United States Patent 10,724,096 (METHODS AND COMPOSITIONS FOR INHIBITING AND TREATING NEUROLOGICAL CONDITIONS) - sequence listing, part 111

SEQ ID NO: 2007 - DNA, 1195733 bp, Homo sapiens
tgtagtacggttccaactcccagctcgcacaccgctggcggacaccccagtaacaagtgagagcgctccaccccgcagtcccccccgcctctcctccctgggtcccctcggctctcggaagaaaaaccaacagcatctccagctctcgcgcggaattgtctcttcaactttacccaaccgacgacaaggaaccagcctcaaccttttaatgcacagcccggccacaggattgccttccatctcctcttggtccctcctggatgtggtttattgatgacttgcgagcccctcagagagctgtcttccctcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggcgcgtgtgtgtgcatgtgtgcatgcgtgtgtgagtgcatgtgtgtgagtgctgccgctgcccgcgacccctggccccgaaggtgttggctgaaatatggagaatagtcttagatgtgtttgggtacccaagctggcttttgtactcttcggagcttccttgttcagcgcgcatcttcaagtaaccggtaagtggctctttcctttcttctcgtcgcacccccttccgtaccccacttcccttctcatttcatttggcgagtagtagaattggggtgggggatagcaagagatttggcgcttgcgctgcccccatttgcgcaccgatgataaaagatagaagagtttttttcttccctgggggcggatgatggtgggggggtggtacaaggggcgccccttcgctgttttaaaatctgatgcttcacgcatttttgcttctgcaaatacttgggttggtttggagagccggcgggctggggcaggtgctggggatatcgttgaaaggaactgggctgggtccttaaagccccagaaacctaccaagtggggaggattggggcaacaggagcaggcgaggaggacatccaggggctttgaggaagtctgcgcagaatgtagatggtggggctgagtcgttggtgtgtgaatacatctccttttggtttggatttttggacttggtgattgagaatagggaaagggacagctaatatgttttggtacttccaaggaggggatcctggtactgaaggaggcacagagttgccaaggaggaggggaggtgtgtttaatattgttttattttttaacggtgaatgtagttcgcaagctgagtctccatatagctccaggacacctccaaactccaagtgattgatattccagagaaccggcgccctgaccctggcacttgcctagctcagtttctaattaaaaatggcaaaactgtttggggattggatctggctagtgcaggagaaagagggacctggaggctggctgatcaggactgctgtaatctccgaatacggagctggcggcttcgacggccaaaagaatagaaaagagcaaaatgactcatgataaggtccacttgttttgcgggacctcaccgcaagtgtagatgggcactggggtacagtgagcggtcctggcaaagaaggagaggagagcggctggatgagcattcagagagcccttcggaaacgacctttttccaaatccaaaggaaaaacaggctcaggcagagaccgggcgttgagtaggagctccccagttcgtgcctgggaaattaacagggaatggcacatcaatcgcggccaagcccccagcctccccggagtccgcagctccggctttctcttctctgctaagtgctgcatggccaagggttgcgaacgcgagcagaaaatgcgcctctcactgtcgcgagggattcagacagtcaagcgccaaggcagcccgaggctccccaaagcctcgctcggccgcacgcgggcaggaatctgcgcttgcactcgggctcagctcctcatcttcctttggccagagacagagagagcaggcaggaggggtgtgtgtgtgtgcgtgtgtgtgtgtgtgtgtgtgcacgcgcgctgtcctgtgatgagcgcgtacccgcatccccgcgcttagccgctggtgctccctccctccgtctgtccctcccgggccggtcccctcctcccctggctcttctctcccggagctttgtcctcaacaattactctcgcaaaaggtgggtgggggtgggggggtgggcatctccacagtaatgaataggtgtctgttttaaattgcctcctcgagaccctcaaatgctagaggctgcggggaggaggaccctccttctgcccagaagattgacttgggctttctatagcagtttgggagacctatgcggacgggaaaggggaagttcagggggcatcccttactgggtagaaagtctgcctaacagcagcactgctgacctgaaatgtgctagctgaatgcactgcatgaagcaaggtgtacaaaaatgaacaatgatgtcttgtcaattacacgacagtattttaaagctattactcaagtgacttttgtctggcatagggtgggggtagattaatagagataaatttatgtgcgttttattaatgtctaaattaattaaatattctctttgcatttatttacatttcttgtccagagagtcagggccatgtattactgcttcattttaattttctcctcaacagacagatctatgcttgaaaaagcagatgtaaggaagggatacatacacacacatacacatgggttatgttggtggataggctaacggatctaaatctttaaacttttctgcacttctaaatctatatctgttatttgcaagtgagtcgtgatgcagtttgcgcagctcgcaggaaagtggatggtgcatttttaagatattgccaattcacaacactctggcctttgctcattaatctgagtatcacttctttctcttagtaataatttcccctgtttaggaacatggcaggaaacttacaacgagaaagcatagttcactctataaaaggaccagtaggaggtgcccttaataaggccaagtgtctagtttactggcagagaaattcccattcagccgggtgttttaaagactttgttgattggtaacaaaggattatggagactagcacaatagcactgggccctttcccactttctaggtaaagtctgaagctgctgtagatttgtatgaaactgtgatgatttaacaaaggacagccctgaaaagtgtcagtagagagtgaggacttgatgttgggggaggaggatggtgactttttagttggcttctgtaagatgtcatcttcttatatatttgacatgagccacaggcacaggaaccttatagagtctcaggggatctcagataagataacaattttggatgttggatgttaatgagtgaaaaatgaggcatacatattaattaattcttcatacatgtttgggttccattgcattgaaaaaaatctgtgagtgtttaatgtagtctggatatgctgaaatgaggctggtcgccctccctaggcgacctcttctcattcccccaaccaaagcagatcagatgcccccatgtgggtttgcttttgagtggcgggagtatggcagagcctgagggctcggggtaggctggcagtccactcctctgtgagtgccgcagtataaatcaccagtacctgtcagtgtccatttcccacacagcagcagctgccctctgagttataaagcatgggaaacggccaccacatgtgttatatgtgaatatattaggcttagtgcctttgctttaatgctcttaaaagccaggctggcttgagatgctgataggcatttttttctggggagagatttataacttctcagtgtgtatgacttaaatttattctctggcaagttaacctcttagcaaacttccttattgttttcattgaagaggaagagccttaatcctacctaaattcctgaatgaagctctgctgaaagtttctgctagagtacaggatatttgcaggctgtagtatggtttcctaaaccaatgggaagcttgacaagatatatggggaggtgattttttggtggggaggcggggatatttttacttgtttttagagagggaagttgtgatactgcatcttctaaaggaattctagcaactcagttatctcaaaagcatctttaatgagaggaaatgtttctcgcttccagtttcatacatctaacagtctgggattcttcaaatgcatataatatgctcctggaatgtttgcagctgcacgcagtagggtcatctagcaggatcactgtcatttggaaatgagccctgatttaaattttgacttgcagacaaaacacttatctttacctggtgcggcatgtttaaaagcagtgctgaagtttctgaacagaatatttctttccatgggagactgtgccctaagattacattttaaagtaagtgttcttaccatttctttggagaatttgccatcccaaactttgcatgtgaaacttcttcttcatgattctaccagtaaagataactatttaaagagaatgcagttgtttccgggtatttctttaaaattaaaattcaatgtccacatccacacacaaacaaggaggatttccaccccctcataccttctccttcaaatagctgactttggtgtgaattatgatagctctaattacataagggcacttgcaatttccctagagaatgagttcttgcctgattacagatcttcctactttccataggaagtttctggcccacactactatcagaaacttgcaccaaattgggaacacattgctctgttttggtatttgctacccagctatacatttttgaaggattaatctacctcagatgataatctcttagatgaactatatacataaatttcaagaaatcttagctttgcctgaggccaaagaataatgtcacaaacctgctgaaattacttgattaattgattgattaactaaggataaaaagtcacttggttctggaaaagtactgtactccctaaagagttctaaagaggaatagtaaatactatgcacatttacaattcataaaatgtaaacgtcaagtcttcttccccctctttttccattccttccttataatgctctggaggaaaatttaagagtttcatgagttgtcacaacagttatatcttaaggaatcatagcttggaatctcactaactcatgattaatagacactcaattaaatagcaacacaatgtccggtgaatttttcggcagcctgctgtgggctgcttgcttgttttcagctcgtttctaaggaatcaaaactctcatctctaagaggtgtggcatcaatactgcctcccttgacgcagcccaagaaagcctttctcactctgaaaccaaggctgtgacccacaggcactgtgtttaatatgctgtgttccactttgcaaggtcagggggatttgccttaaaaataaatttttaaatgttcatgcatgctgcttttggtggagagttaaactgtactctaaaagcagctaaatagtgttgttatcttaagacattctaacttgtggcctctcagccaatattattgaagttctagagctcacaatctttaagagagacaggagtgagctctataagataataggttatgccaacctagttaagctacttttttccccaaaatggtgttaccaggttggaataatagaacgttaacctttttcaaagttactacttttcagaggaaaaaacatttcttaataatatcataatatcagtagcatgggactgacccaatgtatttaagatattgttcttcaaaacaagatatcaaggaaagccagtgttaaacttgtcaagaagaaaggatgaacaatccagattattttccctgcaggccaataaaaaatgtgcaagatagaattacatgttgcatatgccaaataggtaatagcaaaaaataaaatgtaaagtattatgcacctttatcattgcaggactcaggtaaatgaaacacaatttagtaacacactttttctttctctcactctagaatgttaattccttatcttatatttctctggtttaactccaaactaagatggagaaatacaggttggctgactgatgatcaaaattattatagtgctccaaagttatttgacaaattttagcctgaggtttaacaactaaatccctttaattcaactattaagtgaaagtgttttctttggtagtttagaaatacctgagctttgtcccaatggtgtggtttagaaatacataataatgcataagattgaatatgccttctttttcaatattgatgggaatttgccaatggtaataccagtgcatattgctcttttattaatagttccaaacaaccatattattcacagctttcatttcttggggggaaaagttcaagtaggaaacacacaaatcattccatatttattgatcatatttttaaggctattcttatggcatgacttctgtaggaatgtttctcttttctagtaaattccacgagcccagtgtctatgatctacttctacttcgtgatatactttagcttaatttcactaatccaaattttttgacttttagcttgctcagtcatttcaccatggccctccagggaggaagaccctttaaaaccatttgtggttatgatgatgaaacttaacaggagtatttattgcaatttggagatttcttcctggttcatcctttaaatattggttcttgcctgaaggctactcctaagagtatctaggacaaacatgttccactgaattaactgaatctttaggatgttatctgatgaaaataccaactggttagtgaattgtgttctgataagaggacttgtcaatacaacattattctgggccatctacaatgttcttaaatctgtgtttacattttgacaagagaaaaaagaagttaagcagttaatataaatgtttttaactcaaatcacatttttagattttacttatttttctatagtcttttagaaatatttctccactcacttagctgcctctttaaaagtatgtagaacataatttaacctgttcttaatagatacaatacatcactatgacttcattatagtattatgtgattttatagggataatttttgaaggcattgcatcatacagaactgtttatttttcccatcaattgaccatggactgttactattgttgagttttatctctggctataaaatatattttgtctacatcttgtgttcagctgaaacttctccctgtataaaacttcctcaaagcagttctctcttttagttttgatgttaagacataggggactaagttttgttggggttgtgtttaaagtaggagaggagattagaaaacagcacctgaatcccttattagaggaatatctaattagttttaactaatgattctgtagcatctgatattaatttggatgtcacttgtactttgtacaacgtatttttccttattaaatgagaatgtggactagatcaactctagttattagtttcaacactatataatttatttaaattatgaactgtactatacatatagtgtttggtataattaataatacaattcatgatcatgataacaataataataatgtaataataacaaatacccatgtacccactagcagttttctgatttttgtattaaccccttgccttttgtacagtttttccacatatgtatacatctttaacatgttactttacttggctgttcttaacagtaataaaataaatataatgtgtatattctctgacttgcaattttgctgaacgttaagtatctgagtttcatctatgtggattcatattgctgtatttcagtcactttctctggtgtataatacttcatgatattaattaaccatagtttatctaatctattgttgatggattttgaaattcagttttttgctattgctagtaaagttggcataaacattctggtgcatgtccaccagcacaaatttgccaccatgtttagggtgcatacctaggagtggaattgctgagtcatagaagggtatcttttcatccgggaggcaaagacatgttgcagttactgaaacccccaccaggggcagatgaaaggcctctttgcttcatgcctctgccaacacttggtattttcatatgcttaatttgcccgcatctggtaacttctcattgtgggtttaattcgcattttcctgattgcttataagtctgaacattttttccattaatttgttagctatttgtgatgtcagcaagacaattctatgattctgtttcttcaactgagcaacatttgcttttagaccttaatattattggtagttattctgtttcttctactaagcaaccctttgcttttaggcatagatgttatcagtagtctaatgttcaggaagttgtcgcctaatactttaccatgttgactctggcctaggctttatttaagcaccttcccaaaatgtacactgattttgagttggaaaagacattcttagtcactgtaacattgttgattaccctgagcaagtcctgccatgttagtatcctgccttatcctgtttattgtgtctttatagagaatcatttacagggaagcaggatgctgggatgccaggcttaatttgaggctccttatgaatcccctgaatataatggaactaaaggataacagaaacacagagtagtaatggtagacaccaaatctgagttaaaaatcttaatatgatcatttgaatttgggtatatttccaacatggtaaaatacataggcccaatatcattgttacatttatggcatatataactgtgggtttcaaacaaacgtatgtgctttgtgcaccatcccccccaatttttgtttgggtttataattttttcacctgctcccatgggacaggctaatgaagacccctgaatgaaataaagcctcagatgtacttgcagaggcctctgtagtgtgttgccttctgtgcagactcattagagatgtgagccaaggctgagacatctaagcaaaccctctgcacccagagtcctcaatccattgttcctgcatcttttttcagtctcatgggatcccagaagaatacaaattagagagaagaatctgcaaagcttttcctttcatgtttaatgtctgggcagagctgttccctgcaggacaatttctggttattttctctctctggtttgaggcatctccagggatggtttggtgactgtttcccttggggaagttttcagcagcatatcagttttactgttaaaagtttattttacaattcatctgagatagtcctgttctaaatgttctttccattacccttgtcatctggctcttgattcctgcatacccttttcagtgacactgcctcttctgggctgaaatgtgttcaataattcgagctataaatcactctcgcctccccatttggtctttacttaaccagattataaatatttaattcatttgatttttcctcataccactccagaagcttaatcatgtttagtcttcttactttaactccctctagtttgtttatatctttcttgtaatcaaggggcctaactctgatgtgctcttctaagtaagctctccagagtcatattataaaatacaaattcagcatcatctttagcttattgtacagccatagacaaacatatggtctctcaaaacttgtgttatcagttttcaggaaggactatcaatgcctaataaaatcattgagatattataaggaccaaataagaccaagtatttcattgaagatagtacaatagttactgagcctttaccaacgattacaaatagatgaataaaagatttagatgagtttctgccctgcaggggcttttcctccagtgaaggtgacaggcacacacagaggtaggtaggatacaaggtagaacaaagtactcaccgaaaagggacacaaacagttctgttcttcatgtggtttttgtcattggttctgtttatgtgatggattacatttattgatttgcgtatgttgaaccagcctttgcagggacatggatgaagttggaaaccatcattctcagcaaactaacacaggaacagaaaaccaaacaccacatgttctcactcataagtgggaggtgaacaatgagaacatatggacacaggaaggggaacatcatcatacaccggggcctactggggagttgggggctaggggagggatagcaataggagaaataagacaggctgatggatgcagcaaaccactatggcatgtgtatacctgtgtaacaaatctgcactttctgcacatgtattccagaacttaaatataatttaaaaaactcataatatattaatatttattagctaatggactgacagagccaattcattcatccttgtatccctaaattgattggaccaaaaagaggcaagggagtttaaagagttgtcaatcatgtttaaaccaaagtattggtgtggtaagaatgaggatattatggttttgcctacagatctggtggcctgttgctgtaaaaacatctccagactttcgtgaccctttcttcccatatttcttgaatgtgttccaggtattgtgttaaggtggcaatttagcttacagcccagtgagataaatatgctaatcaaatacatatgttaacaaacccacaattccaaatgagataaggctttaaagaaagaaaatactgtaggaaagggtctcagacagcagatcagagacagcttccatgagaaagtgtgactgagtttacatctgaagaatgagttaagaaggggatatttaggaggggcagacgagagaatatcaggtaaaaaaaagtgagctcaaaggccccatggtgggaggaaaaatcatgaattccaagatcagtgtacccaggaccactagaactaaacataataatggcttagctaaggctggagaagactttgggattctctctctccagtagtagctacttgtacttggtagatattgactgaataaattcaaatgagttcttatcaaggatctttcctaatctcagtacaatgattcaaaaatttctgcaaactacataggccaccttttccttgatttttttattagatgtgaatttatgaacctatctatcctatatgtttagagatacattatgaggtgttacggacatatgtatgcaaccgagagagggactttgaaaagtgtacagagctagaaaaatccaagtaattatcaattaacttggtaataagtcatttctcctttgaaagctatcactgaacagagggaaacaaaacttcaccttttctataaaaatagaattgccatggacattccttgttctggggcctccttcaaaatgtgtgcctgaacgtgtttagtaaacctaaacctaaattttttttggagtttttatagattattttctcaatatgatccttttctatgcattttgtccctattactatttcttaaaaacataaacgaatgttctctttgctttcagttacagttcatttagaagtcattgagcttgtaacctttccatgtcaccggacctggaactactgtaccacttgaatcaacctaccatctaccactggatgttgcaaagattgttgctacacagccctgtggtctttggtctcgataagagggggcatagcctagggggaaaaagcatcccagctattgggtttgattgagatccttaaaccactggacctcaactttcccacctataaaatggacacaaaatcaacctctgcttcccaactctaaattgggggtaaaaattactccagtagttagctatatacaatatctattccaatgcctgacttataataagtatttcataaatgctagctattgttagtattatgttagtatgggctacatttatcccgaggtagtctttacaaatagaaaatttcacaggcacaggccagcccttctagaacctgcctcaattttattgttgtgattttagagacttaaatataaattaaggtagtcagactccaatggcaattttgaaatcaatcacatcatggtttagtggaccctggtcccatgcctttgcttgatttagaggctcataggtccagctaagttagatctgacatagtgcaatactgatcaaacttggcagcgtatgacacacttcctgtggattttccatccaaaccatcctcccctattaactcttccctggttgaccatgtccattttctacagacccgtcatctactcagcaggcacacctagaagctaatacttgcttggttaatgtgcagtactgggtataattggtcctgagggtcttctctgtggaggagtggctctcatcttgattttgtgtcaatgcccagcccttcttcataccaattaatttagaatctcggagatgtattccaggcacaagtattctaaagtctctgatggtgattccaacatgcagtcatgtttgagaatcagtgtcctagggtctttctactccaagtgtgcagtccaggaatcaaggcatttgcatcacctgggagcttataagaaatgcagaaacctcaggccacacccagacatactcaattagaatcccaagtgactgaggaatactgctctagatgactgaaagcatcagatagggaggtgatccttgcctctattcttcacaattgtaagtaatcatgtagtcaatgggaaactgcccctaccacactagtttttcttagcttgaagcatctgttgcatgctttggcttcaggagttggtcttatagtggcaagctatgccaacatcaaagagtcttctggtttgtggtttagcggcaaatatatttcatggagaccatgacacgtttcattttccttgagattacaagcccttgaaaatgctctttgtgtgttccatctgccttttcccttcttttctcatcaatactcatataagaacgcatattttacaatggtctgctggttttcattccatagtttcccctccttcaactctctttcctccttaaaaatgctcagacccagggaaaaagaaagacacataaaagggacacagaggccctgggccctcctcctccctccctcctctgtgtcccaagtctgatgctgagagcacacacatgctcaaagtgagaccctgacgggggctaccccatactgaacctcgccttttgattggggatggtcttcagggcatgaaacagaccaagtgctcatttgcctgagcctctgtggcagggcagaaggggtgtaacagaggtttttgaagaagagtaaagctttacaggcagaaagctcagtgcagggttttgaagcttttgctctgcactgcctggcagagagagcagctttaactggcgtgctccaaatcagagtctacacgaagagaacatggggtctcagctgcgcagattggatcaatctgaatgaaaatcactagtgttcctcctggggagagaagtttctgcttagctcatgaactgtaggcccttctctggccctggtagtaaatgagtagagcttttgtgaaaggttatgtaaggctgctgttttctctccctgcctagagtaaaattctatttatagagggatgaactgcctctcagcgaaacatgcattttataaactatagcttaggaaagataatttaataaatctttaagaaagaattaagggaagagagagaacaaaatcctaggcagagagagtgggatatacagcaagaaataggagaaagagaaagcatcattgttctggacttagttactggagtagtaatagagtgaccgatcattcttgtgtgcctgggattgaggagttttacaggaagaaggactttcagtgctaacaataggacagccccaggtaaactggaatagtttgtcactcctaatttggtacctatgatggggaggggagtagaaagaaccctgaaagattttcagcagggaaatggcattttagataacacactgttagtcctatgaggaaacaattagagaatgatagcaaggcctattatgaggggatgttctaatcgtccagaaaagatgaatatctgattggaggtttagaagcaacttagatggaggccttaccctctaatcttgtggcaaagtctaacttgacatccaaaactgaaggtttttttaaccaactccttggccaaaacactgtcagagaacgcatttttgaatcaggttatcttttggacatgataggataatgtatgtattggagaagtcatgtctagcacttctgtgttccactgtgtctagtacagtgctgaatgcatattaattattcaataaatactcattaccaaattggtttttatataatgattattctcaaatttgcatgaaatctgaagtttctttctgcatgagcttcacaaagttcagttcaggatattgtaaatttcaggattactcagctattacttgcctcttctttagaggtttattctgttttctttttctctctccccttcttttgcctgatttttcctttacatgccattattaataatgttattggcagcatttcagagtgcttgtgagaaattcaaaattgaggaaattctgcaaatagcaaaatgtgaatgtataaagtctatagaatttgctatctctttaagccccgttacgaatgcatatagggcatttgtcaactcgcatatatgaaaatggaacaagataaagtaggtgaataattatttcctacataataatcccagggatagactctgtgtttgccttcagagcaccattcctgaagacttgagtgagtcaaagcattaaaatgttatttttgtagaaatcagtggaagtcaagacaagatgatggagattaaaaaaaaaaagcacatagaatgaaaagcacaaaacttcttgtgtttcaaagcactgatcaggcagaaaaggaccttggcaggtgtttgagaagacccttttctactggtaaggactcaggggcccagagaagctaggtgagcctctaaatcacaaatctacgaatgagttccatgaaacatattatgtacacgtgggtgcaaatcttggctctaccaagatgtagctgtgtgaccctcactatgattcagggtcctcatttgtaaaatttggaaagccattgctgaatggatgacatttttgaaaaacattacactcaaggattatcacagtctttggcacatattgagcactaaactgtttctatttttatttgttcattcgacagatgtttttaaaggtaatgtttcatgtatcatatttgttagcgcctgtggtgtatttaaacagcatataaacacactgcctctgttgttttagttaacaaaatggttggaggaataagacctaagcagtgcaagcatgtaagaaaaaaaaaggtgaccagagtcacaaggcaatatattattgtattattaagaaccaaatgggtgagaggtgcagttagaggagagaaacagaacatgatcagaaattcttccagaatgcagagggattgagtctggtaggtagggtaatttggggaccttacccacataggacctgaccctatgtggacactgttctttacatgttcaggctctggaagacaaaaaagaaaaaaaatgatggtgatacttcactgcagaaagcttcttagtccaggcaccagatctcatcactagcaatgacttccctggtcactagccttttcccaagcgaatttatgataaggctaggagaaaaaggaagagagatgtggcaaggtcatctgagaagtaactttggtggcatacataatgtaattttaaaataaagaggctttaccagtagggctttttataatagttttaaggaggtctcagaagctcagggaaggacagatgccatcacacactgcattttgaacttggaaatctagtggctgagaaagcatatttaggctcctgcactactggaataagtctgtgctggaaattaatgttttcatctttttttttcagccttgcttcaaaatgtatagaaaactttggttcaggatgccaaaaccctttattactaatgcgtaaagggtgttagctagttcatcaaagatcttctgtacattttgcggccaaagggcaggtagcccagctcaaaatttgcaacttaaatagcttttcctttgttctttgttccagagtacacagtcatatgaggttatgataattaataattgataaattattattaggatgatattgttccatgcttatctgagactttctgtcttccaatggcttttgaatcttttatccatattcatctctcaatacctctatcaagtgggcaaaatggctaagttatctcacatgtgttattagtgaggttatgagagtaggggccagctatttatttaagatcacacagaagttacctgttctggctggaaaacctaaatcattttttttttttgagtcagagtctcactctgtcgcctaggctggagtgcagtgatgtgattttagctcactgcaacctccacctcctgggttcaagcaattctcctgcctcagcctcccgagtagctgggattacaggtgcctaccaccacacctggctaatttttttgtatttttagtagagacagggtttcaccatgttggccaggctggtcttgaactcctgatgtcaggtgaaatgtccaccttggcctcccaaagtgctgggattataggcataagccactgcttccaaatctggcttaacccatgtactcaccagtacatattggacactttccaaaagcaggacattctactcttttattccccaaaaattcatgtactaaaaaaatgccacctagcactcagatcttgatttctaataccattctccaataaaagaaaccagagctcctcagggaaatagttgattctggaacttatgcagaaaacatacaagataaggctggagcatcttggagtgccagaaaggaagaaattctttaaaaaagtgaaaaacccacaaagatagagtatgtcaaagggacacagaacctaactgaaagcactctcaatggtcaaaactgcaacaatttgagcaagaaaatcaaccaagtagtttcctattataacccaaactataaaataaatgtccatgagtacatactgacataaataaataattgaataaataaagagaagagacttagataaatcccctatgcagaagaattcaaaatattatatatactctactctcgaagagtagatagagtacaacccatatccttttgagtgtgggctgtgcttagcgacttccttccgaagactatggtatacaagggggaggggaggaagttaactacagtagaaaaattggccggatcatgaggtcaggagatcaagaccatcctggctaacacggtgaaaccccgtctctactaaaaatacaaaaaaaattagctgggcgtggtggcgggtgcctgtagtcccagctactcgggaggctgaggcaggagaatggtgtgaacccacgaggcggagcttgcagtgagctgagatcgcgccactgcactccagcctgggcgacagagcgagactctgtgtaaaaaaaaaaaaaaaaaaaatctgacaaacactacctcagccaggtgatcaaagtcatcatcagcagtgataagtcatgttgatagcatgtaccccctgatatgatgtgataaggatggcatttcacctctgtgatcttccttttccaaatccataaccccagtcttacaatgagaaaaagagtagacaaaccccatttgagattctacaaacacctgaccatattccttaaaatgatctaagtcttcaaaaataaagaaagtgtgtgaaacagcacttttaacaagctctctaggtgattcttatacacacttcacttgaaaaccacttggctgtgcattgtccgtaaaacttaataatggtggctctctgcttattgagatggtctttgagctcaggggatgatctggagtcaggtgaacttgggtttagatcccaggcctacaactttctaattgagagaacaaagacaagatattccgccttttttgtgcctttgtttcttcatctgtaaagcaggaaaacaacacttaattcagagagtacttataaaatcatttcagaaaagccatgtaaattatttaccatattaccatatttccacattaccactgctcaacaggcagtgagcactagcacgactctactggtgttctattagcttggttatataaatcaatatgaacataaccaaaattactcctcattgttactgatactctccaccctctaaaacttgtctttggcatcctgcaatgctttccttacatgtttctaggagtcctaagagctatgtcataaaccagttatcttctgctaggcatcttcacatgtctggaagtctggtatgcttgctggctttcatgtccccaggcagccaccgtctcttgccagccatcctgctcctctggtagattgctgctgcagcatcaatgctttagaacgtttccagtgcctgagcattattactatgtccactgacaagactgtcccaatgttgattctccctctgttaaactctatcatactgcttgtgtcttccaatttataaaatcctccatgacaacaattcatttaactagggtctgtaatttttctctacatatgacttagattcagtaagagaagggctgatctggggacagatgttgcatttcctattccctgtctttagcctttctgtctccaacccaccaatggaacttcttccttaagtagtatttaaatctcccctacataaatgagttactgcagagagatgtctgtatttttagaccatacaccataggctgtttcattgggtttgaggtacacatgtggtacaaaaatgtagactaataataatggttaatatttatgaaattgtatggtttgaagtgatgtggtacatattgcttaagaaatacttattgcccacccatttttatatttaatacagaagaatatcccattttaagtagcaatgtgctagctcaaagactcgatttctcaggctcccttgcagctaggggtagttatgtgaaagttctggtgattggcatggtaatcaggacacttctggggatttcagagtaagcttactctcctgtcctaattaccacccccttcctccttgttgcttccttctttctctggaaagtaggagtgaggcctgaaattgaagtagccatcctgtgttacatcatctattatgaacaatgagaaggaaatgaggagaagcttgagtccatggtgacttccttggggtagctatataatcttgggattgtttctttctagacttctttttatgctacaaagtaaacctctgtttgattttaaaacactgtaatggggtttctgtcacaggcaatactcagttcaaactgctgtatgttcccatattatttttttcctcacagttaaacagtgagagaggaattaatattatgtccttttacaagtaggaaaagtgagacaccaaaaagttggccaatttttccatgcctccatgctagtaaattgcagacttatgatttaaatcctgctccataacatgtccttaattaagtctatgctataattcctagataaatagatgttgtagctattacactattgttgttatttttattgttgtgggtaattattacactattgctttttatttttttgcaaatcacattaattcttgcaatgttgttttatttttattattgttattctcctctctaaaagagggatcttcttctgtgaaccgtttattatttagacacttctagattattgagtatataaataaaaattcaattttctgttaatcattttcaaatgtcacagttttcactaacaagttataagacagcttcatgcactttaatttcctctgaagaagaaatccactgccaccttataaaagactaacattccaaatacagctttagaatgctaatgccttaccttaacaagccaacttaactctgtgattcacatatgtgctgcaatttctctcccattgtagtgtaagggaattttgcacagttttgatgtattgtgtaaattaggccaacaaagtgctgtgctatgtcttcattaaaataggagacggtaataatgcaaccatgtagcgtggtcttgcaggctttgagttatgaacattcaatagtgtctccttacttgtgcttaagttggcatttgtgagcagcatataatcaattaatcaataacccaattttctcttaaagagatggtgcatgatttaaaaaaatcagaaactactgtatgattttatgaaaagagccatttcagcaaagaaacttgttttgaaaacactgaaagtcttttttggggaggacaattttgcttaactaagccaaaaatgaaattggatacaaatgtttagttcctgaattcttttattgttttgcaactacagaaaggaaagggccagtttgggattgctagtaagaatgcattgtttttactcatgattggaggtgtgtaagtggacccatctatgaatgcacagttaaagtcaattaatcctcaaacttacagtttaaaactcatctattctattacttacaagctttagagtatactaagttgcctaatttgtctcacatgaggtcacagcagcgcaaagtgatgctttcacggtgatgaagctgacagtcatgttgagacaaaaacctggccttctcaaactttaatatacatttctatccttatctttattataatttctacctaaaaagatatatatgcttattataaatattcaaatattacataaatgtgtgagtttgagaaggaaattgttccataatcccatcacttcagaataaaccacaatttatttgttttgttcagtcttttttgtctctttctctacctgccccacatttactgtgaaatttgtggaaagttaatgtttatttttgcattgcattaagatactgagttgtgttttctttctaccaaataagtaaaaagaaatatcgtggaaaaagaaaacctcaaatatttgctttgttatttagacaacaaaagacatgattgagatgagaattgtctctataagacagatcaccttccaagagagacacgtgctaggcatgcctgtcttctaaaagtgtcagttccaacgcctccaaaatgttcaactgccctcttgaaccttgcctctaaagtgcagcctgtgggccagccaacctccatatcacatgagagcatattagaaatgcagaaactcaggcttcatccaaaatttactgaattcgaatctacattttaacaagatccccaggtgatggctatgcaagtcaaagtttgagacatatcattctagtaatagcatgtttcctactcaaattgctaccatattctaagagctgtgagttactcatgaattagcaatggtgtgcagggaaggaaccagtatcaccacagctcgttcatgtggcttctaaatttcctccaaagggttgagtgttgtgctcattaaacagtgtcaagaccagaataactgtccaagggctggctcacatctattctcttcatttaggtcatgacacacattctcatccatacctctgaagtcccaaggcactaaagaccacattgattggaataattgtgtcttctattccagtaattggttgctaattatgcatggcttgatgttattttgctaactcatatacaccaaatgaaccatgagttgcttgaaggaaaaggccagtccctgagctcttttcttcaaggatggcagtcctgtttccagacatctggccattcccatgaatgagtgaatgatggttattaggtatgttagctccatttatccaaccatttgtgctttccacagatccagatttgacggttatgtcccccacttggagctgggaagtcacaggacttacttgataaacagtcaacttctttcttgaatttatgccaagacctcatatatctatctctttatgctctacgaccaccagcattggttggtggcccagttagaaacaaaaagatcggggataagtgtaggacctgtccaatttgcatcaagtaatctttcataagtttgtaaggggaagataagggagggttataaaatttgaatgctataatagattttatcttgtagcctatagtttttattttttttctcttagcttctaaaatctatgattgagtttctgttttgggttattaactcctgaaaccaagaatatcagaggaaccttaaaaaaatagaactttggaatattaaatattgaagaagaaaagctgaataatctccctataggcaggttgggagtgggagcagaatcaaacaaaacttctctttgttcttttagccccccccactcccctcctccctccataaaccaaaagagcatttatttacttgggctgcattataaacatctatctttctttcgttcattcattcgttcatttccttccttccttccttctttcctttctttctttatgacagagtcttgctctgtcacctgggctggagtgcagtggcgggatctcggcttactgcaacctctgccttccgggttcaagcgattaccctgcctcagcctcaggagtagctaggattacaggcatgtgccaacacgtagtagagatggggttttgccatgttggccaggctagtattgaactcctgacctcaagtgatccgccacctcagcctcccaaagtgctgggattacagacctgagccactgcatccagcctataaacacctttctagggataaactttgttggtttaccatcacataggagactcagctcatcaagaagtctgtattcagaccaggttcagctcagactaattaatgaaatcatgtaattgatgggttctgtttctatttctagagctcttatattttgatatgagaatatggaagtgccaatcaggttcatgaggtcacccttcagaatccctcatttctcctttctctcctatcatgtagctgatgaaaaatatagcacacttccttcccctgaaagattcacattagttgtgtcttggacacaacacctctcttgctctttgcttctggccatatcttctttgactcagaaggctttatcactggggatatatgtcaggcaaagatgcagttctcagaaagtttgagagcaggggatgttatagcccataagaaagggcacaaggccaaaaaagagaactaggctctactggtcaattaaaaaatatatatttaagccattttcagtgttcagccaacaggaagcattatggatgttcaaattgctgaaatattagcatacttcctcactgattggtaaatatttgctatccagggcctcccaatgtgccctgcttcctccattctgattggtgagtgactatgccaatcagctcctaaaagtcctccttctaagatatcaacattggcttttttcttagtgactttggagggccagatgtactctcacccagtcctgggaaactctgattgccctttagcccttcagtctgccatctacactgtgcaacatggcaccccatggcccatgtgccttctgtgcttctctggccccctgagactgacacctaagcaggttggtgttccttgagtcaccctctcatggccatcagtgaaaaccgcagctccaaaagaagacaaggtcaggaatctccaccacactgatgcttaaatatgtttaatatttaaataccacacattttttttactctgttctgtggagacaacactaaatgtctttatggcctgagaaatgttcatagaataaattgcatattatgtagtgattggttctatgattgctataaagatttttaaaacttttagtatcttatttaccaaagaaaatatgttcaatgaggaaagcatttaaacaggtatataagaaaatataaatcactcatcgttacatgactcagagttaattactgttaaaattttgataaacattgcatgtgtttattcttaatagtaaataaattatattgcatatgctggcataacttaaaaaaagcttagccatctattatgaatgcaattaaaagaccaaagttttctaagagttgggagggaacttggaaatctgctagattcattttctggtgaggaaaacatttattacatagcattcctccgaagatcctctagcttcctccttaataccaccaagggcaggttccacagccttattatgcctctgccttaaattatttttggattagttattctagaactttctgttctactcttctcacctgttgcttactcattgatcctggttttgcccttcttagtatgagtggaagtgggccaggaagggcaggcttagaggcagtgaggaggtggcatggtgaagtcagtggccattgtctttcatgagcaaaacagtccttggtcatgagactgaatgagtttcttgggtgatccttttcacctcctactcccactatattttttcttcagagacttacattgggggacttatgccttttttgtcatagcagaaaactctaaatatgtagaaagtttaaaagaaataaatctcattggctgaacacagtacattttaggagacaaaaaaaaatagaaggatgtgtttgaaaataaattgagttggaaaatatctagaggtttcttcactatcatatggtatgtttaaacttgtctccttgtcatcttccttgctctctgatcttaagaagattaatgagatgatgatgtttaatgcttgaatgtttggaagaagagtgctttgcaaatgtcaagggttagtgttatccttcgcagtagtgattgaccataagactgttctcgttattgtatttcattaactaatgctctcatttatcaagtattgaggcaagggagatatagtagtgggcaacagacaagatccttgaaaactgtttaatgaaaaagataaacaagtaacacatgattacttattaaaggaattaaaatttatttaaaattgtgttaatatctctggaaaaaagaattccctttttctctatcttaacatatagaacaatgggaatcttgggagtactaatgccaattgcttgggtggggtttatggtctgaggtacgaggggagagtatggcagtgaaggaaagattactgagcaaagctgagaggggaggagggatgcagcaaagggatgctaaactgggttgcaactaagtcctccttctccactgtagtcagatattacttacgctgggaggacgtgctaatttttcaacacttacagtattgctacagatcagagattagcagaattattctgtaaagggtcagatagttaatattttaggttttgattgtcacacaatctctgaggcaactgctcaactttgccatagtagcacaaaacagccatagccaatacataaataaatgagtatggctttgttccaataaagcattatttataaaaatagtctggacttaacctgcagtccatagtttgctgacccctgtaccaggctcttaccgcttgatcacacacctgtgtttaaacttaaggcatcacgttatggaattgttcttagaatatagcttcttacaactctatatattacttgaattttatgcattttacaacctttgtaatgcctatcatttttacgtatatgaaggagaagagagagattttagcatgtgcttaatctgtttatgctgactcctgactttcctcctataaacatctatgtttaaaatattagtactaatgtgtccggaattggtgggttcttggtctcactgacttcaagaatgaagccacggaccctcgcggtgagtgttacagctcttaaaagcagcgtggacccaaacagtgagcagtagcaagatttattgcaaagagcgaaagaacaaagcttccacagtgtgcaaggggacccgagcgggttgccaatgctggctcgggcagcctgtttttattctcttatctggccccacccacatcctgctgattggtagagccgagtggcctgttttgtcagggcgctgattggtgcgtttacaatccctgagctagatacaaaggttctccacatccccatcagattagttagatacagagtttccacacacaggttctccagggcaccaccagagcagctagatacagagtgtcgattggtgcgctcagaaaccttgagctaaacacagggtgctgattggtgtatttacaatccctgagccagacataaaggttctccaaggccccaccagagcagctagatacagagtgtcgattggtgcactcacaaaccttgagctaaacacagggtgctgattggtgtatttacaatccctgagctagacataaagactctccacctccccaccagactcaggagcccagctagcttcacccagtggatcccgcaccagggctgcaggtggagctgcctgccagtcccgtgccgtgcgctcgcactcctcagcccttgggtggtcgatgggactgggcgccgtggagcagggggtggtgctccttggggaggctcgggccgcacaggagcccatggagtgggtgggaggctcaggcatggcgggctacaggtcccgagccctgccccgcgggaaggcagctaaggcacggtgagaaatcgagcgcagcgccggtgggctggcactgctgggggacccagtacaccctccacagccactggcccgtgtgctaagcccctcattgcccggggccagcagggctggccgactgctctgagtgcggggcccgccaagcccacgcccacccggaactccagctggcccgcaagtgccgcacgcagccccggttcccgctcgcgcctctccctccacacctccctgcaagctgagggagtgggctccagccttgccagcccagaaaggggctcctacagtgcagtgggggtttgaagggctcctcaaatgccgccaaagtgggagcccaggcaggggaggtgccaagagcaagcgagggctctgaggactgccagcacgctgtcacctctcactaattacataataatgggatctcctcttcagaaggacactgggagatttgatctaatctcaacttctctgaatatttactttgagtccttgttgcttgtgtcatcctgttatgtattggcttttctcggcagagccaatcttcttttcttgtctcaatactgatgatggtgtttgtgttttgtctttggctggtttagctaatctagtgcctaagtatggctgtttctcccagttagcaaaggttacctctaacaactttgatggggtgcagagaatctgaagcagtcctttgaatgagaataagcaggaaactcgcactgagggaagaagttgaaattggctgtacataggcaagtctgcaagtgtgatggtgtactgtgggaattataggtattctttctgcaattgaggcccttccatgctgctcagagtcacagaggtattgatcagaaaggctttgtacctgcttcctttttgtttggaggggttgttccagtccagatagtgacatctgtgaactcactaataagcaaacaggccacagtagttgtgtgaactttgcaggttttggaccttttccactcagaaagatcctgctgtttgagactgggttaaatctgctcttgtctagaggcataggaaagtaatttatgatcacttgtgcagctgtacaccctgtggctagagttgaatatacatatttaccttgaaggagtagtcacgaggtgcaatctgtttcatttctgaaagtatgttttgagtgtcttgaactatttatccccattgtttctttctttttttcatgaacatgttcttaatatcatgggtctgtgtttctttctatttcttttagaattggtaagtagttgttttgggggctggaggctatttgggataaatgaatgggggacaagaagacaaattaatttttaatctcaaagcataccctctgtgctctgaatgttgctctttccaccctgagaaaaaatagcaggtttcagtccatatccttagctccctatgcgtcattctgcaggaaaaatgatcctgtcacacttaagtgcctcacacagcgggtactgagaaagtactacattatcaagtcagagttgctgagacttacaagtggtccctgaccagtgctgatgggtgactttttcccactgttttggatatagtgactgggttcttaagaattagactacttgcaaagtgaagaagttctttctccatagctcccacctcttcattgtctggaaggcagtgtgaaagggttgaaaaaaactctagtctttgttcaggatcctggtaccttcccagacctgtgcactgtgttgcccagacattataccttgcaaaatgaagataagactgctagtcctgcttatgtccaagggagggctgagcatcaagtgatataatgtatgtataaagtgcccagaaaagtatgtatcatgatgcaaatcaaagttgttgttgatcctccatgtggtgagaaggatctggctcagaaagcaccagttctgagtgtgtttctacctgttatagtatcggagagactgagaatggcaagtctttctcttaaggttacaaaggtgtttcatgtaatttctttgtacgaaaaaccgggaaggaaattccttgtctctccaagaatgaatttggtggtatcgatgaagagtcttctcaaaaacgaggacaaaaaccctaagaatgtgtgctaggtgcttctagattctgtttaaattttacttctataattctttgtgggttttttttctttgtgggtttttttttctttgcaaatgggctattcctccccactttagatccttcaatagttagatttttatttgcaaattggttatttctccccacctcaggtccttcaatagtgggaataatttttacaaacacctgaccatcagtaatctgggaatggctgaacagattcaaagagaagtgtccatttcttaccatttgtgttgagtgtgcatgggtgtaggagccgatggaagagtgggtgaataatcgaagaaggcagccccggggatcatgctcatgatgttacaacgatgtcaccaaacactttgcaaatggaggacatcacaggggcttggccttgagacctttctctctctgcctctctgcttgttacatttatttttttctttaattgtcagtactgaaagatattatataaaccaaatctgtattgaaatatcagcatggtgtttataactcaaaggtgatgttactttacttgatcctcattgatgaggttatacagaattggtctgtcatgactatatatctcagagaaatttgaatgcaattaccagagtgaatgtaaaaagtttctgtgatatatacatgggcaggattactacgtttgagtcaacctgaatatgattgggaaaatgaattcaaaggattgtggcactaacagtgtctgacttaatttccctcatcttatccaaacatacagagctaattgcagaaaagaaaatacttccaaaatatgaaaattcaaaagtaatgggtgatattaaaaacagtaattaatttacactcccactaacagtgtaaaagcatttcattttctctgcaacctcaccagcatctgttgtttcttgattttttaataatcaccattctgactggcatgagatggtatctcattgtggaagacagtgtggcgattcctcgaagatctagaagaagaaataacatttgactcagcaatcctattactgggtatgtacccgaaggaatataaatcattctattataaagataaatgcatgtgtatattcattgcagcactatttacaatagcaaagacatggaatcaacccaaatgtccatcaataatagactggataaagaaaatgtggtacatatacaccatggaataaaaggaacaagatcatgtctttttcagggactaggatggagctggaagccattatcctcagcaaactaatgcaggaacaggaaaccaaacaccacatgttctcacttataagtgggaactgaatgatgagaacacatggacacattggggggaacaatacacactcaggcctgtcaggggtgtgggggcagggaaaacatcaggaagaatagctaacggatgctgggcttaatacctagatgatgggttgatctgtgcagcaaaccaccacgacacacatttacctatgtaacaaacatgcacattctacacatgtaccctgcaacttaaaataaaagttaaagaaaaaaacatgtagtaattaattcagaaagcaataagattgaataataattgaagaaaaatcaccaacgcttgagagaaattgtttaaccattttaaaaaatattttttgatggagaagaaaggaataagatggcagagtgtctcaaggaaatcattgtatttttttgaaatttttacaccaaataactatttggaacaacattaccagatggagataatggaacagacttcggtaaatacagagagcatgctagaggttggtggaaagcgggagttcagaaatcaatagaactttgtcaaatgtgaactccattacaaagagaactctttgtcaggggacaggctactttctccctggatgtcatcttgttagggcactggagagaacattggtaatgttgaaaggaccatcttttggctgatttaaaaaaaaaaatcatactagtctatcacttcttgaaactggtatttttatttatgtatttttatatttccagcagttagagcagtgcctaggtgccacaaaatttgtctatgtttgtgtatatgaatgaatgagtggatacaatctgggaaataccaaagtgaaaatagtgtttctgcttttagatcaaagttatccaaagtactaaattggacaatttttatcaaatgcctaagcagtaatttatattttgtgaaatatgtttaagtaaggaaaaaccctggatacctcctaaaatgtaatactctaattttttagagagaacgttagtgaacgtttactaagaggtttcagaacgaaaagtgtttgttagttgttaactcttttaattccattttaccctttttcaccttcttaaaggcttgaagttacttagcagccccgggaagaaggctttctaattagacctccttcccctcccgcctgcttcttctctgggtgtgcaaagcaatgtatggagttcgtttgtcatggaatcatgaaaaaatagaattggtttggaaatgactcttcgaatgaatctatcaattttctgtctggtttatgctagtttcctcatagcattatattttggacctaatggagtttcaggacctaaggaagaatgtgttcttaaatttggcaccctaggttcctctctggcctctgcctagtcctggctgtgggtgttacccaggcaatgctttgataataaagaagaccaggctgaagaagaaggagctgtttgcctggaagatccttaattgcattgtcttactctctgatcatgtcctccttttgatcagctactcatttggtagtttttgttcaccacattgtgaagaagggaatggaaaaattacagaatatcagaatatgtcaaacaagttctcaggttctgagccagtgagtattggggtgaacaatgctttagttatgccctcttcttttgcctccaactacaaagagctggatatctagcaagccactagggaagtttctgaatgagccttctttctgtacgagagtagtaacctctgcataatactagaccccgtgtagctgtagtgctgaagaaaccctctggggattggttgtgtagttggaaagtgtcagtttggggtgagggagtttattctctcttgcaaaaacacatgtgctctgtttgagagtccatgcattggctggttatgaggacagtgctgtaggctaaactgttccacaaggcactccctgtacactgggagtagggctggttgggtgtctgtgatgacctttagagttgacagcaactattacttgtggaaattagagctattttctagtgatatgttatatagttgtatatactacctattacatggcagtgaccctgaatatatctttatgtgtatataggtatgcatgcatcaacactttttgtcatttaacgtgagtgtgaaaccatgcatttgtatgatttagttgtgaatggatgtgagcacagatatgaatgtgcttacttcatctgttccctcacccaccctctttctcacctcctagcttagatatcaaagtattttgacggtgcaaaacccaagaagcaatgtggcagctgcacatgcactgaatttgatttgtatacctcggggcagctttgggatcacttagaggatgaaataacaaaaacccgagatgataaaagaagagacaaccattggaaacaatttattgttcgaatggaaaatgcagtgcattttgctaaaaacctgtccttgacaccattatcttgttagggatgcaggagcctctattcccacgctaggtttgattgtgttgacaacacacctgtggcttataatcaatgacccagctctcaggcagtgaaggtttgtttttcagagagaaagatacagattttttaaaaaaatgtaaacacatccagaagaatagtttaatgggagaagatacgtgaatttagtagaagcatcaaccccacccacaaggcagagtgaggcaaactaatggccatacagttttttttccaaaaaatgtgcatctttccccctaccctcaaatgtgacccttaatctaatctaccttctaaagtgaccaacaatgaatctgagagtgtgtgatgcaagcctcaaggtctctatgttctatgctgttctacttttgagggggctttcacaaataagtagtgcccacaaatcagcaatttttcagctgcttattaaacatagtagtgaggctggaaactatagatgtgactatattcaacatttctatttcttcagtggaataattttgctgtatatttaaaattatgttgttcttctgtgacatgtataccaactattagattttgcttcataaccccacaaggctctccctgtacattgtgggggtgggtgggcattctcttttgacctttggagttgataacagccattacatgtgaaggttagagctctctctctctctctctttttccttcacttttgaggaaagttaaccaagtttgatttcatcatctgaataatgccctcagtcaatgccctccttccatctgggcttttgtagcctaaatgatgctaacaccttagtcattgtttagcttaaaccttatcctctctctccctggatagatcacaggcttttgcaataagaaaacaatcacttgggatcaatgaagcatatttggttgcatcattttttttttttttttttttttgagacggagtctcgctctgtcatccaggctggagtgcatggctcaatattggctcactgcaacctctgcctcctgagttcacaccattctccttcctcagcctctggagtagctgggactacaggcgcccgccaccacgcctggattttttttttgtgtttttagtaaagacggggtttcactatgttagccaggatggtctcgatctcctgacctcgtgatctgcctgcctcggcctcccaaagtgctgggattacagacatgagccaccatgctgggcctatattttttaatctagattatcctttacaaacttgcagagttcactgagtagaacctaaagagagtgaatacactttctcaaatgggtttttggtttttactgaggatatctattattgagactttcttatttcccttacgatccaagctgaaagttgttggacacttttatctgaattttttaagtcagagcagctcctccagaacaagtatgttcagttccaattttagcccctcggtgcttagaagtattgggaaggaactaggtactgatgatgtttacttgaactgaatatatacagctataaatgctatatatatatatatattcatgcatctaaacaaagaattattgatgagaggggcaagatacaagagagatctaagaacacagatagggccaacattagactggctggaataggtcttttgaaaccaaggaaatgagataatttcctgtaatgtaaacaaaaaagagaaaatgtacaataacataatatcaactttgagctggccataataaattgtcttgattgaacagcctaagactctactggacccattagtctttagtcagagccaatcttttgttctggtctagaaagattaatacatgaaatggcttgttacctaaaatgttcatttcacacagcagatgaggagttttgtatgagagaagggaagttgaaaggtagaaacaaatgtgttacactcctttttttctccttctcaatattgatttcccagccattgacctctgtccaatgccatgtcactgacccagaacattgacttgtctacatgtcattgccatccctcgatttaacaatctgatacatggctgaaaggctgaaggagcgccatggggcttttttggtcttcttgatccccctttgtggtacgtggttgccttttgacaaaagaatgtgttaggactcttattaaaaataaacccagatttttagttatatatagtcttgagttctatagagacaaaaaatgagaagtcagtgactttaggattgtgaatctctttactatgagaggagccaagatatcaaagccaatcaagatgagggcaaaagtctgagtggacgtgaacttaagaaaagtgaaactataacactcacacacacacacatttaagatatatgcaaggttaaaagaattaacaaaccaaatctgctctataatattttattagtagtataatgaaataatgaaatgctggtactggtttagctctttggagacactaatcatatcatataattaatctttattattcattatgaaatttcaaataactcttagaaacaagattgtaggaacaattcttggcatgctgctaagtgtttaacacagaagtatcatgtctccgtggaccagctatgggagtcttgaaccttcatttgacattcttttcctgatttgggatgtaactttgtgaagtttgtgcagggaagtcttgtctcacaattttaaatggaagtatagtggccagaaatatagtatcacagcctttccaggataatattatacaaagcagtgtgaagcatccagtggcttaaaccagccagtatagttgtgaggcagtagaagagacatcctgtgggttaagtgtttctgggaatactgggagtaccaggtcagatcctgaccccaggctagaaaaagttttatgctatcaggatagctgttggggtgctaagtcacagagacaaatggtaaagactggtagtctgtagaattttagagagaagtcaaggtttcctagccctttagaagtaatcagtgagaaaacaacactacatgctagcccgaaagacctagatcctggaacccactaggctttaatttatgatttggggaaagttctctttcttgtgcttcctttcctttatctgtaggacgatggcttgaactaaatctattaactgtcatagggtgctgtttataaaataactctggattgtaagccttatcctagatttatcttttgcttaaaaagaacattgaggtcctcaattggaggaacactctgtacaatggcatgtcatacatactccaattaagaggtgcagaaaatagcactttggtttcaaatatgaagacatgaagtaatcctgactcatgaagaatgttcaactacccagtaagtaggcaaattcttcagaatttaattggaggaggagggaggggttagttaatttgtctctgaagatttctgttgtgtagccaagaatagaaagaatagacttgaatttctcaaaaataatagtatatttctatgtgtgtgtgtgtgtgtgtgtgtgtatatgtgtgtacatgcacatgcacaagttttcacttgcaaccttcttgcaatagaagaaagtatgctcaaaacaaataaaaatatctttagtttcttaacattccgggacaaactccctatctcatcttttacaccatttatttgtttatttggggattttctctgcaatcatttagtgaatatctactggggctaaagttccaggcactttacatacgtcatctctattaattatatatcttgtctccttcagcacttagcacatgctttgaatagatagatgctcagttaatatttattagaatacatgaagtagtagcaaaacaacattcaaagacgcaaatgtgtaaaagttgaggaagggaaggggataagatgtaatgtggttaacacgaagtcaatgcaaagccatcaaaaccgtgcctggagtgctcaggtggtcaggtcagaccttccagcagcggctacatctgatgcctatcacccgttgtttctatacaggtatcattaatagaggataatctctttcttcaggcataaaacccttttgagaaaagcgctgactgttcctattgcaatgctctttgagtgagcaatttcacttagaaaaattgtataaacaagtgcttaacttcagctttttttcttctctaattgatctaaatgtgaagttaaattagctgctgatgaatagttcctatgctgttaagattatgatttttccagaagagaggaaccagcctacattactatcctgagcacttctcattcaaaactttaatggatcacttagaagcatggccagttggtctttttctaatggtgacaagtaaagtgcacatcagcttgttatcagaggagtttatttacaaggattctacaggttaatattcccttaagtaattttgctcatgaatctccaagaatggccatgtgctgtcacattgctacatttttcattgttagtaagcccctgaaaaagccagaacaaccatggtgatttcactgctagcatttagatattgttgtcttttgtcttaaactatgagaatctgacttacgtatttatcttgtcttaaataatagtgaaaacagagtctttgccacccattgcaacaattatgcatttttttttataggaactgcaaaaatcaaacaaaacaacagaaaaaaaaaactattaagccacttttttttttttttttcttgagacagagtttcaccctgttgcccaggataaagggtaaagtgcagtgacacaatcttggctcaccacagattctgcctcccgggttcaagcaattctcatacctcagccacctgagttgctgggattacatgcatgcaccgccactaatttttgtatttttagtagaggtggggttttgacatgttggccaggctggtctcacacttctgacctcaagtgatccccctgcctcggcctcccaaagtgctaggattataggtatgagcctctgcgcctggccaagccatttcttttttttcttttttcccttggttttctaggattccccaagacctgatttcaagaattctggaatctgtattttcatgtagactatctgtgaagcaataataattgttttaaaaggaatagattaactagggactccaggtgaatttaggaggatagatctaagctactcatgcttatttaggaaagtgaatgtctttacttattttcataattatcccaatggaaataattaactgaatttggttagaaactgagaacactacaaagcaggcatctaactaatagagatgatctctaaagaaaaaaaaaaaactagaatttcacattgagaagatttgggaaaatgacataatgtcataacttaagcatccttacattgtaatccaacgagcctttgtttagcaccttctctacatgcaggaactacaaggaacataagataaatatatacagtggactttacacttcagggagtataatcttgtttgtgaggcaagatacacagccatgaaaaacagaattatttaaaatatatatactttttttgagagagagagagaaaatctcacactgttgcacaagctggagtgcatttgtagagtcatggctcactgcaacctctacttcccgggttcaagtgatcccctcacctcagcctcccaggaagctgagactacaggtgcacaccaccatgcccagctagctttttgtactttttgtagatatggggttttgtcatgtagcccagactgttctggaactcctgggataaagcagtcctcccacctcagcctcccaaggtgataggattacaggtgtgagccactgagcctggcttaaatatatatactattttaatattatcatgttacagtatgattattctcttagcaatagactctttccctcttcagagagaaaaataatgaattttggtttctatagcgagttttgtgtacgtgcccttgttgtaggaaaggtaaagtataggtacaaaccagtttatttggggacagaaaaatgaatgaaattgcttaaagcatcttgtgcctcattattaaagccatcaaatattgcgtagcaaacctctctcaggtgccacgggaaatgtgatgtttcatttaaatgtttcttattcacagactcatttagctttattttccctctgtctcaatttttcctaggtttatttgagatgcagtgctacaaatgatgaccttgctacaaaagcataatgttttttttttcaaaaacagattggatacatgcccattgcttagtgagaaatcaaagtgtagtagagagagttgaggctttggcatctaaaagatctgattttaaatccaggctcttctgcttattagcttgtgatcttagtatggttacttagccttgggacttttgcccagtaaaattatttcccttgtagaaaacacttttgaccacgtatttaatttgttctgttgttcaacactctcctctccactgccatgcttgttatgactgttttcagctataattaatattagcagtaatggccctttaattcactttcctagctgcaaagagtttatttaatatttgtgcatcacttaatggcagaaagtctttctagtaatttttgttatttttcttccactgcttgcagtgtagggaatgagcacttaaccaaaagttgagagttatttagcttcggcttagttatcaggttcctggataatttagggacagattgaacagtctgaagcagcttagaaatctggtactttgccttgaagttccaccagaagttaggaatctctgtctcttacccttgacttgaaaccttcttgaggtcctcacatttatataatgtccctgtcttaatctgtttgtgctgctataacagtatacatgagactgggtaatttataagaatagaaattgatttctcatagttctggaggctgggaagttcaagagcaaggtactggtaggtttggtgactggtgagggcctattctctttgattccaagagggtaccttttgccacatcctctggaggggaggaatatcgtttccacacatggaagaagatgaaaaggcaaaatggacctaagctagtttcctccagcccttttataagtcactaatccattcatgatggaggatccctcatgacctagtcacttccccaaaagcctatctcttactgtcaccacaataaagattaagtttcaacatatattttagaggagcgacattcaaactataccagtcccctagaataaagtttctgctctgagataaatgaggtattgtccaaaaccatcttgcaaattagcaagataatatataattaaatttcctgtttggtgattcttagtataccatcttaccagttgaaccaagtgtctctttagattgagcttgtggtacccaagcacctacgcaattagcaggaaaaaattgccagatggaaccccctcacaagacaaatctctccattccccacatctctaaactccattccccactttcgaaacatcaatggtcatttcagatgggcactttgattcagtagaagaacactggatttcgagatttaaccatgagttttacatttgtctctgaatatcttaggtgattttataaactttgtagactgtccttgggcctcagtttccatcattataaaatgaggatgttgagtcatgcaaaacagaaacaactggtaagatccattccagatctaaaattgtatgaatcaattacgtacatagcttcttgcacccaatgtattaaatggttctgtctgttctttctcacctggccatatggggctggccattgtagcatggggactctgcagcagaagagaaatgaaagattcttctttagtctctttcagctaggagcaaataatctctgtgcttacctagacttaaaggagctgttctaaagctatatacctgccattagggaacatactcagatcaattatttaaaaagaaaattaacaaagaacaacttggcattgtaacctttcttagcagcttgaatacaaggtattaattagacaaggaaaaaggggggcactaattatttcttaagtggaataattagtgttgctgaatttataaattaaagggcctcattaagaaaaaaaatcaaatcaagtttgaactatagtgatatcactgtgaaattataaactgatttttgaagactgcactttgatcctatagtagatgaaaatttctgtttcagaccatctggatttacttaagggggaggtgatgcatgtagttggtgcagcattttagaaagaaaggacaattttttagcatctaagggtggaatcttgttatgctgaaagaaaaccttatcaaataatacactatttctaagaatagagtatttggccagcaggctgatacatatttcattgggcacaaggtatgaattcaacatcaaagtagttccagttgcaaaacaggagcaggagcaacattgaggaacctgacccagctagagttgggccttctatgcctatgttatgtactcaatataactataccctagtcctgcccttgactcgattacagggctgacttcacttcctgtgtcccaccactgagggggctccagacctggtttgaggtgccagtgtctcaacaaacgggatcaatatttgcagatcctcaactctataggttttggcttcaaggtctgctttcactggggcggctgtttcttgttcctcttctcttttctgccctagcgagctcattcttaggagctgctgctaattattgatcctactctcatggtataagacatctttagcatattccaccccaaatgctaaaacatgacagaattatatcttggaaatttataacaagaatttggagttaaagttcagaaataaaatcatatttggaagtcttggaaaaaagctgtctccttggtccatgctttggagaaacaaataatgctgcctcttagttccttaaggagtcacatatctttggatgaggatctaagactgactccctaatagccaagtcaaagaagctgcatgctgcacacatgtacattttcatctaacatacattgaatggtgttctgtgctaagtggactttcatatgtcttaatattcagagatgtaaaaatgaataggaaatatctcttgctgtcatagaccacgcagtcattagaggaaacagacaaataaaatcacaataatttacgtgctataataaaattatttagaaaacaccaagaaactcagaacagagcagtgcctttcaaacttcttttgacatataattgaaacaaaagttttataaagctatattaaccacaactacatgcagtgactaatacttttgttatattctattctgttcctttattttaaaataaaataaatgccttaatgaagaaaataccataatcatatttccattttatagagaacattttggtaaaacttataggacaggttttactgagataagactggagtcagagagactatttgtggactattgcaagtatttgggctagaaagttttggaagtgaacccaatactctggtgttgtaatgacgacatattggagagatattttggagacagccaacaatgaccaatttgacctgagagattacagaaattaagaaattgaggatgatatcagggttctgccttgggtctgtgggtagattgatggtgactttaatggagatggggaacacaggagacagagtaaattgaatgggaatcagatagcttgattccattgttacataactcgtacctgtaatactcaggtgcctgtgtaggaggcaatccagaggtgcctatcagtcacttttacttctaagactgtattcttcactcttatattgtatgtcattcattatttcatcaaaataatattaccatgttttaaaaattatgcacaaataaaatttagattattccctagtattgtatgatataggcatattaaaatttatttaatcatttctctagttttgcacattcatttctaattcttcaccattacacacgatgctaggatgaatgtctttgtgctagatccttcttacacctgatacatcccttaagacagattctcaaagacaaaattcttgagttaagagcatgaacgtactaaaggctcaagatagatatcagcaatagttttccagaaatgcagtaccaatgtttacctcttactctaaatttataggattgtccatcttaccatattccatgcaagagaggcggtattacaagaaacagactggtgagaaatgttatcatttttaaaattgcatcttttattatcagagggattagtgttttatattaattatatttttatgtgatggttagacaactgtacttctgtgaattatctattacatgattttccagtcttcttccatttgtatcttattatttatctcattgaatgttatatggtatagcttattttatattatgtagcatttgtttatatacattaagtgtattatttttgttatattagtgtcaaataaactttcatcttttatggctagtctcttctttttatttatgtcattttgaaattttggagttttaatttttttatgatttcattcatgaattattcagatgttgtttttctaaaacaccttccttcattttcctggtttctctgtgtttcatatgattattgtaatttttcctctttctctcttcaatttggagtttctgttggtgtatgatataacaacatttcaaaacctcatcctccaaatcagtcaacgggcttctatacatttaccacagaaattttcattccactgaatttttctcttggtttttctttagctggaacagcaccaactcattcttgtatatgtatgtaagcaaactcatctgtcacttagcacttcctttaagaattgcttttctgatcacttaaaattcccctatcacaatcacttattttcttacttaaaattttgtttacattatttttaatatattaaaatagcattttaattctgtttatttcctatttgtcttctcaattatctaattgagaataataaatttcttatgactagaaactgtatagtcaacttgtttttgaacttctcaatagcagcccaacactgggcactcaagggaacataagattcactgaactgaggctgaatgattaatgtcacataacccctataatcattagagacctctgtgcactaaggagtgacacttcctaccgagcttccttcagaggttagggtgcaatcctggcatgcctttgctaaagctctttgtgtgaatcattttgttccctttatcccagcaataatttaaatctgcagcaacacctgaaacacattcatgaatgagtgatgtcaaacacgatgacattgtctcatctgtaaccacattcctgtggagaccattctctgcagtgtggaggaagagtccacagttctccaagggtagttcaagatcacaaaaaaattccacaacagaaatgaaggtaacaaaagcttttgctgttgtccctggggtggcgtggcggggtgaagaccctgtgtagcaggagagttgactgttcaaaaaatactcatcagctcttgtttttaaagttaccaagtcgtcttttttatgcccgcatttgtatgcctgattcagaaatggactttgtttcatttggacaattagcagaattgcatgacaattataaacagaactaaaagtacatatttgcatagtctattctgaaaattaaactacttcactgcattcatatttgatgaagagacctttcacaatccccaaggaaaagagtccattttttgggtaacatacacaagcaataataatgaaaagagagatataagccagtgtttataaaaacatgaagaactaatcttaattaatgggttcttcaaataattagttcgtggaatagctctctatataataatgaaacacataaccaaaactcagacttcttgagaaccagaaatttttatagaagctcagatgccttctagggtgataaaaagtgcatagagcaaaggaaaattaaatgtgaatggttcacaaccattgcttaaaattccctgaaaaagcaaatgtagaagataaacgggaatgcacttgtctgggtgctctattttcttgtcccaataaagtggaatgtgtggtatgaaatagccagcaaggcttcattttgaaattacacatttttatttttatttatttatttattttggagacagagtcttgttctagtacccaggctggagtgcagtggcatgatctcagctcaccgcaacctctgcctccaggttttaagcaattctcctgcctcagtctcccatgtagctaggactacaggcccccaacaccacatctgacttatttttgtatgcctcagcctcccaaagtgctgggattgcaggcgtgagctactgtgcctggcctgaaattacacacttttagagcagctagtttattcccagcttccaaagaagatcccattccaggggaacagttccacagtttaaaaacactcagaggatgaagtgattctatataaccaattgatagtggtagtagtgttagtagtagtagtagtagtaattagtgatatttttcagggaggaatgtaaattccttgaacttggaaagtcgaatctaaagtttaacctagctagaccaaatgaattaattatctttttctcttaagtaattccagtcatctgtaaggttttttaaaaaatatttaattattgttgtgtagtgcttggtatagttgacaattgttttcctcttttaaaattacctcttcacatattggtgctgcgagctataatagccatctaattagtagaaaataatatttgtttggtgtatactatgtcccagggatcatgctgagcatgatatatagatagcacagatgtgtatgcatatatatgtgtatacttacgcagatataggtagattcttattcaatcctcaccagaaacctttaggttgtttctagacatctagcataaggtcagaactcaatattagccaacattaatgttattttcccatttcacaggtgagaaaacagaggctctgggagcctaagtaacttttccagggggcaaaacagcatccaaatccaaatctttctgaaccgctatttcagaacatttcccatctgccagattaccaaacaacagtgattgggtttttagggggtttcccatattcaaaagacctgtattaaattccagttttaagatcttaacaaagatatagctttcattttttgccctcaaacatgattttaaatttaaaccttgtgatgaaatgtcattaggggattttggtaatcctcatattagtttttcaatcagtaaatgatgttttttcttgagtaatatttccctagtcatttattttcattccttttctgttggtccaataggccttttgtgagcataatgagttttgaaagaaatggagtgatatattaattaaccaagctaattatcttggagagccttgatttttaaaccccaaggtgtatacattatttctgaaaatgtgtgttgggagatcttgattgagatggtttaggcagagggaaagacagccaagtaatacacagcaggataagcaaattttggttttagaaattagggaaagagattgttgggaatttaattgctggtgctgttttgtttcccatatataatttctaatatattacaattgcacacatagtttgtacacattacacaacatgtatcatatatcaaaaatcacctttcaccataagctcaatgtcctcattgaaactaactctccagtctagtacctattacagataccattacgggagtagctctggtttttgatgccataagttgtagctacttaaaagccagtagtttaactccaatttgaagaacaaaatgaagcagaaagggcagagtagctaaggtgagatgtatgatgttttatttcatcagtagcaaattacaccgaattcagctgaaaatgtctttctcatattttcttaatagcactttcaattgaaatagacacatagaagaaagattcttaaatggcaacaactattgatcatgttctttgcttcctgtctaatgtactaagcagtgagttagtgctttgcagcaggtatggctctgccctccagcagcctgttttctatgagacttactgaaggtgtgtgaacaccgatgacatcatggacatcaggacaaaggataaatggatcttgtgggaagggagaagaaaaaaattggtaaattacaggagaccagagagcgagtctggatgatgacatttcccagctcttcagggcacaagaatggtatattgttttcacgtgtattgaagctgcagcaatctccttctgcaagcccttgctatgtgtttggacagagctactaccagcagcagagacaccagcttcctttaagatctttccaatgcaagggagggcaaagccaggctgttttgttttgtttcttccttccttccttccttccttccttccttccttccttccttccttccttccttccttctgtccttccagctttaatgaagtatgatctatgaacaaaaactgtctatatttaagaagaagaatgtgatatttctatttatagtttgttctggcctcattgtttgaggcctattgcaatgctctctactctttcaaatattctgctgcaatgaatgggattctcataggttacatccaaaagaactctttttctctttacattttgctttggataggaaaataatacacatttataaaagtttaaccaatatctagttttaaaagtaaaaagtaaatgttttcctttgctcgccaccaccaatcatgctccactgcccagagttgacccttgacaaccctggagggtgttcttcagcatggcacatgcatccatgggcatactaatcacatcgtggtctatgtgaggggctctccctggtaccaggcagggctcagcctgcattgctaggcatgaaagcctagaataacattaacatctgtggacccagtggcgagctttggaggcctcagtcttagttctgtcaccaacttgcttcatgttaggtgtgacgttcaacttctctattttttttttctgctaattgaggcattaggagaaggcaacttttcatgtgtctgaagaagacattggaaaagaggatttctaatgtctttccagctctaaaattcatagatgtgctatgtatctttctagtaatttgttgctttgtagccacagtccataaaccaggctgttgacacacagctctccagattccaggatcagacaagagaattaatttttatttattatttaggttctgccaaattactgttttctggttgcaaattaaactactattgcagaagcattttcctttataagtgccacttttttttttccccacggaaatctatactgtattttgcatggctatttccagtacttttagaatgtgtaggggaaaaaaaaaaacctttgctaggagtatttcagcaaagtttttatttgggccatcaactttctgtcagcttcctgcaggtaaactggagagagaaggtgagatgtattctttggacatttttccttccagggccttctcttctgctttcagcagccttcccacacacacgtgaaaatatgtaggggatgagtatattttggaaatgagttttccaggcatggtcaggtcaagctgtgtgttattaagtatatgatccacatggacgtataaatgatagcttcgactataagctcaagtgcatttgagatatttttgggcaaaagtgtctccacacagtggacacttggtaagaccaatatgtattaatagccagagatcgttcaggaccgaggatagccattcatcaaaaactatgtcttctgctgggtgttagttgtgtattctctgcccagtgtgtatggggaagaatatgtgtatccaccctccctggaactgctcagcgctggctgcatacgcacagggtgagcccacctgaagagtcactctgtgcttccatttcatcttgtcgatgagttcatttttgcagtggcttataaccagaagccagttttgcactcccagcatgtatttggcaatgtatgcagacatttttggttgtcacactggggaagtcctacctgccaaataatagataaggtacacacttaaatttgaattttcaataaacaacaaataatttttagtatatctcaaatatcgcatggaacatatttctactaagaaattagtcatagtttatctgaaattcaaatttaactggacgtcttggatttttattggctcattctgacaatcttatgttaataacgcagtaggtggaggctatggaggttgctaaacattttacagagcacaggtcaataaagatttatctgacccaacctgtcaatagtgatgagattgagaaattctgaattattgtaatactttatatggtaacatagtacatagtcatgcaaaaagcaatatggatttcaggagaaaactgatggcacttataaaaaattacttctatggtaggagttacatttgcaacaaggaaacagaataatttagcagaagctaaataataacttaaaaatcaattatcttgttggatcactgaatctttgaagctgtgtgcacctccctaggtcctccatcatttgatttattttacaaggacagcgagccccttctttcatgaaagtctggcatacagtgtatatctaattgattattgttgattgattcaatgaataaaaacaaacactttcttgtattgagaaactattaagtactaacctttcacacatattgcttccagttcaaacaaggagagtattataccaatttttcatatagagagactgagacttacattacaatatgccagaagttatagcactagtgcagggcaaaggtgggatttggggagaggatgtttcttccctaaggtttctatgctttccccgccacaaacagaagacccaggcagcaaaagatctgtaataggggaaacattcttccctctatgaggatcctgtatcagatcttcaggttgttggctctcccacaaacatttcttccatgaatgtatttctgttctttccccatttctcagtaatgaaacagtgactgcatatccctttggaggtaggtggatctatttccaaagctctacctgctgggagacatccacaaccttctcatgctgcttctgtcaatcgtctggtgagcacaccaggatgggcacagaagggacagctgttacagtcttgggctcctgggaagcctggcagaggtttaccctgcctacagacactccaatttagtagcaatcattgaacatttttaccctaataaatttaaaaataaagaagtttgcatcatttattttaaatttgtgggtaggatttcacactatagtcatttgtgtttgctgatgagtggaatggcttccaccttttatgctactgtgcagtctgaagaaacccaggttggcatctgctcttgtcacatggtggagttcgcaggtctccaaggagactcatggtctcttaggatgaaggaaagagaagaaatgcagcatcctgagtcctgggcaacagttttgtggccaagcatcatggccacttgtctcattaggcaaatattagttattcctcatatccatctttttccccagatcactaagtcagaaattgttagttgtattcattattacacttccctcagcatactacactctcttatacatagcgaacattgagtgtattagcacttggagtttatacagcctattttgcagaagtttgtcccctccattaccaaaagtcttatcatcttcttgcctttcacatctatgtaagggtagaacatcttgttacagatttttttttgtgtgtgtatgtgtgtataatattatacacacttttaggcttctacattcatgtatgctgtcatctggttcttaaaccaaaattataaagtaatatttccattttgaagatgaaggaacagaaacttggtgtataaacaggcacatccccaagctacaatagtttataagaggcaggatcaatttggagcctatcatctcttgacttcttcccaagggatttttcttctctgctttgtagctcatgaacacttagaaggaccctcaaatgttgcttcaccattatggatcttaatatctaaaatcagactgtgtgttttttaagccaacaagcatatagctaggcacaaaagagagatccaattttattttcctctaatttctggttttgcatcctctaactgaaatatatagtttaaacagattcaaagaaattgtttgaccagaggaagttggttttaaagtgagaataagagaaccagaaggaattaagaattcatacttgcttttctttctgagatgaagacaggctatctgggtctttgtcctgctttgagcattggttgtcagtgaaggttatcatcttgccatactcagagtggctcatagattcaaaaactgccctagttcaaggggactgggggaagggagcagaatacttgagttatttaccaaggacactggtcaaactttaataggagtcataatgcaactgagcaccaccttataatcaagcaactctattctatttgggcatatccctggatctattgggggtagggtgactggaaatatacttaacctgcttatgccatcatatgggcacgctgcttttctaccaaatctttggaaggcgtcttacagttgcatggctgggagaagtgtcacagactgcaccactgggacagctaatgtcagacacaaatctgtgtatcagctttaaagctgccagtgtagcgctatgtgtcaactattcgagtccacaaattcttggcataaatgccaataagtcaaaatcaaatctgcgttatgaggcgcacagattgcctgcctggtagagcacacatgctcattcagttatgtgtgaataagaagccacttgatctattaattatgcttcagaatcaacgtgaagctctaggtaagtggctggtagcagatgaatagatggctcatagagtgaagtatagtaattgtcttgaggttcttgatgtgcaatttagtaaactgaaatatggtatttttcagcctaataacagaaaatcctctatctgtgccgaagggtggcagttgcatgagtcactctcatgttcagtaaaacaaaaaggcaactcaaccaattagaaagcttggatgatacattgccacatgctaatgctattaataggatgactgcacataagctgtgactgaaactgtatagtgaagtcttctaatggcagttaccgatagtgagaaagggtagtatatgtgtaaacccaattcatatttactttatgtacaatgcaagttgatggaagaagaaaaacttagttctaatgggcagtgcattttatttaaggcactatcattcctcactaatatcaggggcttaagaatgtgtgtgtgtgtaggtgaggggaaaacttgttgcaatactcctgctgctaatgcctttgtctgtgatcccatgctccacttatgggtggtacattatttactttggtgtgttcctgtctactcaaaaaatgcagtgaagttcattttggtttatagaaagaaagaccaagaaaataaaatatggaaagaccataaagttgacttccatcttccactttttttcaggattggaatcgaactatgcaataccaatagcatcctgtttctggcaaaaaggaggaagaatataatgttatgtccctttaggatcttcttccaatcttatacagatgttatttttctttgcaatggaagctgtttacctttcattcattcctctgtggtgaagccagggccagtactaggctaatctgagaagtgatgaaattagactttcccctctgttcttctttggaatgtccatcagggctttcactgtgggatgagatatgttgcaggcactgaccacaggtacactcccaatatctgtgtgatcatggttcagtcattttcattctaaacctaaatatccttaactatgaaatgaaagaatgacatgcccattcataacagagggttattgtatcaatgatttctgacttggaccatacggaatctcatggaatgtagaggggacgatgcagatatagtttgaagaaagcacatcagatggttctaacatgtacttcctcatcctcgaatgacctgagtcagtggttctcacagtgtgggaccaatgggagcttgtaaaaatgcaaatcttgaatcagaaactctgagggtgagacctagcaatccatattttaatctctatattatttatattttcatgaataatcacaacaaagtttgaggaccactggcctggatgtggatccaagaatgtggtcacctaaccacctgcatcagtatcaccaggagcttattacagatgaaaattcctggaacaaaaccaagccctgctaaatcataatatctgggactaaagcccagggatcaatgttttgacaaacttcaggaaattctaaaacctgttcatacttacaacacaaagttagtctagaaccactgttccagaaaagtgattgttaaaactaagtgcacattaaaatcgcgtgtgagagtttttaaacaataccaatatctgggctccaaccacaggccaattacctagattctaatttccagtcaggattaaaaattactagactagattatttttaagacccctttcagattcaggttccatgatttttgcaattttgtgttgtttcctaaatgcgtattttaattctcaattcatagcatgcttttcaatccacaccatagttgatttgtaccacacagtaccctacctactggtaaattcacgataggctggtaaattgtcatcggctaaatccagcaccatttacaatactatgagctaaaaacaacaggtgcagcctgagaagctcatctctaaagccataccttcagaaaacttggtccaaatagatctcaactcctatacccaaggcatcctcgtctttctattgctgtgttgaatgacactagccttcaggtttcatttacttgaatactatttgcaacagaattaggatgatgattattattattattattgagacagggtctcactctgttgcccaggctggagtgcagaagtgtgatcatagctcactacagccttgaactcctgggctcaagggattctcccaccttggcttccaagtagctaggaccacacgtgtgctctaccatacctggctaattttttaaagtggtttttttttttgtagaggtggaggtcttgctacagtgcctggcctggtttccaactcctggtctcaggtgatcctcctgccttggcctcccaaatcgctgagattacaggtgtgagccaccacacctagcctcagatttgtaattattttccttgctgcttccaatgtttttaaaagcataagtcagtgggcagcaggttttggaggtcagacccttaggagttatttcctgcagcttccagagccccatcctaataatgaacacctgtactaggcttagtcaaattgatactgtttgccagtaaactctggttttcaaggaaactgaaaccagaggagccctaataatacatgtttttaacctgaggtttgggcttgagccaatggcatcagagagcagctcaaatgagctgttgcaaggaaggtttatctgaaaaatagttaatgaaagactttgagagctgcagggatgtctgacagattggcaactcactttgagaaagagactatttcccgttccaagtcccagacacacagcctgcgggtaagtcatcagaagtaaaataaacggggaaatgggagaggggaaaaacagtaccctgtaacatctatcaactgtacaagccaaagctactgatgaagttaaatagacaacaatcctttgtgtttattttctgttcagtgaagttgctaacctgagctttcagaggactaacaccacaattaaaggcaagcagattcaggggaacacagtgaaaggtagatcaagagtatttttatgtttagattgaaatttactattggctaggaaaggaggtgtttattgtgtctaaagacaataatactattatccacccagcaattatggtcacaagaccactcaaacaagtagtgggttgttttggttggagagaaaaaaccaaggctctgtttgcggtattgctcggtatgtgggtttggttttttttgtagtttagtgggctgtgggcttttgcagccaccctcaaaaggatgaagagacttttaaacagcttcggggttggtaacaggagtcccttggtcccttcagggaaaccaaagatactcaggccaataatttaatcaggagaagatttatcagttggagtgacacagttttaaaggtgcaaactctctgtgtgattctaagcagatatgaagtccagctgagaagccagtcaaactgatacttctcgggtttctctacccagctattctgagcctgagatctgccttcttcttactctggcaaatcagaaccaatgttattctcccagatttggggcatcacatctattacgggtcatggctcctcctgaagtcaaaggcccttcatttccatcttctacatggattcctgcctggttatctactcttccatttaatgcaacctattctacaatccagagctcaacctattccacaacccagagctctctggcctctcacagaataggtaagatttctaaacctttccacagattcacataagtcaggatatacctttagatagaaaacgttaagcctcaggccaccctccctgctgagttctagtcagaactcagaggccagctttcagtgtattctgaggaaggaaaagggaaacagactatcaaatgcaaacactaatactgacgctgatgggttgtatgattccaggcaaactgtaaatctttcctggggttctctatgtatttcccgttaaagcagaaaagaaaataaatgcctccctattctgcatgttatttgggcaataaagtgctactgatttgtgaacttcaataataataaaataacactggaaaaacctgcaccacaccccccccccaccccgccctgaaaagacttcaaacatttgatgaagcttcaagcaaattagaaaaataaaaaaatcaacaatttgagctcctcctaattttcctgacaatcaattttctcataggatgcttattttcagctttacaatctgccaactagctcctccaaacctcatttgtgacccctttatgggggaaacctagaggttaattaacagatgactgttagttcctgaaagtcgccctgtgatttagtcccgaggtggcctgagcatctccatcccttgttaggaaaaggctctctggttcaatattaatttctgtagcttttacaactctcactgggattaacatttaatcaacagagcaggttcctttttatatcattatagaaaagtttcaataaaatagaatggtgcattatactgtaatgaatgacaaacactggtaaattttcatttaaaatcagtaagttgaacctagagttgattcataacggatgggtcatctcaatttaatgaatagtaactaaactaaaaacacattaaacaaatgcctggaatgaaaagggagacatagttattgccccacgaggctgtgtgatcctctaagagagggcatatgttttcttaatttttccttagctgatgcttagagcaataccaagcatatagtgggtactcaacaaatgctttccagactgaatatattaataaatgtttctgtgtatagaaaggtattttcctttagaaaaaatgttactgcattttgctaattgcggccacctctcaatgaatggggatgatcacaagggattatgtatactacatctttttcttttataaatgtttatagtagtgattctcaaacttgtgcttgcatcaaaattacgtggggagcatgtaaaacagtgatttctgggccccactactagaatttctgatttaatattctggggaagagctcccaaaacgcatacttctaaattcctgggagatctgatgctgcattctggagatcatattgagaatcactcgcttatagcatctatctgtatggcattggtggcaatttccatttattcatgtacaggtgaaatcttccctagagcaggtcctcacacacagaaaatacctggggagcattcgctgactgcacagataattccaccctcattgtggggaatgtaacactattgctgctatatgcataaatggctttcattcctagggtcccatcagctatgaaaggaagcataacagtattgctgttggccttttctttcatgtgataaattgccattagagtgctaccctaggcatatatcaatttccttggggatctaactttgactcttccgaatctgcccacagttgctatagctgtgtgtatgactctttggccctttcacacagggtggctgtcactggagtaataataggagccattgccattagagtctgccagtggtattgactctgtgactctacctttgagtttgtataatattttattccaattaagcctctccatctgtatttgttttcatctagcaaactgttaattgtaggtggctctggatatatctgatggtgctggccacggaatatctgtccatctcatgtaaaaaatgtaggaaaatattttattaggaaaagaatggccacagtggtcatgcattttgattggggtgtttgatttgtttgcttttaagtaatagggctgggcttcaaggcctcatcaacagctcctcaccttgtttcctttctgagcagtagcaccaattgctatttaactctttaacttagggatacatatattggggtaatgctttaactttgacggtacatacattggtaatagaataggatagagctaatttactgatccagttttgtgggtggaggatttcacaactttggtcccattaccaacattttcttagcaaatgttttaaagttatgttaaataagcctgatagttggatattttcattcagatatcttagagcctaatacacctacacatcttttctctcctttcaaattttgatgcattcttcaaggaaaagttcattccactctcatctgtgggttttttcccaacatgaactcttaggtgttactaacttgatcattcttctggcactctattacataccattttgtgacatcctttgtattgtaactttttatgcgtataaactttgtctcctcaattagattgcacactttttcaatcatctctcattttactacatgattattcaacatccactatgcatagtgcaccaaaattgatgctggaagaatacagagaggcaacatatatggtcttatatctaggctcttaaagaatttatgatttagcattaaggccaagctgtgcacatacatacacgtgccataaaacagcaactttcactcacagtagcacatgagttaggagtgatataaataggatccatataagtctgtttttccactgggcttacatattgttttatagacatagtcatggagtgcccatttattttcttcatatgtacataagggatgtccttttctaattaggttcggtgtataccgctcaggagatgggtgcaccaaaatctcacaaatcaccactaaagaacttactcatgtaaccaaatactacccattcctcaaaaacctatggaaataaataaataaataaacaaataaataaatttgccattatgtcaaacctcagaagtgctatgaaaagagtaattattttgacctaatttggatatatttaaatttaaacacacttgatactgaaatccatattgataaaaaattaaactgagataaggctcttgacaaaaacaagcatctttcatagtaagatgtctttaaattagcaagctccttcacatatttaaaatatatagtgtttttttgtttcttttctggacaaaaggaggagtttgaggaaaaagttgagtatcagggacagctttactgatgacaatctaacttcctcctagctctagttgcccctagataactttccagcattgtctggtcaaggcactgtttaattttcatcttcgttctactgccaccattataagcagataagaaaatgtccttttgttatttaaacacatatctataattttctattgaaagagtgtaaaggggagactgatcatcatgaagcccaacatcatcttcccattccttctccttattcttcatcctaccacatcctttatgatccagtgttgctgatctacttataagtccctaaaaatctatttttttagagtcacatctggcttttcttgcctgttgaatctctgcttcatcctcaaggcccacctcagtgtcaaactctctgaaaagccttcctaaattttatgaaacagaggtatttgttctcacttttctgtgatgttatgatcactctatatgatggcattaattatagtgtttttccattataaagccgttattgacatgtctgttacgttcattggactgtaagttccctgagagtgagaacctgtcttattcttattaatatcgttagcattttctgagacagtatatcttgctgataattggatggccaactatatatttgtacaattaatatatgaatgaatttatcaaataaatgagtagatgaatgcctacctcaaaagtaacaaattagtgactacctcttagaaaattgaatggataataaataaatacaattataccaaataccattctatggaatttcttttgatcatattttcatgttgtgaatagaaatatgtttgaaagtagcatatcccatcaatagcaattcatagctcaacccaaatgtgtgacattaatttcaaaatatgtctgcttttgttctggcacttttcaagctgaatgtgtacccagtatgttcatcctgtcaattcataagggtagcaaggaatataaaatatgaaactgcattatgctataaatggtgatcttgaaatcaaaagtattggcagacaccaaaaaatatggatgatttctctagtaccttcaaatttcctaaacaaaacttcctataaataaaattatattttaaggaatcagttcaaaagtcaaagtgtgtcataaatttattagttagaatggcgattattaaaaagtcaggaaacaacagatgctggagaggatgtggagaaatagaagcacttttacgctgttggtgggagtataaattagttcaatcattttagaagacagtgtggcaattcctcaaggatctagaaccagaaataccatttgacccagtaatctcattactgggtataaacccaaaggattataaatcattctactataaagacacatgaacatgtatgtttattgcagcactgttcacaatagcaaagacttggaaccaacccaaatgcccatcagtgatagactggataaagaaaatgtggcacatatacaccatggaatactatgcagccataaaaaggatgagttcatgtcctttgcagggacatggatgaagctggaaaccatcattcttagtcaactaacacaggaacagaaaaccaaacaccgcatgttctcactcataagtgggagttggacagtgagaacacatggacatagggaggggaacatcacacaccaaggcctgttgaggggtgggggactaggggagggatagcattaggagaaatacctaatgtagatgatgagttgatgggtgcaacaaaccaccatagcatactgtgtaactgtgtatacatatgtaacaaacctgcacgttctgcacatgtatcccagaacttaaagaataataatgataaataataataataataatgcatgtaactcaatagtggataaattctgctggcccttgaaacccagaagaaagggttactatttgggaccggtaaagttcatcagaatgccatcaatcatatgctttcctaatgggcataactctgaccacattcatctagggatcactatctgaatttgcatggcatagaacatagcagaataactttccatttctccatctctactgagcatttacagcatcccactagttacaacttaacttggaatcttgtggttttataaaccccaggataaggacagaacaaaattcatattctaaccatttactgacgctgaagcaaattgacctttagcaagtcaactggcaatgcagagaaaccacaacaaactgtgacttaagcatttctagaaattactgacttaattgactcagtctacagctacatgtagagcaaaggaacagtgaaaatggccctgtcctcagcctttgccttttatagatttttctcaggtgcattcatttatgtagactcagtaatgataatttggcactctaattttgaatgctgttctaagtcctagagcagtgaattatgtcttttctttcaaaagtgagatttactaggaaaagaacaagctttttttctgttagaagttcattatgctcaattttaggaaggcttaacaaaatgataaagagttttcctaaagtaatatttctgacatagctgttctgtcataaatttttggcctatttaattctctacaaaaatgtaaaattgtgttttcaattatttttcctgatcaactttgttacattaatacaacgaactgccttttctggaagaaaatttcaatttataacgatattataggatgtaaaatttcacataagatggttgactgtcttcaaatcgttgcagctgtcttctagtaagcaagtgtattacttgtcaagggttgcatgtacaattcagtgcccatggacatatctaactgattgggttatactttagaaatccttttagttttgaagttttgttctttcatagtaagtgaaagtaactacccgatattaatggtatatatgaaagagttaaacatttactttggtggtagtatagtgtgataactcactctctgatcgatttaaatggatttaaaactgcatctggcctggttcattttgggtgatcagaatattttactctataaacaagaatgcatttgagtaagtaatgtgtagacatgggcctctatcgcatgttttcaactccctgaagtccactataacagttcattttactcattgtgtttgttctcttcatcttcctttctattttctccatcctttaagtgccccaggaaagtacccatcaagctgtgacttgaaagtttcaaggaattattatttcaactgctcttctaaaggttggcttcacttccaaatctccccacttaaagttttcttttttcttctttctgtctgtcatttacaaaataagttggttttttagatgtcgcattttaaattttgaaatgtgtaactaatgagactattttccttatctcctttctttaaccctcctttatatactgtccttatgggctagtgtcatcattaattagttaatgtttgtagaatttgtgagcaagaattagtgataatagggaaagtagggaatatttgggttgctggttggaggaggaatactaatgaatgttaatcctgaatgctcacatagtgccttttgtcttcaatatagttgaacgaggcactaattaattgtcatcctacaggattattattaaaacagtacagtcagtgttcaagtgtgcctggagcaaatacagaagtttagtcactgtataggctaagctgaagatgcatgtgttttctgtgcagtgggaatgactaataccaaatcattaacagaaggatttggctaagaaaacaggtgcaacggtgaaagttttgatggtggacaaaaagcatttgactatttgtttttttgagagtttcaggcaaaagctttgcctatagtaaagtttaccgtatgttttctagtaatttttaagaaacatctctacaagtaagcattcaaaagaatgatatgtggtatctacaaggtaggccagatcctggtgacatatctcagatttgtctttgttgttgtcttctggtctccctataagggaagcagagataagggaaagctgaacagcccttgatgctctccacttcttattttggtggtttcaagtctttcactgcccctgtcattcagaaagagcttactctggggcttcttgagggtccagactcatacttaacaccctgattaacagcccaattgtgttttgattcatggctagagtgtttactatcatctctcctaaagagccattggtcagtaaacatgggaataaaaagtgctgcttcttgtccatgaatcatctcattttccccaccacattctttatattgttcactagattctatgaaaaactaatgcagaggaaatgaaaatgaaaattattcaggaaagagcaactaaggagggaaggaggaggcaatgccttagtgcctttgtgtgtgtatgtgtgtgtgtgttcaaagcataacccttccctaaataatgcatttgctgctaattcaatagcatatttcacacttgagaagagcctcctcagcagcacttgatgccagccctagtgctcttaaaagcaggccttctttaatgtatgtttgatgagtgtattgttcactgagagatgaacaaataatgatttggaattctctgtgtcactagacattatgtagagctttagtcatgggcaattagtaagcattaaccctcctggtgatttacactgtatttcttagattcagaatggtcattttctggaaaaacaaaagtatattccaacagggcatgtctttggctagacagaaggttctgcctgactttgaggggtaggaggtgggattcctaaagacagcggtacaatgatacatggacttatcaggcaaaaaaatatggtgtcagctcattattaatatttccctgaactctagagacatcatttatcatgtattaaggagggaaatgattatgttcataatgtagagctttaatgaattgaaaatgtacagacatcattgagcaactcttccttccataggtcaggctgactatgcttttactgaagagaatgggttagtaccatggagaacagtcattcttcttagatggcgagcatctgacactcaacttgaaagataacataagagtaaaatgatgtacgctgactgtgtgccttcctcctgctgcatagtgaacacttctgtaacgttaaacatgttgagtttatattgcataactgaagttggtaaagaaagaaatctttccaaggacacacacagtaaacctgtatgcagaaatacgaagaaaagagtgactagcccttatccctatattggtaaaaatgggcagatttctactttgcagcccgaagttaagaatggagttttcttttttgttttcttttttttttttaaattatactttaagttttagggtacatgtgcacattgtgcaggttagttacatatgtatacatgtgcgatgctggtgcgctgcacccactaactcgtcatctagcattaggtatatctcccaatgctatccctcccccctccccccacccgacaacagtccccagagtgtgatattccccttcctgtgtccatgtgatctcattgttcaattcccacctatgagtgagaatatgcggtgtttggttttttgttcttgtgacagtttactgagaatgatgatttccaatttcatccatgtccctacaaaggacatgagctcatcattttttatggctgcatagtattccatggtgtatatgtgccacattttcttaatccagtctatcattgttggacatttcggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgtcttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgttttttggctgcataaatgtcttcttttgagaagtgtctgttcatgtccttcgcccactttttgatggggttgtttgtatacaccaacaacagacaaacagagagccgaatcgtgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgcttatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgcgaagtcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagttggattgaagacttaaatgttagacctaaaaccataaaaaccagagaagaaaacctaggcattaccattcaggacataggcatggtcaaggacttcatgtctaaaacaccaaaagcaatggcaacaaaagccaaaattgacaaatgggatctaattaaactaaagagcttctgcacggcaaaagaaactaccatcagagtgaacaggcaacctacaaaatgggagaaaattttcgcaacctactcatctgacaaagggctaatatccagaatctacaatgaactcaaacaaatttacaagaaaaagaatggagttttcagagtaggcctactaagcctatgacagcattattgcttaattcggactctggataatgggctccagattcttacatagtccaggaatgatcctctgcaatctctgtgcccttctgattaaaataaatgttcaaagatgataaagggctagctaatccttttacttcttactgtctctctgttacaacttgtatgtttgtaaattttatatggaatcttgtaaaattaaaacaaaacaaatgttttacagtttgggaggtaccctagaggttgattcctcaaagctccagagactgttaatgatagttacccagtgtagcaatctatgtaggtagattcagtatgatataagacagtctgaactaatgattatttgttttccttttaataaacccatgtgtgagtctgtatgtatctgtgtggttgcattctctgccaggtttgttttgtattttcaaatgaatatttttgttgagattcacaccggtgcttaaaaatcaccatgttgttttgtctctgacttctcctactagattggtgagtttgattactgtagtcttttctaaatagcactctccataatcttttcctgtggaaacatttggtggcacaattgtcactcctgcagctaggtgttgattattaacaaccacttatttttgctccatgattgctgtcatgtaaattcccaggaagtggggtcagccagtcctgagtctatcctacagtcagtgatgcttatgggcaaatgtcaagagaaactttgtaccttagcgttgaaggtgaagagcactcctgaggtaaatatgagatagttttactagaaacagtaaaacaaaagatgaaagatatgttgagtaatataaacctaataagagatgaatgtgcatttgatatattttcggttgtccaggtccaaaagaggtcttggtcttcaagacccaactcaaaataaattaataacctggtcatactccaattacttccttgatattgattatctgaatatctccaaacattcacgcccttatataagggcctcttaaaattattctttaattgtttcaactttttatgttctatttcaattagattgaaaaaaaagccaactctttgggatagaaactccttttcttctggtgttcttgcatcttcttccatctatctacacaatgcatcttcaatatgaagcttgttgaagaaatgaatgaatgaatggttaggttggaaagcagagatttcaaagtgttctctaaaatcataatacatttatagaaaagtacattctctatttctaagctagcagttttttctgtgtacagcttccctctccaaatattttgtaccaaaatacccatggcctacatttctgtggaggccatatatggaaagcaatgagataatcaaaaaattcctttagttattttgcctcttgccttactccatccaatactagcctgttgattttcattctcttagtttaattggttaatgtggttaagacttaagtataactgactcaggcaaactttgtatctacttataaatctgctgtttttatgagaaaataaatgacaataagtcttctgtcttacagaaatatattattcatccaataagcctatgaaaagtccaaaaacttcttgggacttactatcaatcacatatccaaatgccatatatgatattctaaaataatatactagtatgagactagtttagaaggtctagctgtcaaaatccagatttttttaagaactgaaatgagattagattcaacaccagttttttatataaaatgtagttagaagacattttaatttttttaagcttttttcatggaggaaagtctttttaaaaatttttattaaattttcttaaagaatatctacaatgacaaatgctgaattcaggatgcatgaagaattatgaactgaaattatacattttgaatttcattttagaaatatgagataagtttttatcagcccctgttggcaaagacaattcctgatgtggaccataaaacaactcaggcctacaaattaatttataagtaattacaccccaggtttttagatatttagttcatatgcaaaagttgactgcacattaatgcagtttggatgtatagtttgttattttatattcctctgaagcatcaagcatctatagctccagaaaactctggatttattaagcatatggtactggaaaaaatataatttcataccctaagcattttcagcttaactcatcattgtattaactattagattttctttcatttctcaaattgttgtgcattttgtgatagatttgtaaactatctgtaaggaatcttttcactggaaacttctgagttctctttaaagggcagacaaaatgatttgtgggagtttggggagtgctatttgtttttattaggttgaactacaaggctcatgtcatccttatgaggtagatccaaaagcagctcacttttgttcattaaggtcaaatgaatgtcttgggatatacccctacagacaatcctgagttctcatcagcacaaagcacttcttgttacagagagaaatgttttgattcattatttcaggaaaggatgccaaggaaaaaaagcagctgacttacaacagcagttcgtacatttcctggactgttgggatgtatcatgtattccatttacattgcacctgcctcaggcacaggatatcactacgtaagagcaaacatattggcaagtaacaatatggtgtatgtggttgtaggtaaggatgctatccaaaggcaactgattctgttgtgattcagagtagactgcagacaatgctcatcagccacaattcatcataataacttgtgtgtatctaaactcttatacattggtagagtgtcatattgaaccatatgaaattgctgatattcaactgttttttcttagcttataaaactggaattttatgtagtttaatctaatactttcacatttattattccccttcgaaaggctacctgccatgcttgaaagcacactggatttagagccagcggcctgggtccatgtcccaacttacatgccacttgcttgctgggtgacctttacaaatccattagagattgaacagtgacatgtgggaacaaagaaaaatctaattcatgagctatttatcagttttttgactaacagtttctggatagagagccttcttcacaggggtgatatgaagttgcagtaccataatgtattcaaaaaggctaacaattcaaaggtgaataattattaatgtcatgactggtcatcaagaggagattgtcaggtaggaagggcaagtatcattatccttattttgcagttggagaaactgaaagtaataaaggtggctgaggtgactcagcaggtcaacaatagaatctaagacgtgtcactgttgctcttttaagggcaccctctggtggttctctcagtgtcaagtgagtgtgaacactgctctaactgaccacagcagcatcaccaggacatccccaccagtgaaaatgcctgtctctgtaatgccacatcagtgttttgcaaagtcatgaaaatgtaggatacctgacaatgagttcttccaaaatctttgtttttccccttcaaaaacggtattaggctggatgctgtgactcatgcctgtcatcccagcactttgggaggctgaggcaggaggattgcatgagcctagaagtttgagaccactctgggcaacaaaataatatcccatctctctgaataaatatatcaataaaatatgagttggacatggcagcacacatctatagcaccagctactttggaggcggaggcaacaagaggccttgagcccaggagtttgaggtcacagtgaactatgattgtgccactgcattccagcttgggttatagagaaatacctcatttgtaaggcaaaacaaaacaacaacaacaactgtatgaaaagttttggtgtttttgttccccccatataaggaaagccttcacattgcaaccgtgagaggcaccatgtagggtggttgctgtcattcctattatatgactgagaaaacaggcccagtgaaatctgaaatacctggtcggagatgtggcaggtagggatgaacagctgtgaagaaagctagttccttccagtttgaaagcctgtacttctactgctaaaatgctctgttcattcaccttgggcctgaagcagctcacaacactagttaattggtttgggcaatcataatacccatgcatgaaacaaaacattattcagtggtaacatatgaagcatatgggtaagattaaaactgaattcagtgagatccagaatacaatattggatgatagagcaaatactcccttggagaaggaatacagtgactttttatagacaacttttagaaaaatctcagtacagtattaatctgagtctacttaaagcacctgacaactatttacattgtaatatgactggttccaggatattttttacttgggtaaagtaagccataaagaaagccagtttacttcggaattcatatataacattccaccttgaccacccaccactctactttttatcactttccctttttattcttagcggtaaacttcctgtgtaagatcttgaagttactacggtttgcatgcaacattcaaggatttcatatgcggactgctttaaggcagctccctcagatctcttcaggatgacttcccagttagtttcaatttctctccctgccttcacactgtgaaagagcatggcatctctcgggaagtctctgtaatgctaccccttcttcagctcttagttactggtcctgggtgaagatgacttgttccatttttgacccagatacaggctgttggaccctgcatggaaaactaaagcaagctatgccgaaactgtcattatctgaggcaaccagtgctctctggacccaaaagtaaagccttgactaactttgcttttctgttaatgagaaaattctcccagttacctggacattttctttctcctaagatttcatctagggtagggtctgtcttctggcctgtggctacctacttctggctataagtaactactaggaactttcctcctttcattcattcatcatgaatagtgaagtacttaagattgtggatccagtgtcagactgcctagttttgaatccaggttcttccacatattagtcaaatggctttaggcaattttctgggcacaaatgtctctgtctgccaaacggagataagatcctacctacctgatacaaatatcacgagacgaaatagatcgatagattaaaaatgcttaaaatattgggcttacctgtccccaacctcattgtcaagccacaagcaattcatcacttatgctgtgtccgtaacaaaccccaaatattccatgcatctcagcccacgttcaaagtgcctcattagcttggaattccctcttgccacccccacttattaaaattttatccacatttcaagattctattcaaatcccacatcttccttaaagaacttccaccttgtgcacacctaactcttttaccattaatataatagcacttatactgcaatgtataatgacatttatattaccaaaatgagtatacaaatgtatatcattacacttaaaggcacctcaataagtttttacacatatgtgagtgtatgtgtctgtgtgtttgtaaaggcatgtatacacatgtatgtatgtattatgtacctgtatatctgtctgtataccaattgatttgacagtcattccttacatgactatcatggttaatgtaccctgttacacggaggatatgaggtaaataagacatattttctgcctatgaagatttaatattatggaaggaagattttttaaaaagcaatatatactatactatactgtaaaactgacttggatgatatacaagaaatatctaacatatacacacatatatacatatttatataggcatgtatttataaatgtacaactaaaatttgatgaaacatcaaatttctaagataatttccaaaagctaattttatttcagaactgataactgtgatcagtattaagtaaaaaattattattgtatttctacatattctaattgaaccaaggcttgtgccccaagattgttcagacttgcatacttcaatggttctaactttaaatttagaactttctcattctgatggcatctccagatttctgcttctaagtttttcacatacctttgatagactttgttgactaaaaatgttctttgtaacctttgccatgtgtttctgcagcagaatcttttttattcttttgcattttacagataataacttcttgtctcttggtctgggaacaatgtggaataaaaattgtaacaaataattttagaagaccggattcatccagatttaactgaataggattgttactatgcatttatacactgacaattcaatcgattaagcttacttttgataaactctataggttgactttagattgcattatttgacatttattatctccattgtcttcagtaggccttagcaaggaagttgagtttgtttagaggcttatatgtttttttttcctgaaagatcattgctttggtttctctgttttaaaataatatatccacattacccagatgattagtaagaaaattggacagagtacatagaagtgtttgttaaatagcttactctaaaaattatgcaaacctcatagcttttaagatgttttttaaaagcctaactatactagatagaaaaagaaaacagctaacaattatttcagtgcaaactgaatctttttctgtagctatgtctagatgattcatatattagtaaaaatagcatgtataatatgatcatgtttcatatagttacttttgcatctatctaatctttctatctttctatgtatctgtcatctatataacctctcttctgactataaatatgtagagataaatatttgaaattattttcacaaaatgataaaagttatttattggtggttgaatatagagcaattatttttaaccctattaacatatgttctgatagttattattttatatataataaacatgttacatatttttattatgtattctaagaaaattagtacctttatctctatgaggtttttaatccttttcaaaggggaaaaacaagcatacttctttataacatgttagtatcgaagacagacacacttttgggcttgagcataagggagcatctagttttgatgagactctgagagaaatgtttgtgagtttcggtgtcttttctctttagaaaaatactcctttacataataattatgtacaaagcactgggtacttatgcatatgcatatatactgtttgctaggaagatgctctgcaaatagaatgatttgtcattacgtacacgtgtgtatctatgcttaaaaatagctatttgtgtttatcacacacctttcatctcttagatgcatgaggatattcacagtatctttgattttaagtcctttcctttgccttgaaatggagttgaaatgactatttatttatttattgagatggagtttagctcttgttgtccaggctggagtgcagtggtgcaatctcagctcactgcaacctccacctcctgggttcaagtgattctcctgcctcagccccccaagtagctgggaatacaggtgcccgccaccatgcctggctaattatttttgtatttttagtagagacagtgtttcaccatgttggccaggctggtcttgaactcctgacctcaggtgatccacccacctcagcctcccaaagtgctgggattacaggcatgaggaaatgagactttaatatgaattctcttttccatgactcaatgctttatcttgcttttagccccttctgctccccatctgattgactttctattagtaaacatagaactgtctctgcattccaagccctcaaatggccaaagtagatggaccagctccctttctcttttataattccagctggattctcccccttgttatcgttagtgggagaacagagatgtgcattaactgcatagacagctgtggaaaacaagaagaagcccagtccccatgacatctccaataaagccatgagactcatgcaaggtggagaatatttgtatgttgtggtcataggaacctgaatgacttatgagcagttggggaattctgtattcatttttattaactttaattataggagcactataaaattttctcattctgtgttgcgtgaaaaatgcagtagttaattgctcctgacatttaattggtttatgcttccctctaacacaatcttgtactgcaagagacagggaaaactagttggcatatttctgcaattgcagagtattacacaccaagaaattagtctttttgttagttctagcagtgaattacaaatgcagtttcagaagtgtaggtagagaaataaaatctgtgcgtctacattctacatatgctaaaagactgacatgggcttccctgaatgctttgtatgactttgccagaatggctgagattttttcattatcattgtacagatttaaaaatgacattttttatacccttgtgaacatgtcaggttgtttaccatttctgttacaagccatctggacccttcataaccttttcatatattttttcaaatatcatctggcataaaaagcataaggtaaccttgctgttaccaattataatacatgatggaagaagttggatttagtgcggcatagtgcctctgatttcaagagtggcgagacactctggaaagcatccatctcctgtgatatgttctaagcctgaagggagaaaatgatacatgaagtacaaaaagccaatgctaattgccatttgacacaattatggactaacggtgcatataccaacagcaaggcactgtgtaaacattatgggatgtgccatgatgaaggtggcaggcaccttgccctcaaggagtttgtaatctagaggagggaggaggccttacatggtaactaaatgcaaggctggaaagtgcataaggctgagagagcacagagggagagaattgcgagagtatggagaggtgattagggaggctgtacggtgctgccatattataaaaatagaagtgaactggcagtggggaacagctttttgaaacgtgaagcctgtttatcatttttattgcgtctatttgattcttctctcttttcttctttattaatcttgctagtggtctatcaattttgttgatcctttcaaaaaaccagctcctggattcattaatttttgaaggattttttgtgtctctatttccttcagttctactctgattttagttatttcttgccgtctgctagcttttgaatatgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtactcaatagtcattcaggagcaggttgttcagtttccatgtagttgagcagttttgagtgagtttcttaatcctgagttctagtttgattgcactgtggtctgagagacaatttgttttattttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtgttcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttagcattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacttgagatgggtttcctgaatacagcacacgatgggtcttgactctttatccaatttgccagtctgtgtcttttaattggagcatttagtccatttacatttaaagtgaatattgttatgtgtgaatttgatcctgtcattatgatgttagctggttattttgctcgttagttgatgcagtttcttcctagcctcgatggtctttacaatttggcatgattttgcagtggctggtaccggttgttcctctccatatttagtgcttccttcaggagcttttttagggcaggcctggtggtgacaaaatctctcaacatttgcttatctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttgtgggtaacccgacctttctctctggctgcccttaacgttttttccttcatttcaactttggtgaatcagacaattatgtgtcttggagttgctcttctcgaggagtatctttgtggcattctctgtatttcctgaatctgaatgttggcctgccttgctagattggggaagttctcctggataatatcctggagagtgttttctaacttggttccattctccccgtcactttcaggtgcaccaatcagacatagatttggtcttttcacatagtcccatatttcttggaggccttgtttgtttctttttattcttttgtctctaaacttcccttctcgctttatttcattcatttcatcttccatcactgataccctttcttccagttgattgcatcggctcctgaggcttctgcattcttcaggtagttctcgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcatcaaagtcattctccgtccagctttgttccgttgctggtgaggaactgcgttcctttgcgagaagaagcagcaggaccatagcgcagctctgtccgcatcatctgtcattaattcttcgctttcaaattttataggaccccggaaaattgattgaggaagatctaaaagaaaacaatggtcaaattttgttctttagttcacttgctccaggtcctgaaaattatttaaaaccaacagatcgtcaaaggctaagaacacttactggagctattttttaattcattaaagacttcaaaagctagaaatcacaattctgcaaggttaaggaaaaagagaaatcttaatttcctctgccattagttttttaataaatccaaaaatacccctggtgtatcttgagaatgtagctcttctccatttttacctagtaaaagccatgtaatctcatacatgaaatgaatagataaactaataaacatgaaaatggcctctgtaggcagacaaggtagagatcattatactagtgcaagcagtgtttttgaggctggagcaggcagggtggcttttccctcagaagttacgtacgtccaaaaggtttgcaatggccaactcaaacgaaagtaaagttatggccaactatctgggaaggcatttccaaatggctcaaagatgccagaagcaggaggcaggcccaggttttggttaggggagatggggacagaaggttgagtcaaagaccaaggtggttttcatcctatacagtcacaagcagtgggtccaacacattcacaggtgcaacctctcccccagattctcccctgagttcagagatacccaatagatccttggagctgctggcgcatgtcataagctccaatacaaaatatcctaggatgacgacaatgttgtatgtagtaatcctgttattatctagtgaaaaacagtatccgagatcctttttctttttctttctttctttctttcttttttttttttttttttttgagatggagtctcaccctgttacccaggctggagtatagtgacgcgatctcggatcactgcaacctctgcctcctaggttcaagtgattctcctgcctcagcctccccagtagctgggattacaggtgcacgccaccaggccaggctaatttttgtatttttagtagagacggggtttcaccatgttggccaggctggtctcaaattcctgacctcgtgatccaccctcttcagttccccaaagtgctgggattacaggcgtgagccccggcgcccagtggattcttctttgtgctgcttttgctgatcactcgccagtcacatgcatagagacaatgctatttaccatcatgttcaggatgcagcacagggtgttggagagtccagtgcatttaggagcttgtagcttcagctctgcccacttgaaattcatggggctgattatcttggcctgcaagatattcagaaagcagctactggcaatgcacatacctctgcccactctgtgaacatagaaaacaagttttcatccagtgtcactgaggaaatatttcaacttcaaagcagccattgtctgtaggacttgattagagagtacgaccaaggaattggctacagtcatgtgtttgagaatcaaatctgtggatcttaatgtgcacctggtgaaataaaggaaactataacgttaaagaagaaagacatttcctaggaattcaactataatctgagataagaagatcattccttttgccaaataccccagggcatttgtcattttttcagtgacttttatttccatttagagtgagaggatcctgcatagaaacatgaagtctgctttaatgtggaacctgaaattcacttgtccacttattgttatttccacctccttaatttcttattaaaacccattttttcttcctctgaatgtttgctataaaaataaatacatatatgggaattatattagtttcataagaacatatacataccatatcagagttttatatataacaatcccataagtaacaataatttcataaagtaagcactttgttattcccattttacaggtgaggagagcttaggtaaaggaagactgagtgacttttctaatgtcccctccttggaagaggcagagccaggagttgacaatgtatttaaccattgtgtgtttcaacctctgacaaagttgtatttttccaaatgtccacattatttttcggttttgcatatcctgtacatttttaaataatggttgtgcatttagaaaaaaacaaggcaccaagatggggatgttgcatagattggggaatcggttctcaaggaaagagagtcaagaggaatagagcaaggctcagagctggcacacaattgaagaaactcaatctctagacccaaggaaagccctgtgatgttgctgttctggaatgcccagactgtgcttaccaggatgtagtggctccttagaggcacagtgccaggcaagccatgtgatcttgatctaaccagttgaggatctaggggagcatttcttaaagtatggtccacagtctcctacaccagaataccacaatgagtgttaaaaatgcccatctccagacctgactgcacaccttggaatggattttggggcaccttcctgggggtgactcttaatgataccaaagtttgagaagctctcatttaggtcatcagaagaaatgaacacgtgaaatcaatgacccagacaaggccagaaattttacatgggaaatcatggggccagatagtaacaatagtaattgaggagaaataaagataaatttgagctaagaggttaaagcaggtcttgaaagatgtgaggaattttactcagtgaagaggtgggaacattcttggtgggagaaagggcctcaaatgaaaacccttggaggaagtcagcctggcatcatggaaaaggccttgagctaaaattaggtttaatgaggattgggtttagaggagagtgttagcatctggtgtgggcagaataaatgtgatggtaatgtttaaaagtgattcaggatttaaggacttattcagatcaattcactttcagtgctacaggattgcaagcccagaattcagtgaattcaggaccttggtattattacttttgctaagtcatattttcaccttatcgaataatgattctcttcagtgcaacagatacacatctaacattagtgctatatgaaataagggggaaacatagaaaagttattgaactgtacagttcctgtgccttgaatttcatgttcttatgagcccctgtaactttttaatttaaatgctaatgcaaatagcccataaaagagacaagaagagaaagtgcacatgcctctcagaaatcatgtagacaggtagaccaggtgtctgatgcgcaatcaagatatgaagggctgatggtgggtggctgccattagaggtgtcagggataacgatggcaggtccgatgacattcctagtaacagctgcatatggctaactatgaggagtggcccttgcagtgcccttcctttagaagtcccttattcaaatgtgagaacagcagagattcccagactccaagggctgaaagtcccttttgtttaatccctgtcccaatcccagccttgctgctgctgccccagccctgcctcaggctcttgagggatggtgtcttttcagcacaaaacgccacatctgctgcactttcttgaagctcacttccacggagcatagggaatcaggtgatcttggcacttgagccttcactgaatttgctttgaaaagttaccaagtggttctggcatgagaagcattcttgattaattccccaggttggtggtctcttgtatttgccaagaaccagagagagagaccaacagaatggtaaatgttttttgttgttgttgttatttgtttggtttgttttgttttagtgatccttgtagtatgtctttctttagcacttaccggcccaatggcccctgcactccttatcctgcctttatgcaaacttctaactgtccaaagcctcaatagtgaccccatgagaccctatcatttctagtagagccatgcgtttcagacctttctgaagtatcttcttctcatcatgttttaataatgttttcctaacacagaatgttttcctttaaagaaaactggaaaacagagaaaaatgagaaaatatttgccaacatgtagataaaatatttattgctttaatcttaatttttttaagcttaaaaggaagggattaacaaaaagaaaagtgagtgaatgcgtgaataaatgaatggacacaaatgacaaataaatgtttgatttcatctgcttaaggcctgctaagtgattgattggcaaatcttagagaacaattcacatccagatgtttatagctaaaaatatcctaatatattttctctgagagatacaaaaagaattctgagacttgtgataatatttgcatgtcagtggagctcttagtccccttaacatcacatcaggattgtccactctgttttattggcttaaatgtccagaacatggcccagagaagagcctgtgacatttatcttctgtattcaatcccacttcatctgcaagatcatagttgggaagactgtaggttgccccagagtaaggaaggatatacaaactacaatgaatgtgcctagtaatatttctcacattcattccaggatatacaaactacaatgaatgtgcctagtaatatttctcacattcattccaggatgacacaaaaaggttcattaccagatgtgcaatgcaaagacaagtgctttgtgaaggtggaagagaatagctaggagtcatgtagaagaaaggaagcggcaatggggtgggttaagaattagagcaacatagatatcctataaaatggaatatgtgaagaaggtataagtgaacccaaagaagggtgcaaagatacaagaatgaggaaggttggtcaacagccacttttctggactagtctgtcttccagtgcttctctttgccactgtttggagggcttgtgcaggtggtggcaggaccttcaatttgcagacctgtgttaggtaggacagaattggattagccacttagtgacattaatttattgaacaaagtgagtcagaaaattgaaagttcatcttaatcctttaacctcctttcctgggacacctggattcattcacctatttcattaaagcataagtgtatggtacttacatgtgtcatgctctgtattaaagcctatgggaaaagcaaggataaatgttgctcttctgcctgtaggtggctaacaatcctcattgaaaaaggcagaaatgcccaagaaacctatgcagggcactatcggctgtatacacaagtgcagaaaaacaatgatagagaagccctgcagaggtagagatatcttcaaactgggggatctgcaaagtcgtcagagtggtggggttgaagccttgactctggcagatgggaaggaattctgactgggtctgaccattggaccatgaaatgtctgaaacacctgcttcctatcctcgggaggtgactaactcagctcaaggcctcttgactacacaggctttcaaacctccagcagatgaacacagaagatgaagtggctgagatgaagcctgcttttctcctgtcagaaaaaaaaaaaaagtttccattctgtcagtaggcagagagggaatgagagagcaaattctagtcaaaaaatgacaattggtttctgtttacacatatgtgctgagggttgttttcaaatcaaacttctgtaatctatcctcagctgttgtggtttatggcattgatgagtaagagcttcttttggaaggaaaagaaatataatgcacaggagggatcttgaaatgtattttgggacagaaccacatttcctgaacatgtttaaagtgtgaccttttctaatctttaaaagtaagataactttttgaagattaatatgttatgagtataaaataaccctctggtaatgctgtgtgtgaatggcaggaatatttttttccaagaccctttcgcttccgttccgataatgtctctaggaccaagaatggtttcttgttcatcctttctaccaaaagtccaggatatggctcagagggtggtgcaagttcagtagattcttgttctgggctcctttgtggatgttgatgaacttctatgtgtatgaaaattggtttgcttattttatcagtcttctaattggatttgcattgcattggatctcactcaacaaatttgctttaaaactgaatattatattaaaacctaccatgtattaggcactcactgtgtatcaggtagtatgctaagtattgtactgcttaatttccacaatcaccgttcgtgctgggagctattagtaccagtttccagatgatgcatttgtctgttccccagagcagggatcagaaccagcacctttctaactctaaagttcaagctcacaaccagtaagccatattgcctcacgtactccttctcaaccatatcccttcttccctaagggacaaagttcgtaggggaagcacaagtgctagagaggaaaagccatgggtattttagatatatttagtgcttttatcaaataagtagggcatggtttttctcccaatatttcctgagttaaattatagatgttttgagccacatagagcgatgttagtggtagagctaaatcaggctttggcttctaatccagccctccaactaggcaacaggatctgcctagatcctaattaagaaagtgccacattttttctaaattgtgcaaagcccttattgagttacctctgccagttcacaatgggagaactgatggttggggaaattggaagtcctgatacagattatctgcatggggttcagacgatgccagtcagtgggtaacttccttctacgtatcaaacccaagattattgccaaagtatcttatttatgttatatttctttctatttttttccattcattttttattatctctcctgatttccttttcttttttattttctttttatttgtttaatttcatgggggtacaagtataattttgttacatgcatagatggcatactggtcaaatcagggctttagggtatacattgcctgaataatgtacattgtacccattaagtaatttctaatcatccatttttttcctaccatttgatggatagtgctgataagtttagatatttcctgtattagaaagttaataggctccactagcttaggcataacatttataagctatgttacaaaataatacactggcaaaactcatgtagttctgatgttacttgtcaattttctcctaaggaggtattaatgaaacacatagttgggtgtggctaaactggtgtccctcttctctttctgcttctgtcatcctcagatagatccctgagtgtcacggggctctaagtctcatgatgatccatgtctccttgcgttagactggttccctacctaaaccagagccattgctcaaattgcagagtttcagttggtgtctgaggtgatttcaaggttggtgctaccatgcaaagatggctggctacaagtatgccatgtgctatcagcacgttctatgtcccactacacatgcatttatacactgggaacgttatgactatactgcacagccagtagaaaattggcaacctccattgccaatatctgtaaaaatgcttgcttgtgactacagtcagcagggtttcgtaggccttcctgaagttgaataagaaaagaaaagtaaaacattttgggacttggaggattcttcccaccctcattcattgggatcccaggaaaaaaagcaaagtgtttggaggcaaactgagtttaaattccagctccactcatagaaattatgtgactttggcttgtggtgtattaagttctcatacataataggaagacaatacctacctcccatggttgttgaaagaatttaatgagtgtttattgcctatgcacatacattacagtcaataaatataatattctctgtcatctttgtggttttctaattcctgatatcaagtgttaccctaaacattaggctcaagatctcactgttgttatctcagtgaggttcttcaactcacacagaagcacatagcaatttctatttctaaggctcaccttagagatcatctaggattagatttgagtttatgactaaaatgttgtagttttgaaacagctttcaacaagcagcctgtaccagcctgatcaaagcacttgtgccttatgatggtggtgaaaagctgtgtcctccaccctatcatctccacggcaatgagaacataatgaaggtggctgattgtgcatgaatcattccttactaaagtcagctgtagtgccagaatttttttttttttttttggcatcgcttactccaacttgacagcttgagctaaagctctaccccatttgacatctttgagaatcttccttttccctttgtaaacttaaacatacgtggtcgtggtgtaaggacccagtgggcacaagagttatatctagaaaactgtgtgatgaccagttttatctacactgaaaaagagtctatgttttcccagaaataaacccccaaagaaagtggacagatttgcaaacaaatcaataatcaccccagcaaccaccgacaaaaacctacaaggcaaatatctgtttaataggcctgatattgcctaacatacactgatagttctgagaagagaattaattctgtttgatctgctttagttagtctttgtagaggataccttgttgccagcatgtaaataggtgaggatttacaaacagcttggtcattgtgcaattttatattactttttcaaatggcatgtggaatgtggcattattttttgttatcagagaaattgaatttgaagattagtaactatctgtgattataataacaaaaaatccattttggttaaaaataataataacgattcattgaatacttacaaggtttcaagcactattcttaattcttggtatactttatctcccaaatcctgacaatagttctatgacgtaggtgctgtttttaatttgcatttttatagagacaaaaactgaggtttaaaagttatataacatgttcaagatcatagaacaacttaatggtgaagtaagtactgtaatccagatccaatctccaagtctacattcttagccctttcactaagtacttactactggaagggaaattagagatgaactaatatcacctgctcattgtcatgaagataaaactgaagtccaaagagctgaagtgatttgtccaaagtcacatagctacctagtgccaaatccagaattagaactgagatctgctaatgttcgttaagatcaatatatccctttcccctgcactacatccagggttatttctctctgttaactctatgatcactttttgagaattttttttaaaatcttttaagaaggaaggaagagaaggaaaaaggaggatatggaaggaaggaaagagaaaaaagaaagttgaaattcagatttggatcagttatacccaacaagatgtcaggtttgcacagtggagggtctgagtctgagcctcatgacaaagcagagggtgtgcgactgcagatattgaagacaaatatactcccaatctaaaggatcatctgtttttaggatgattcctcttgtaaggaaagatgttggcacttgtcagccagtacctataaggccccctgaaggtgattttcttactcccatcatgataaattcactctgtttcaatcagggtgtgcagggtccaaggccaagttcttttcctcttttcaaagttcagtgccttcttcctcatagaaatcagagaatgaggtaaactaactttcttttcttcctttcttccttccttccttcctttcttccttccttccttccttccttccttccttccttccttccttccttccttccttccttggcacatcttttgaaacactcaaagtattatctcacgcagctgatctggagccaaaaggcaagcactccaccaaagtagctcttgttcaacaaagtcacgtctctaggaccaaattgtcttggcttcgtggctcatgtgtttattccccttggcctggcattttgaatgctactgtccttatcaatctctttaaaaaatcttcttgcatttctgttttatcttctctctctgcagccccttctttctcccttagttctacttccactaaaattgcctctctacatgcatattgatcagctttctgatttctttccctgagaatattcattgctgtcctgcttaatgacaggttggtgagcagaattatgtttaattcaagccattttcaccaacctgttctttgactcttttacatgaagccttcagagagtgtgtctactccgttagtacaagaaaagtagaaagaaatgtctgcccttgtgtcataataagattaagtaaaaatgtaacaaatgtgtttgtcctaattaagaggatacaacatcatagaaaaaaaggtcttaggcagacctacaaggagatacatttgacttggagaagatttgtgttttaatatgtaccatcgaaacccaacaacaataacttgtacacctgcttttagagtttaatggataatttaatcaaatgtggttttaattgtaccatttactgatataaattattattgtcatcattagccatattgttaccaaactatttcaggatctaaacttggtactaggcattttgtgtgagacagagcaagccatggaaatttattataatttttaaaatctttatttcactgaaataaatcaccagacaaactaacaggaggcccttgctcttcaatcagcaggtatgttattaatccaactgtattttctctaacccctggaaacactggtgaaatgcaaagcatataattaacactgtggctagtaaagctattaatatatatataatagaagtaatagactgcctttaaaatacccagcggctgaacttctcatgttgcagaacagaaaaatatgcacgtggatgaatacttttatccaatcatttcctgccatccccaactcctaccctctctttcgcactttacttctgctatctaaacatccccttgcctttctaagatctacgtacagttatacaacacaaaagtgactaatttttactgatgtccataactgtctttgaggcccatttattgagtgtctgttaagtactaggtactgcgctaagcattttaagcacagtatctcatttagtctactcatcaacctatatattaggtgttactatcactaatttacaataaggaaactgaggctcaggcaagttgtataaattgcatcgaagtacacagctggtaggtgacaaagctgagattcacactgaggcatgtgtgagtgtctttctgctaatagacattacccttgaattttctgaaaaaaacaaaaacatctgctgctttttaggatgctaaagcactctttacgtttgatgttagagtgataagagcatattaatgacttttcaccatctaacttttttttgacttaatttatttggctgtgtgaacgttttctatgtaatcagatgaatttgtcatgggcccctttgattttatttgtttctgtatctgaaaaacaaatagcaacaaggcttctctcacctgtttcaatcaactaagcctaatctaaagcagaaaatggccatgttcttaaatctctcctttgagaatattgtcattccatcagaataacactcatccaaacaaagctccattataacaaatcttaatttctatccaactcaaagaaacattcctttattaccagtaacagtcatagatatgctgggaattctaaagtaattaaaacctggctcctccttttaagaagcttatagagaaggaaaagcagattttgctctaacaagtcaagaggtgggtaaggtattggggctacagagaaataatggcttttgagctggtcatgggaggatcaacaggatttgagaggtggataaggtataagaatatttaaagtaggagaaagatacaagctgtacagagcataaagcagattttagcagagaataaagtatatgcaaaatatttgtggaagagaagttgtactgaaaaggtgagctaggatcaaactgagcctgaagagcttttagagctcccaagagacacccaatctacattctcttggtagcagagagcctagggagggttttagacgtgaaagtaataagaatacatctcttagaaacataactctgacagtcaagtgaaaggcaaatgaaaatgaagggaaactgaagatggcagcttatcaggagggtgctgcaatggttcaggtaaatgaggatgtatttctggaccaaggcaacggtggtgagggagaaaaaaaaagatgtgaatgcaacatacttttacagtacaagaaaaaatgcattggttaattggatgtgaggtgtagggataaggaagagtcaagtgtgactcggaggttcttgcctaaggcagccaagtagcagatgattctgtttgctagggaagggaaagcttgggacagtgatgagcctggtagatgatgaatgtgctggggtgctttgggtttgtggtaggaatctatggaggatgatagtaaaaatactcattaattctcatttcttacatacatacaaatgacaaagaggagctgtgcaaaaccgctgtggaataagccagtttatgtttgtagtgtactagttatatggcatttccaatagggaatttcctattgaagtgaaacacagttgtttaggaagaaataaatgctgaaataatgcacatagtgaattcagggatggagaaaacactctcaaataatttttttaactaagaaaattccaggcagcacctaaaagcatgattgctttcactagacactttaaattactgtctataaaacttcttgatcctcttttaatgcccaaaccttttagaggaatttacaaactctttatttttggcttctcagaatgagtggtttaggttcaccccacaaaactggagggattagcccatcaaaagatggacacatatggaaaggtacttccacttgcccttaatacccttcacagtgatcctcaaagtgtggttcttggaccagcagtaccatcatcaccagagaacttgttagaaatgtaaatccttggacactcacccaaatatactgaatcaagaatgctggagttgggacccagcaagctgcacttttacaagtcctctaggtgatttggaggcttgctacatttgtgaatcactgctctagtcccggaggtaaagattgatgaaaaaaaataagaaaagcaataataataaagaaagaagagaacatttagaaaaaaaaagatcagcattcactttctctttgaataagtgaatgaacattccttgggggtgtaatagttaggctcctatccctttcaatacaacatatatttgtcgagaatccaattagtgccacggactgtgctaagtgtagcatattcaaaaggggaaaaattctgtggattttctgtgttctcaaaagaagaagaaaaaaatgaagaaaaagaaaaaagtattgttcgtcttaaaggtaaataatatgttgtgcttttgaagaattagatgggcttggctgtttatggttccaatgccagatgaaatgctcagtgaacacccctgcaacaagtacagtgaagggtcgtagctccactcagcctggccatgcatcctaaattccgaggccacaaatgttccagagacactagccttttttcacgaggcataatcaccacttatcaagtgtctcaccaataagcttcatgtaacagaaatgtcaagccccatttgattcatcttgcactgcccattctctctgaaggggatggctttcaggccctccatccatctcgcctgatgatcccttggagctcaactagagaaatcatccctcagactctgacacctttgaaacccaagagcatttcagtaaagcatcggaaatgtcagaactccctctgctgattcttcttcctcctattttatctctagcacacactttgctgcactgtttgccacttttatcttctttccctgatggcttttatatattttttggtcttgttcaagctttgaaatcactgctgctcctttttgtcgcccctcatcactagctccctgggtttcattgaccactgcttatctccaccgtgttgcacgtgtcttgttggttatttaataatgcatggctctcatgatcaggagtggagaggctcaggtctcaggtctggctactgaaactggaggtttttcctgctgacttgggtctcctttgatgtacgaggacatttgcagctcagcggcggattggtagcttctttgatgtgctcttcttattctgatttgatgtatgttatattccttttatgttcaagagggaccaaataaaggaatgtccctcctgcttctcacatctaatttttgcctaagcaccctctgttgctcttcgtgcaagggagtggttcttttgacagtgtataatataattttattaaagaaaaacaaataatatcagacaggatgaatgtcatcatttatgaggtcttaggcagctctttatctctctcctttgcttcatgttgcatttgcataaatggttctttaattcaaggagaattggctgcggataaatacaagtcaaacttgaaaggagtttaatacttgataatcacttatggacattgcgattaaatacactatcactcttttatgtttaagctacatagcctaaactgagtactacgagtggatttatcttgaagcctgcagtgtgcaggagtgccgcctgagctcacctgtggcttatactggcccagatattgccttctctggagagttgatagagggaaattggcaaacggtaattctgtcctgtgcttccatctttcagtttccctctgcactctaacatctggcctttcatggggacataagcaaataaataaaacaacaaagaatctgaagagtgtcacaaatttatttattttttactaatctttattagaacatcaaatgagattattcttgttaatgaagtttatggatgatgtgagcattatattcatttttaatatccctgaaattatttaaccaggtatttgagagctgtatatttaggaaactaaatagaaaatctattaattagggttaatttgcgatcagtaatattttaaaattaaacccacttgtgttcattgaaaactttgggtggaaggggtttcaatttcaaaatcatgtttgaatttattaatttatatttgtttacagtactcacattgctttcatatccattcgttcatttgaatatcatttgggtgagaaagacagaatggttattattagtgctatattacagatgaggtaatgaaggctcaaagatcagtatattctgggactagagttttgagctaattcagtgctctttataatacatcaagtccaattttgtacctcttgcaatacacaacaatttggcaaataatgaattgttttttatatacactaaaaattggttagtcatcatgacagaaacacataatgggaaccatgtatgaattctaacacttacattagaagtatgtatttgttgtagttgatgaaaaaacaaagttataaagatattgtagtatacatcaagaggttattggtaatctattctttaaatgtaactctggattcccctttttaaatctgattatttcattttgttatcaataataattaacgcttttatacatgggaagtcctatttttgtcttattcaacactatgaatcaagtaggtttcttgcaaattttaggattcatcttttaataataattacatgcagagactcaagtgttgtctggtttccctgtgatatagaccataagagttgaacctaagaatgtcagtcataagaccatggtggttaaaaaaatcacacatgtaggtccaagggaaaaaagtgccatgtaagcagtagttcctaatcaaatgtgtggtgtaaagccatttcaattattgattagcaggctttcttgcataatcagagaatattcaaaaatccttagaaggggttgaatagttatgtaatccatattgtaatcaatgcataaaagtgtttatttctctaaaactgtaatccttggatttacctatgtagttagctggctataattagatatactttacaccactggtgtaaagagaaaaattttgctttcctgggtacatttggcaatgtctagagatatttttggtcaccacaactaggggttgcttctggcatatcatggatagagaccaaacatgctactaaacatcttacaacacacagggcagccccctgcacctaaggattacctggcccaaaatgctaagagtgcccaaaaatgtcaataatgcccactttgagaaaccctgattgagataaaatgttaaattgctacaattatccataaaattcaacttcctacaaaactatttttgagaaaatatactgataaaacagtggtgatatgctgcataaactatttttggtaattaaatttgttctccatttcacttttgcttatgtgtcaatgctaataaaccagcagtttttaatttttcttttttttttttaaaccagagaccctttggaaatgcaaaatagtttagggtacttggaaccatttggttattatttgctatttcctagatgtatcactataaatttctcttcaagattatgcccttttattttattaacactgttacatactagacacctagtcactgccccacacctccccacgcccgtccctctggaggcctccctgattctgcagtttcgataacattgtctgtacccccagaccacagcatatattcctcataccagtaaatctttgttgtacacatatgtcctgtagattgcaatgtttgcttttatttttacctttcttgcgagtaatcatagtgcctcactagggctaggtgattcggttatctcatagttttctattcaaatcctaggctgtttccagacttgagtttgtctctctggtatcattagcttcttcgcatgtgggccctcacattctggcccaaagaggccagtaaaaatgctggtgccttttcaatcccctctctaatctgctcatcttcctgcctggataacctgtcaggcctttgccatttataatatttatccttcagcagttttccctgttcccttgttgattgcttttctgcaccaagaaactcccagtccctcttgcctgtgtgtgtgtgtgcacgtgtgtgtgtgctaaatagatctgtcttccttcagcagcctcccttgtaccccacttagcccttctctatttcataatggccttttccatgggtggggtatgtagtaagatctccatatctcccgtctgcctggctgtggctgcctcctcgtcagagcctcgggtggatgggaccacacacacgctaatgctctctaatccctgcagctttgtcactttcaggactgctcagatgctcacccagctctgactggtttctcatcaccctcttgaagggttgagctgtctttcccatttatctcaacggtgatagtgacagcaatccaccttcctggcctttcctcctgggccacctgttaggctgccagccgcccttgagattgatatttgccatttctgccgccaggtttgttctggcctctgtgggcatgttcactaagaggcacatcagtctcgctgccccgtgttggggcaggaaactccattatagactctcagttgatcactgttcttctgcttcttccctgcatcagtttctatctgtgagtgacggagcacctgcccagggggagatctcaggaagtcccatctccaatcaaatatacacaatcctgcccgctgaaccaaacaggccttctaaacgatcagatgacccatggcaaccatctccccagtaggacattgtctctattcttcctctacccattcagcccggagttctccggaaactctgggatgcctatcacacacggatccctctgcccctcagatcttagttttaattcaaccactgattctctcttacccactcagagggctagacccgaaaagagaaaacacaaggactgtttttgaaatacgtggacatgagtgtcacaaagttcatctggactaaggagagaaggaaagagctaggggaaacccccaagtaatatatgtgactattttttatagtggcttctggaaagcctgctcccatgtttacgacttcactgaaataaatgattctggtcatgtgcattttgagacagacattagtggcaaaccttgtcatgaatgactcctggatgctagggaacaaaagggccctttatgcagttctacatgacgctctccattcttgccactcaacatgctgctcatgctttgtggcattagcatcacctggaaagcttgttacatatgcgatcctgggacccacctcactatctcggacctaccaacttaccatctccattgtaacaagatttccaggggcttcctatgtacattaaaatatggaatattctgctctttcttttactgtattaaattctcagaactggctgggcatggtggctcacacctgtaattccagcactttaggaggctgaggtgggtggatcacctggggccaggagttcgagaacagcctgccaacatggcaaaaccccatctctactaaaaactacaaacaaacaaacaaaaatcagctaggcatggtggtacgcaccagtagtccctgctactcaggaggctgaggcacaagaatcacttgaactcaagaagtaggggtttcagtgagccgagatcatgccactgaactccagcctgggtgacagagcaagactctgcctcaaaaaaatgaaaacaaaaattatcagaacaaccttctgagataattattaaatttcccattttatagatggagaaactgatcctctgaatggtgaagaagtttgcctagtgttactggaaattgatccctcctgtaaaggctaaatcttacttttcttcttttaactatggaccactactgtataggtattcacaatgaagtaggcattactttttaaaatataattttaaatattagaaagaaaaatgttccagtctcattaagatggcaaattgccaaatggggaagacatctccatgggagatagggctctgaaacatccagctgagcagaggcatgaagagagagtgcatcctgcctgatgtggagggttcagggtagtttatagtcatgtggcagaaagaggacacactggggctctccacaggctggcagtcttggcaatccaaagatggtcacagcaagataaattatgtgttaaggagataattactatggcctttcctctgaacagcagctggaaataggctgaaacagatggagccagaaatagtgaaaaggttgaggggcaacctcaaaagagagacagatgtcctcaaaggaccagtttaaataagaagagcctctggatggttaaagataggggcgcatattctgcagataggattgtacaggtcttttaattctccctctaactagagttttattgttgtaagaggaaagaagaaatgaatcaatgaggtttattttaaaattgtatttttgttgacatatcacaggggattgatttacatggttttttatgcttatcccacttgtctcttcccaggcaaaatttaaccactaggtcttggctatatggaacaggaaccactgtccacctatattcaagaagagttaaaatttagaacatcttcttcctctttcctttacagtggcagtaaatactatggtgcctccagaaatcactcagcttaagaggttatctatttcgattttcacctggtgagttttgaatgggtatttagatgccaaattttaagcttgactatccctattcactccttttcacaaatattagtattaagagccaatggaaaaatgaaggctttcaggtagaacagcaatacagatagattcactgattagatgccactgttattgctgctaaccattcccagtttcaaaaaacagatcccaggggccagagtttcttactgattggcagcttgctccccatcctcccattcaatatacacacacaattttcaccactccactgggttctcaactgggttctcgacatctgcagtgttgtagatgggcaattgtaactttgagatgtgcaaaagcattttgaaaatcaaggaattctgtcactctggtcggtctcctggctttaatcaagaacatcctaaagcactatttctctatgtggtgtttcaacagatgttatgttgggttactaagagtgctgtaaaatggagagtttcagttctattgacccacctggaaccatgaaagaagtttattaatttttcacattaacatagtctacttagctcatagagtatcttcccattgggaaattctgcaaaattttatcactaattgttccaaacaaaagttttaaaattatgtgaaagtagaatcttttaaaagttatatttgagcacttatataaacaagaaactctttaaaaaccaattctttatatagcttgagacataaattaaaatacttttttcacatctaaatagaatgaggctaccataataaagcagtgctatgtatgtacttggcactcaagattttcaagtggcatcactatttcattattatcttgcatactctaccactaggcacagcagacaatctaccactaaaattccttgagttgtgttatgcaataagagggctatgggggtacatttaggtaaattacttatagtcgtgactgaacagcagagaattgaagggaccagcaatttccacctttctgaagctaggaagacttgaaaagatcaatcaaaggcatatgaatagtggccaaacactttgcctcttctttttagcaaagggaataatgaattttctctatacttactgagctcctgttttttctaccaagtgtgggagaaaaaaaggtaaattcgaaattaatacacgttttcctccaggtttggtttatgaaagtgcagcaggaaaaaagcatggtaaacataccactgttaatattttggaagatatgttttgtgtgtgtgtgtgtgtgtgtgtgtgtgtgtgtgtgtagtttggtttccctaatcacagaaaaaaatacaggtaatctcttactacagtgatctagtagtataggttgagagtacacatcaataagaaaacttaagtttaagtgaagaagtatactacccacactgcaggaacacattagctgtagtttcacttttggcatggaacctgactccctaatttcttatggcttcacactctggtttgtatatatattagggtgagaaatggccttagggtgaggcatctggaccattgctgaccttgcctctgtgctcccagttccctcattagtaactccagagataagatactgaagcgccctgttaaaaagtatgaaaggattgaggttgtgggagaggcttaggtgttgacattttatgataacgaggtttgtttaagttttgacacagattaattcaacctgttaaatagcagacctcttagggacatgacctaggacaggatccttcaacagagagagacatttgtcatctttgtatcagcagaatctaacagagctatcaataaatatttacctagtgaataaatatttgtttagttaataaagaaacagagaggatggatactccatttaccataatgcgagtattacgcattgcatgcctgtatcaaagtatcttatgtacctcataaatatacacacctactatgtacccacaaaaattaaaaataaaaaaatgaataaatgatgaaaaggtataaggaaataaacggggcatagctgttttcccaggaaggaaggcacaacatgcaatgtcactgggacaagtttgcgggtcagggcacgagcagtgttcaggaataggggttggatttaagagaggagaatgtgacaaagaagagtggaataagaaccagagtttgctctttcccatgtgctgtttccagccctgctaagagcagaattctcagtagaccccaatttgaagcgcataccccttccatcgcagtgccattcatcagggccagttacaaaggatgggatcttcaagagaattccatctgagtaatctgcactctcacttgaaaaaaatctctcctgagacagaattcatgctcacgtgcttcagaatacaaatccacaaggatggttcttagaagcttggcaagactctcttgagtttctttttatcattttttctttttgtttttaataagtgagctcaatatttatagtacttccatagccatttatttcaggtgtgtgaaaggggctgtttgcctgcccactgagggtgaattatagggatgacatttaatggtgcaacttcttctgctcagtgccctcaacaatggagagatgagttgaaagggagtgatattgcatagtaaacagtaaatgcctcacacaatgggaactcatcatttttattttattttatttcttaaacgtaaggtttgaaaaaatagcatgtggtctcttgacattattctaaattgcactgttagaagaacattaactttttcatttcacactttctgagccttaagcaccattgctgtatggggaaatcagtcattttctgatgattcatgtgcagatttgtgccaatcagaattggccataattatgccaagtctcttctttcaaggaagttcattgagggcatagagaaaggaaagcaaaaggagaatcatcctctgtatgtgctctgtgtaaattcacaaaccataaaggtacaagtaatttcatagtgcaatggaaatctactttgaatagactacattgttataaaccacagatactggtacagctatctggggagtcacttgatagggacttaatggcaaatctgtgggtacatttgtctttttcaagtttgccttgaggctatggacataagaaaatagtcaataatatctttctatgattaacttcctatgaaaatcactgagaatttggaatcactgatttttatcacagattctagagtagctgaagttatgagagatgttcatttgtctgagaccatttattttaagaaacagcaattcttacagcatgatactgaatcaggaatgagactaacaggaggcaggaactccacaaaaatgagatgagtggctgagatattagaagtgagaaatgtttatattgatttttgcgtgaaaaagagtccgatatctgttttattctcccctgcttctcaagattccctttcctcaaagtctatgaagtgttgttatggatttgttgttatttattttatttttaccttatttttagtctgaagtacattattgttttaaatcctatcaccataaaaataaaaaagggacacaattattttccttggaacattcctctgccttttctctcctattcaaagagcttactgttgaatttttaaacactagcattttcatcttcttcagcctgacagagtcattttgggaaatttgtgtctatagaggtattttctagtaaggtttgatttgattactgaccttttttaaccttaaaggtacaaaagaaagtacttcaagcacctaagggactctgccaactaatagcaaacaaaagttcaagatgggtcaggtcccacaaaggaaaattaaatgtattattctcacacaacaagattagcaaatcatccataaacccagccactcttttcttctttttattctaatgagtttagtgtgcaataatgatgatacaggcttcatcagaattctgccagtgaaggggaatttgcaaactctgtttgcaaatgagatgtgcaccataaaccatagtcatccatcatagagaagtagcttgtgcctgataaaaggctgttggggctgagtcaatcaaatgagcattattagagcttggtattatactgtcctttaggtgatggagaaggaatgtaatacagttatggaatgtgatttttttatgcctctgtcccttttggaagactaaactctattctaacatgaacatctcagagtgacattcataatctatgttataaaaagagaccttctctaatttctcatctgtcaagaacagttagaactgtgtagagttttcatgatatagctaacaccatgaagaaatggtcctgtaactaaaattacagctcatacttgttgattattaatgaaaggtagactgagcacttgtgtcaattaaatgaagaccaatgaagatgataacttctaatgtcctttgatcatgattaaaaataataattataacaataagattttgagcttataggttacttagacaccatctgatgtagtggatttctaacttttatttagtattggagcccatttttcaaccaaacatcatatggcaccaggacatacaaaatgatcaaggtgtaggagttctttagaaagaggcaagggctttctcactctttcttagctttccccagtcaccctccttgatggacatctctgatattttgaaacacattgatgtaactcatttttctaaaatttacagattgagaaaataatatgccaaaacatttgtagattttaataaggctgcagaacttactaattacaaagcaaatataaagatccagacatctttacttccacacagatgctttccctactgtgcagagctccgccattaccttgctctacatcgggtcagaaagccaatgtctgcaggggccaggcagtcatggggatcaggggtaaagcaggtggtaagctgcaaagctccaacccccacatgaagagaacagctgtcacagtttcaggggatgcttctcatgaggaaaatagggcccaagattccttaactttctttctattttttttttttagcagaagttgaaaaatcagaacttcagtgtaacaatggtaataattaaaaactttaagtgaataataataactactatactgatgaaacaaaacatatctacaagacaaattcagccaacaccactggtcactataaatactgatgttgagttcaatattgtgatgttgttataagaaatattaaaattcaaacatccctgtaattagattcattggatgtgcccaataattattcttatgaacaattagtaacaagtcctcattaattttttaaataaatattgaggagcccctaagcactaagctctgctgtatagaaaggtcatattcccagacctttgagaacacataatctattgaagagagacaagcatacaagtgatatttgtaagaaggtgaactgagctaaaatagaggagaaatgatggtgtttgtgggactaccaacaacagtaaaaaatatttgcataactctgctcgataaagactctccttggggagtcatgaagaatgcataggagtttcccagacaggtgagaaaggggacattctaggcagaaagaacaacacacatacaagaaaggagctgaggaaaaatcatgtcttgatcaaggaactgcaagtaatgaggcatggctagagggcagagaggatggagaaagggaagaagagagagaggcagctggacatgtagacaaaagctagtcaatgaaatattataaaatatatgctaacaagttaggactttattgtgtagctgctaagatgatatttaaagattgtaaatgggtgaagtcatcccatttttattctagaatgatgattcagatgacatgtatgagttagagacagagacgggagaaagaagaaccagttcttgaaatagctcaggttatcattgatgagggctgcaaaggtgttgagattggaggaatgaaagagataactttgaggcagtagatttatagaatctggctgctgattggctgagaggaaaaggaaagtattaaggataacagatgcccgggatttctgtctcaagaacctggactgactgtgacccatttaaccaagggggagactgaggaagtggtaggtgctggctgcagcctagaaaggctgtggaatggggctacctgaaccaggtctggaagggctgtcagaacaccttggtgtatgcagttcctggcctgcagaattcacctctaaaatgaggtgtttccctaatttcctccagcacatttcaaatataaactaaaacatgaccttgaaaatccagaaatctaaatatgaatgaaaaaactactaatcttattagaaatagcccactcactggaagacttctacgtcaagaagcttaaaatcagctgaatttattttttttagcaaacacattctagtgctaaaaacaaacaatagtaaagccaataaatgcctgccaaatatgaccagtagtatttctcagctggtttaatgagcactgagctagaaggtcgagacaaaagcacacaagaatctctttttttcaataatacaaatttaacatgtttggcattttattttgcatttgaatatggaatagctgactttagtttatagcaggagggaaaggttaaaagatttgttttcctcctgctttggcctagagtagtattaaaccacattctcctgtgatctattgtttagaaatctaatttttttttcttctcaagaatgtattcggagtaatcatctcaaaatatcattgaaacccttcaggtaggccattaaactcagtggcagagtgaccagagagagagagcgcttgactacctatattttcaaattaaatccaaacctcaagtatggtgaaaagcaaatatagtcattctggtcatcaattcagcaattacagacacacagtggatcactatataattcaaaaatcatgtgtctcaatgaggtctgtggttattttctatgttaggtactaatttcttttaatttacaaaagcaatgcatttttcttttttaacagtctagtgggggtgggacatgcaaggtggaaacaaacacaggagctattgaacatccataataagggcattattaggagaataaaaggagagggaagaaaaacaatcaacctgaaaacttagtacaattcctaaatagtaattcctttcaagagaatttatggatcttgataactagcaagtggcagcacgctccattcaacataaaagtaatagcaactaataataataataatttccaatgaaagcagtggttaccacagcctctgatttaaaatgtaggttttggaacagcaggcgtattaccaatgatatttgattttccaagaggattatccataaagaatcctgcagctgcacttatttacctgtctcttcatagcatcattatgcagacagggatactgagaaaaacactgtaacaaaatttaagcgactgcataattctttctaaatacacccactttatatattcacatatattgtgtgctcttcaaatgcaaattttaagtgttgtttatctgttacttctctgcttgggtctctgtgtgtagtctttccttaaggtagtaatatattcagatgttcagtttctctaacacaaaacgaattttgaatatgtaagctggggatttttcaatgaagtgacaggacaaaagagacccagacaaactgatgctttccttgggaattaattaagattcagagtagccctcaaatatttataccaaactcttcattttttaataagtggcccctagtgtgggaatctagcattgctggtcttttgggggaaggtagcgttcacagatagtaactcttgaatcttctacattcgaaggatggagaaaccacagcatgcaaactccttaccagttttttgtttgtttgtttgtttgttgtttgttttttgagacggagtctcgctcgctctgtcgcccaggctagagtgcagtggcgggatctcggctcactgcaagctccgcctcccgggttcacgtcattctcctgcctcagcctctctgagtagctgggactacaggcgcccgccaccgcaccccgctaattcttttgtatttttagtagagacggggtttcaccgtggtctcgatctgctgacctcctgatcctcccgcctcggtctcccaaagtgctgggattacaagcgtaagccaccgtgcccggcctccttaccaggtttttaacttcaaaatctactttgcctgtacatggcaggttgttgttcattttaacctcgattaataaggaaagaagacaataaattttaggatgtttgaaattctgtatttgcttatctacaagctatgtgatcctccaagtccaaaatgccaagcaaactgggaacactgatagaagtatcgccatctttcttcttttcctggcttcaataacttcatcaactacttctctagatcatatcagatttttcattgactttggccttatgggtttttgacccttctatataaatgcattggaattgctttactctttagcagataatcctaaagaatacttttatagggcttcatcatgtgagtgtgacattacagtctactttgtgtttggattatgggtcttcatgtatcaatggtaatgtcatctggcattctccttctagccactacctttggtattgatgttactgtgatgatttgcacatgagtgccacagagttatttttgtgtgtgtgtattgctgccattgagatgaagagagtgatggaaccaactcaccagaccccctgggactcctgatccccttagtggttccttttgaggcaagttgaacagaaccttgtctccagttttaaatcttgggtttatattacattcggcataatgcccagagagacatttcaattcaattgattgatttttatgttacattctcaggagtactgtttgccagttttcatcctcagtcctgtctgagcagttctgtggagagttatactcttccacagtaatatcctcagaacaattttgaaacaattcttttctccatattcttaaacagacatcaaagactttagtcctcttgtgaaaacacaatatttcttacagataagacacaaggcacatcttagtctgcctaagggtttcaaaacaagaaaatatggcaccttcatgataaagataaccccccgtcttagtcgataatactctcactctgctaaccatttgatatggttatcaaacagtatcttcaacaagtagccagtgctaaagatagtgagggatcaaagaggtgtaagatagcttttgccttcaataaatcatcatagttgggaagactgggtatacaatttaaagtattactgtaaataaaggtcagcatgtgttaagtgcccacagtgcagtggcagatgacagttactatacaggttgagaaacatgggacagaagtgtgactgaccttggtgactggaacaggcttcacagagggagatgctactcacttggatacccaaggataggctgctcaacttcaccagaatggaggtgtgctagtctgttctcgaactgctataaataaatacctgagactgggtaatttataaagaaaagagatgtaataggctcatggttctacaggctgttcaggaagcatgatggcatctgctcagcttctgggaaggcctcaggaagtttacaatcatggtgggaggtaaagggggagcaggcacctcacacaaccagagcagcagtgagacagagagtggggaggtgccacactcttttaaacaagtagatctcatgagaactcactcactattgagaggatagtaccaaggggatagcactgaatcattcataagaaatccacccccaagatccagtcacctcccacgaggccccacctccaacactggggattatattccaacatgagatttgatggggacaccgaaccaagccatatcaggagagtattggagtctggagaatggtgagatattctagtccaggggtccacaaccccagggccacaaactggtactggtctgtggcctgttaggaaccgggccgcacagcaggaggggagtggtaggtgagcatttctgcttgagctccacctcctgtcagatcagcagaggcattagattctcataggaacatgaaccctactgtgaactgcacattcgagggatcgacattgtgtgctccttatgagaatctaattcctgacaatatgaggtgaaacagtttcatcccaaaaccatcccctggcccctctgtggaaaaattgtcttccacgaattcggtccctcatgccaaaaaggtcagagactgctgctctagtccaaccttgaagatagaataatgctttggtgaacagagcatacattttgttattagagtagaatgttaatgaaaggaaatactgatagataaatttatagagttttttttttaattattggctaagcattttgaattttttcaagggaaatgagtgcctttgaagacatttaaaggcttttgagacgagaagttttctaagatttatctgcccagaaccgattgaaatggttaggtaggtgggtggtggtggaagagggagagacagatggaaaaacacattttattagagatttacaagtgagatccaagtgctcagatcagtctggtaacagtagaattgagcagacataatccatatacagtttttacttagtggagacccaggtcattctgaatggagtgagtaacactttgtacttttaccttcccagctaatggccataactttcaccctagttgtccctaatggcttgccaaatgtattaaaatgattttggaaaatagtttcgtgggatgtaaggtgaagaaattaacatttgctagtttctttccttagaataatagtcttaatcttagagcttttattagttcattctcatgctgctgataaagacatacccaagattgggcaatttacaaaagaaagaaatgtaatggatttacagttccacctggctggggaagcctcacaatcatgccagaaggcaagaaggagcaagttatgccttacatggatggcaacaggcaaaaaaggagagcttgtgtcaggaaaactccccattataaaaccatcagatcttgtgagaattattcactatcacgagaacagcataggaaagacctgaccccatgattcaattacctcccactgtgtccctcccacaacatgtgagaattcaagatgagatttgggtggagacatagagacaaaccatatcagagccctttgaaaattagacaaaagtatggaatctcccttgcgggggaaaaatacacttatagacaagattgtgaacacagtttcagggatttgcagataccctgaaagatgcatagatgataacttaagagtccttagagcaatatttggtccttaatgatttagtgtaggcaaattctgagttgcagttacagtaaattcaggtagaagtgataacactatagcatttgctcattctgaggaaagggagataacaatgaaacgatgacacttgggctggcaaaactttaaaggaagactggttgggagtgaggttttctttccacttagtgccttatttgtcactcatgtactctgatatggtttgggggtgtccccacccaaatcttacctttaattgtagcctccataattcccatgtgtcatgggagggacctggtggtgggtcttttctcatgctgttctcatgatagtgaataagtctcatgagatctgatggttttataaagggcagttcccctgcacatgcgctcttacctgccaccatgtaagacatccctttgctcttccttcatcttctgccatgattgtgaggcctccccagcaatgcataactttgagtccattaaaccacttttctttataaattacccagtcttgggtatgtctttattagcagcatgagaacagactaatacatactctgatattaatcaagtaagaatttaactgaagggttaatttacaattgggaaaagaaactattatggaagacagaataatttcggaaataagcctgtctcaaaccgagacttaaatgtaatgaaactgcctttggtccatgtaattttcctaagtgatatttcaggaatgttcgccaacagccacttcatttcattatttttatagtaacataggcaggaagtaaccaaggtttgattaaacttgcttatatgaatggaagaggctgaaaagttggtcagggaataattgctgctttcattaataatttagttgggtggctccttgattcatacctttccagtttattcagtaaatgcttattgaacatctactatataccagactttgacctgtagacaaggtaaccatccatgtagtttgttctgggaaggtccagactaatggctattaactctatgcaattattctcaatatcatttttattctcaaaattgtcctgttttgaacaataaattaagtggttattctagctttaggctatttggggaaatgttatctctgggaaaaactgtttggcctgcccaaacgtttcttactcatcagtccaaattacatatgattacttgtagtatttggagtataatacaagcctcaggaagatagaacttcatccattttgttcaccaatatgtctcctgggcctagcttattgttgaaatgtagtagatactcaataaatacattttataaatgaatgaaccatgtaaaatacttcactattggagaaaatggctaccactataggtatccaaaggactaagaatagactatgctctgcaggtcaggcttaacttgaagaaaattaaccaaaaaaatccaaaaaagtatattaataattcaagaaaatgattttattatctgattgtattttagaaatacgatttgaatgtgtttattttggttttgaagtcaatttcttaagtaaatgtaaagatattaaaatgtttgccttggttatgaaaggttaggtgaccagctattgttgaagtaaccatgtagaacattagaatttcactgtgggcatgttgtgaggcagggattaaatatccatgactaagggaattagtgagcaccagacccaaagtatgtctttcctccctcccttctttccagttgtcaggatgttacagtatatagatattatattttgaagaggtgacctagggtatatgagccgtattcttattttacacagaaatacatcaagcttggttatcttgtttcccagcctccagaagattagaagcagaaagttagaaagaaagctgttagagtcaaacagatttatggtaatgggagagattgcacaaccacaaaaaggaggcaagggattcaaaaagcatcatttctgaggccgtttgggaaagagataaagagcctcacacgcccggtagccccagaaagcctcactgtgttaaaccagctcacagcagttgtcagtaatgatggcctcaggcaatcggaaaaggttaaagtaggtttattgtgctctgttcaataagaggacatagtttataatccacttcagtggtgctggtgttttatttaagctcttttggttgcaagtaataggaggaccaaaatacatcctaagagaagtgtgtgggcgtgtgtgtgtatgtatgtgtgtgtgtgtgtgtacctaatgactacaaattgcaagtaaaaaggtataagtggtcaagaactgagtcggctcgtagggctgggtcctgattttgcaggtccctggtgtcttggtttatgtatctctgtttctgtctgagtctgatcccttgttgcagctaggcattacctctttgggctcttctctctaggcctctttttagtttgaacttctgcttctgtcttctctctaggtgattctgataaaattccaagagagataatgtgatttttccagctcatctgttcacactggcaatgtcacggcttgttgattatcctgtgttttacctgctctgaatcagtccttttcctgccccagtttgcagatagagggagtgagtggctttggttatctggcctgattctgataatccactaagcagaagctgcagacaagctgttttcacaaggactcaactaaaggcattgcagatacctaaacaaatccaaaaatagatcaatgttttaaagttttgagatttagttcaatgaggttcagttacctgaaaaatatgctttaggtagaaatacattccattaccattctacaaataaaaccctactctctctatatttcatatcaattcagggttctaataaaatattactaactttattatgcattatgtgtctttttccccaaaattattccgaaagaagttctgtgttcttcctatcctatgttactcacccataagcacatttccattatcgtccttgatattcgagggttggatgtaattgatccatggcctctaccatttcctcctcttctccttattccctactcagacttagcaaaacaggggaagatgcttttacatctggagcagagcatcactgttccaacaatgggtgaacgtgagctgccgttgttgccaatactgggttttgcaataagtgctcagaacagtgattcatgtcacaacatagtacatgcaggaaattatactagtggtccagtacaataagccttagcacatgtgtcacccatttacacacttggttaaaggcatagaatgaattaaataaatgtaggtcagaaatctgttttcaacaaagaaccagggagagaatggcaattcttttatacctcaagagtaaagactaggtgggacacacttataaaacgttagtacaacttgtacagagatcctgattgaggctgtcaatttaagacatctcaggtaattttaatgacaagactagatataaaaacagaattagcattttgaaataaacaacaatggtggcccaattttgggtgcagcactgtgtgtgcatgtgcccagcgaatgtgcatgcattggtgtgtctgtgtacataggcacaggccaccctctccttgtcacagtacacgcaccacctcctctctatcaccaaaacatatagctaccctcaaataaaagagcagctaagctcttgtagaacatgacgtattatatcagcatagatttcagtatttcaaattattcctggaattaattcactaaataacccaggtagtcaaagcacagatccattaggctcggtagaacacattctttaaatgttagtaccatacaatgaatatttgataagtacatcattaataaaccttggtgtgacataattgatatgtggatgtttaatgacaattccaaatgatgtagcacatggcatccactcatccctcaatcatcacgcaggttgcccctgtaccatgcgatgggcacaattggaaaggcaaagtctgatcttcattagtggctacccataaaaggttttcattacaagataaatgattatagcctggctttattaattaagcatgcatttctgcagaccaaagtaattgaataaaatggctagtagcttttaaactacacaaaatcttaacatctcaagaatagattctactttcaatctgtgcctttaaccctctattatttgagaatacatggcaactgaatttaaactgttgccaaatactgactaaatttcacatacgagatttttttcctctaacatcttgctctgtggctgtcatgataaacggatttgtctttcctttcatctaataacctcaaattcatcctgaccctactctcagccttgaggaacataaccccagaatatgtacagattaactatagaagcattggtgcttacagaaatgaaatgacttgttacatcttgaaagagaattagtggctgaagagcaggtcactagaagtcctttattcagttgtcactgaatcacacctaggaaacgacctcatcatccatgctcaagtccttctttattttggggtcaggaaggatgcttcaaacgtgatatacccatgtaacaattccctttctatctctgactgcttcagtgagaaaaataagaattcttagaatatcaattttaaagtaaaaaatatatatctacaccagggaagacattttttgctataatttttttacatatacaatatcttggaataaaagagctctaaaacaaaagcagtaaattttgcaagatcattatgtttctgattgcttggcacataggagctgtgaaagcaaagtttaaaattcatttttactcaatgagaacacacatgacttagtgcccacaaaaaatccctcaggataacttttttaagtagagcaaaatgtatatgtatataatatattctaccatgaagcatctaaaattaattttataagatcagagaatattctggcaatgagacaactttttctccccaattctgctttgaactagttttttttttgtatgatcactaccagaaataattacattattaaattaattccactcctattgaccgtggtcactaaacagttcatcagcttacggtattaacataaaataggaagcttgaccctcaccttgtcgaaaatacttttatttgtagtgtttttacttgaatttattgataattacttttatactttatgagtatgctattgattcttctgcatgcctttcaatggaagcattaacaaacatttagctttgaaggtgacattttaatttcatttctaacatttgtaaggactttgacactaactcccaccataatattttcaatcccatgaagaacgaaacatttccatagtttattgtctacatttccattgtaatggccaggtggctggtattagagtagcatggcatacaattccagtattaactaaaaataccactagactattcaaatgactcgttttgcattagtgcaattgtttccaattgcgtttcatcatgttttattcatcctagtttcttcttgttgtagcattaaactatatattatgaatttaatgtatatagtaaagctaaaaattccttttatgaagtattaagtgctgccataattcttatgtttatttttaatcatttttaaacctaagattacaagcacagatttagagataattctgatttaatttaattaatttatttgttttgttttcaaatatgagaaccttcatcatcgtgtttcaatgagtctcctgaaataataaattcaaaaagaatttattttctcttatttcagctgagctctctttgctgcaagtcttttatttacatcatccatttttcatccttgattattcagaatcaccagagaaccatcttacttctgaaccatgaggttattattcaagacctactactatgctgaagaattcttctttcttctttgtcccaaccagatctgactctgtcactcaccagctacatgacctggaacaatggtttctgcatgtgtaacataggaaagcttgagggctcaatgatcctcagagaatcaaatttggccagtggcctccaattctatgtgttatggcaagactcaggtacaagtcaagacctttacaggggcaattcagcatggcctggttgtaattccagtttttctacttagtagcattgtgatcctcggcaacttatttaaactctatgtgccagtgtttcctcaactgtaaaatggggttattattattccatagagtttgttataaaaaccaaatatagcaagtactgtgtatccgaggtactaaaaacagtgcttggtgcatggtaagcatccaatgaatgttagcaaaggattaaacgtccctaaggagtaaaaagattatggcacactccatccctaccctacttccgtatgtaagttaaaatcaaaattctggtatctccatatggtgacttttggaagctttagttgaaatatgaaacaaacaaacaaacaaaaaaaggttaacttttggttttcctgccttagctttgctggtgctctaagccagaatatcctgtagcatgtgctgcatcgtatcaaggtatgaaagacaactatcactcccttcctagtcctctgttgaaaacagatttctgttttatatttatttaaatatattgtaggtgtccatttatgaaaataatatttatctaaggatgaagcttcagatatttctggaggtcttatccttatgaatcaagtttcagtcttatagtgattattattgctattgttactattataattgtggtttcaagtaataaatagacattatattgcatttgtcatcatttatcacaaataagtacccaggtatatattaatgaaatttcctgttgctttcctgagtgccttgttctctagaatagtaatgatggaaagcagaccctttcctggcacacatttaagatatagtaaaggttattcaaatgccagttattttaatgataactttgttagtgtaccaagtttatcacatattaacatggttatacaatatagtttaactatatctaacgatattaaggtttaaaaaataaatttgactttcatattttatttttagtaggcccaatgtatgacatgattttaaacttattgttgtttgaagatataaatatttgggcaagtaagaggatatggaagacacattgcttaaagctgatgacggtgtgttgaattacatatagaattcctgtggatagaccctaactgaagagatatctggtctgactccttattttgtagctaagccacttcagaaaatgtaactaatcagccacaaatcgcaaagctggaaacagaattccctgttttttgacaccaagtctgaggtctttccaatgtaaagcactgcttcccaaggtactattcccagagagaatttatctagtattttcatttttcatacttgttttttttttaaaaaaatagtatttccactctggtttgtattgaagtgaatagaatcccaattatacttcactttatggaaatgcaacacatgaagagctttttgtatgagcttttcatttctggttctctttgtcacaaaaggctcttcacttttgtagttgaaatcatttgtaattatgaactgtgcttttaaaaaattcatcaatgaaatctttgattttgaaatgaggtgccagaagaaaggcagaagtgggataagtggaatttaatgcaatatgatagagaaatagagaaatcacaaacgagaggcatctcacctagagcagtgtctcataaagcagctggaaaatgaagataatgcatttggtcatgttttggagtttattattcagtattatttgaggtaggagtgcacagaaaatatctttatgccacacattaaatatttttcatgtatcaaatatatctactatacaagatttagagatgatgggcacagggggtcaccaacacagtgatggaagacacacagttttaaatactcagctgtatttaattatattttattttgttgtctttaattctgacctgctatatggggttttatgtcagtatcataaatgtgccaatatctgttaataacatccttaaggtatatgttagtaaacggccaaagaaagaggactgaattaagtatatgcttaagatggtgagagtgagaagaaattgaacaaatatttttaaatgtggatttcaataaatgtacttccttacacaatacctgcaattaattacaactcacatgacttatttcaccaactcagaggtaaatatgatcatatgcacttatttaatgttacattatcactcaaattcccattgacttgggaaatccaagttatcctctcaaagatcttgcccacccctgacagtttcaactggttaaaacaagcaagcaagcaaacaaacaaacaaacaaacaaacaacaaacagaaagaactcagagcaaagtgggtctgtcctggctccaaaagctagtctctgagagtgctggagtctgatctgttcacttcagctacaggcgtggatgcggccacatggtttcactgactgagacaagcccagcactggcacacagaagcctatctctgatgtccttggtggtccaaattttgaccaaaccttggtcaaacctctccacagcaagtcccagggtttcattctgcttcatatctcatgttaacagagatcttggtcccagtcacacggctgcaggggctgcccctggggcacctccaccaccatcctggtcctgacagtagtttatcccatgatccttcagccttctgattgagccagggtcactgaccacatgtctttcacatacattatttcaggagactcattgtccccccctgactgcgtgtcttaggggtactgggtgcagtactctatgtcgttcaatcttaagcagcagaggttggatttccttcttcccacagctattaggttttgttatcaaaacataaatttcttatcccttctgagcactttgaaaatcagagaaacagagaatgcctatgagttcctctcttacaccctttttcttttccttcccccatcctactcctaacaaggggtttcttttgacccaaatttgcctaatttaagaatacagcaccagagattcattcagaataaagaatacgtgcttcaatgaaacagcttgactatattccttatctagaagatgctggcataaaagtctatattacctctactcactatttaatctttgctgtaacaggcattgtgctacatacagtttttaaaaattctcttctaagaaataacaaaaaaactcctttagagttagattagcctagtcagctcttattcttgaaagggaggagagttaaaaaataaaaacatttaattgtcttttattattggttttgactagaataattatgtcgcttgagcctgaaacatggaaaggggaagttcaaacctaacaacttcttctatactaggccatgtgatttgcacaccaatgaatgtgctttaactctcagccctgaagccgcctgtaaattagttctttttttttgccctatgggtacaaaaggttcataacatcaaaaccttatgccaccctctctacccacagaattctctgataactctcacatcatcaacttaccctttatactagatcgttgtcatttcttttctttagaattcttttttaacttttattttagattcaggggtacatgtgcaggtttgtcatataagtgaacttgttccatgtgggtttgttgtacagattattttgtcacccaggtactaagtctagtacccaacagttattttttctgatcctcttcctcctcccaccctccaccctcaagtaggtaccggtgtctgttgtttccctctttgtgtccatatgttctcatcatttagctcccatttataagtaagaaaatgcagtatttggttttctttctttctttctttctttctttttgaaacagagtctcactctgtcgcccaggctggagtgcagtggcgctatctcggctcactgcaagctctgcctcccgggttcatgccattcttctgcctcagcctccccagtagctgggactacaggtgcccgccaccacgcccggctaatttttttgtattttttagtagagacggggtttcaccatgttagccaggatggtctcgatctcctgacctcgtgatatgcccgcctcagcctcccaaagtcctgggattacaggcgtgagcaaccgcgcccaggcccagtatttggttttctgttcctgcattagtttgttaaggatgatggcctctagctccatccatgttcctgcaaaagacatgatctcattcttttttatggctgcatagtattcatatatatatatatatacacacatatatatacacacatatatatatacacaccacattttctttatctagtctaccattaatggacatttaggttgattccatgtctttactattgtgaatagtgctacaatgaacttacgtgtgcatatttctttatggtagagcatagatcattcttatcaacacacagcctgagatattttcccatggtaataaaatcaaaatcacactcctttgttctcacttcctgctttagatattgcccctgctctgcttctctgtatatcaaaacttactttaaaagtttgtcatactgtttctaactcatttcttttgattttttttctcaaatcatctgtagtcaggctttgcccctttctctgcaccaaaactattcttgataaggtttccaattgtctccatatggctaaacccaatactgcattctgattctgcttttagctaacctctccatagcatttgatctagctgatcactccctctttttttcaacactttctttacttagcttccaagatagtaaactcttctggtcctcctatttccatactggttgctttttagtttattgctggtgtctctccatctttctgatctctaacataatgtagtcatatgtcacttaacaacaggtgtaagttctgagaaatgcatcactcggtggttttgttttctgtgaacatcatagagtgcacttacacaaacctagatggtatagcctagtacacacctaggctatatggtgtagcctattgctcctaggctacacatgtgtacagcacgttactattctgaatactacaggcaattgcaacaaaatggtgtttgtgtatccaaaatatctaaacatagaaaaggtacaataaaaattctgtataaaagattactaatggaagatctacatagggaatttaccatgaatggagcttacaggactggaaattgctctgggtgagtcagtgagtggtaaatgaatataaaggcctaggacatgatgtacactattgtagattttataaacaccgtatactgaagctgtactaaatttataaaaaattatgtttacttctttagtaatgaataaatcttagcttactgtaattcttttgctttataaacttttaatttttttaactttttgactgtttgtagtaacacttagcttaaaacacaaacacattgtacaaaaatatttttattcctttggatctttgttctataagcttttctctattttaaaaactttttattcctttattttcgtctttttagatgaagacacaaacacacacattaggctaggcctacgcagggtcagggtcattcatgcccctgtctttcaccttcacatgtcttcccattggaaggtcttcagggtcaacagcagtcatggagctgtcctctcctgagataatattacttctttgggaataccccccgaaggacttgcctgaggctattttccagttaacttttctttttttaacaagtagaagtcatacactctaaaataatgacaaaaggtataatatagtgaatacatgaaccagtaatgcagtcgtttattatcattatcacgtattatatactctacataattgtatgtgctagattttatatgactggcagcacaatagttttgtttgcaacagcatcaccacaaacacatgagtaatacattgtgctatgatgttatgacagctacaacctcactaggccataggaatttttcagttcttgtataaccttatgggaccactgttgcgtacattgtctgtgattagctgaaatgtcattatgcaaagcatgactgtagctcaggactcagccttggacctcttctctaccaagatttatttgtggtgatctcctccagtatcatggctttaaatatgcttaagatactccgatttttatctccagctcagacctctccccgaaactacagtcattttttcaactgtgcactggaaagtctaatagatgcatcaaaggaaacctgtccaaaacccagcgccttatcttctttcctgaaactgctcctcctgtaaccttctctgagttggaggaaactcagtcctttcaattgcttagggcaaaactttggtaccatttttgactcttctgtttttttcacaccccatatctaatccatcagtaaatcctttggccgcaccttcaatttatacccagaattcaactgcttgtcaggatttgtcccaccaaggtaggaagttattgccataagcacaataagaagtgatagtgtatttatggcaataacctcatatgttgtctcttggcttctacctttggcccactacatcatacacagcagaacagacagggttaccctgtgaacatttacacgaggtcccagcatttcctcattcagaaccctccaatgacttcccacctcagtcaaaataagcatcaaagcccttccaatgccctaaagacatcatacaatctgtgtccccattttatctcccagcccacatcctgtaattctcatcctatttcattctgctcctgacacactgcctcgtgtcagcctcaggcctacctgcttactttctttttgcccacaatgctccttcccctcatattgcctcacagtgcaatatgcaacctcttttaggtctttgctcaactgtcactttctttgtgaggccgtccctgagctcccttttcaaaactacaatcctctcccagatacagtctctatcccccttccctgatttttctccataggactcactaccatgtcatacaccgtctgtttgtttatgtattattattaccccttgcctacttccctacactaaaatgtaagctccatgacacagggatttgtgtcagttttattatttgctccagcccaggtgcctggaacagagtgctggcacaggtgctggcacagagtgagtactctgaattatgtattgaatgaatgaatgaatgaatgacggaaatgtcctctccaatctctcctggccatttctgacagttcctaactgtaactctgcagaagtccctgggctgctttttcttctctgctgcctgatagtggatccatagattctcaggaaacccaggcctgtccactgcgatggctgccatgttctttcatatactcagcatgcagtaattgtaggcatagcatacttaccgtaatagctgcatttactgggtgttaagtctgccctaagtgctgcattaggctttatatatattttctgttttaatttgagcctcacaacccaggaacaaaagtagcaaggtttggtttcttgctcgtgtgatcctttcttatttctgattgtgacttcatgattaccatattatctagtagcttccagttaagccacagtggccttttcctcctgacttttttgaattctacccttctcgactgcactggccacctctctggagtgggcgattggaaacaataagaccagagataaagagtctagaaggatcatttggtcatattggttgatgctatgtttagggacatagccacaataattgtatgtatgtattaagcacatactaagagttagagactgtgctaagaactattatcttatattcaaatgctattcctatgtcagtgaaggaagtgaggcttaagaaggtaaaacaattggctgaagggcatacaactgagtagtaaatactggttttaggatttagaccctggtcattcaaactcagagcctttgatcataagcatcatggtcttaggtggaggtaactgtgggaggattaactggactggcatttttcaaatgcacactctgttccagtcactgtactaggtgctgaggatataacaaaaacagaggaaggacagattcttttctcattaagcctgcagtccagaccagctggaagatattcattatataatcataagtagagatatatacgttgatcacctacatttttaagtgttttaatagctataaatatgagtcattagaagccttggacatctaaagcctttggaagagtgcctgacaatccttcagtattgtagtctttatagcgtcccttcacagtagccattcaggcttgtgtagtgggtcctcttcagcctcatacctttaatttctattacatgattaacatttcattggtaactttgtatttttatgtatatgtgtttggtttgcttcaccatactatattatcagtctattgagtgcaaggatgttctatttatttccatattcccctaagattcttagttgttttatcttcaaatagaatgttctcagtatatgcttacaaattcatcctagttcgggaaacactttcttatatatactccttttgaatgggaagatgaaagtatcagtgggtaatttatcaaaaggcatgtagctgggggtggaatcagaacacccaaacatcagtgcttagaatataaagtatgtggtttagttccctgcatccttaagaaatatattcagatgtcagcagtagataaatgttaacagaataggtgtaactaagctctttgtataaagagctgtgttttagaaaattaggcaagcatattcattaggtactaaggattggtgactttcccatcagatctgcagtgaggatagggagcaacgcaaagcggtgattttaaaatttgcaattatctactttacacattcaacaggtgaaaatgcaggttccccagcatcagaaggtgctcagatctgtactggcatttctgaaactttgaatgcaaaacattcctttcaacttgagtttgaaagagtaggcagtgagaaatcacagggagactttctgcaggcagttggtactacctgttttgttttgttggttttttttttctccccatgggaaatttcatttattatacttacatttgccatgtaaagcgactttttcctggagcaacagaaaacctgcctgtgccatagctgacatttttggagagcaccatgatagaaggagactaatatctttattggttatctctccttccttaatcagtttaggtagatatatagaaataggtagtttttcaaaagaggctcagaccaaagatatttggtctgagcattaatttgacagcaagatattattctttagggctaggttgaacaattgtcccagttttcctaggacatagagatgttctgggactgccagagctctaaattaactagggaagtgatgggtatgtcagaaaaagctggtcatgctatttaggtagctcttctaagcttttaataacttcatcctacaaattaggagggaccacccacctagtaaagtactagaaattgctaaatatttagaattaacctgcctctgaggggcaatgtattctccaaaagttggcgatgaggtggaggttaccaaagattggggaactggtataagtgactctcagccaaagaatacatatttatctgttgctgactttttttctccccgtttctcttgggtaaatttccccttcaggcatcagagctgaaagaacagtgtcacagcaagtgtgctcagctcaccatggacctttatttcctgagtctcacagttattataggcacaatagccacctcatgccactgaatgcctaaagttttgtggagatgccctcagggacttggacttgggcttcacaatagatccccaaagaggctgcggccctttgtcccgacaaaggagcatctgttgaaggcattttgcttgaagtcattcaattcagtcctagaccactagcctggatcctttaaaaagccagctccattgttcaaggcatttcttgaaggaggagtacacacgttctctaacttccctcctctaacttccctcgtttagttaatgctgaaaatgtctggcctagggtctgtcactataagatgggtcacaataacaagagaaaccttatctctaacttaaatttgtatagctcttcctggctttctctgtacttgtcacaaaagttatttcttctaattcttatccagatatagggaaaacagcaatgattatacatcgtgctcattttataaatgataaaatgtgcttatttctccaagtccatatgagctgggttatgacaaaaattagttcaatgctggttgataaattgcattaccagaatggattattgaattgtgttttcttactatttgatattcaggtggtttcatagttgaagtcaataaaaaatagcgtttgagaaggcagatgtgtggcttgttgcaagtctctcagctccaagccctttaaagaacaatactgctttatagacgttttgtctggtctagttccatgctcctcaaaaagggatatgcggcagggggccacgaagacactggaaaatatgtccatggtgggtctaacataaaaatagtggcgttttctaataacagcagtatttttatgttaaatcaacgaagtacagctatgaaataaaatgaaagttcacataacatcataatgtagcatgggaaactcgaaaaacatttagccttataggggcctctctgcttgcccattctactttgttgtttggaggtgggtactacttcaggggatattttttggaggatactttaaaggaacagttgaagaatcattggttctagtctaattctgcctcttccacatgaatgccacattctatacctctcaaaagatttgctgaccttgactgagctcatagtatttatcttgtctgtaatagcaatattggctattcgaccaaaataaaagaattcagtgatgacttttcttctttatagcttaggctgaaatgagactacatgtaattttctgcaggtttcaaattagaacacactgcatagctagccttttgagtttccatgataaaaagaaaatgtatctaatgtttactgaatgctcactctatgccaaacacttagctaagcatttcatatacacttgttacaactgctataatttgcctttattattatctaaatttggaagatgagcaaatcataaccaacttgcccaagcttacacaggttgtcaatggcagaacccggatttcaaatctaggtagcctgagtttgagcccatgttccaaatcactctttgtgtggttcttcttgctgtaaaagtggtttttttaaaaaaaaaatatatatatatattttaagttctgggatacatgtgcggaatgtgcaggtttgttgtagagtatacatgtgccatggtggtttgtggcacccatcaacctgtcatctacattagatatttctcctaatgctatccctcccctagtcccccaccccccgacaggccctggtgtgtgatgttcctctccctgtgtccatgtgttctcattgttcaactcccacttatgagtgagaacatgtggtgtttggttttctgttcctgtgttagtttgctgagaatgaatttttccagcttcatccatgtccctgcaaaggacacgaactcatcctttttttatggctgcatagtattccatggtgtatatgtgtcatattttcttaatccagtctatcattgatggacatttgggttgattcgaagtctttgctattttgaacagtgctgcaataaacatatctgtgcatgtgttcttatagtagaatgatttataatcctttgggtatatacccaatagtgggattgctgggtcaaatggtatttctggttatagatccttgaggaatcaccacactgtcttccacaatggttaaattaatttacattcccaccaacagcgtaaaatcgttcctgtttctcaacatcctctccagcatctgttgtttactaactttttaataatcttcattctaactggcatgagatggtatctcattgggggtttgatttgcatttctctaatgactagtgatgatgagctttttttcatatgtttgttggccgcataaatgtcttcttttgagaagtgtctgttcagaccctttgcccactttatgatgggactgttttcttttttcttgtaaatttgtttaagttccttgtagattctggatatttgtcctttgtcagatggatagattgcaacagttcctatagagcagtgtttgaatgatgagccctattactctgatggacattttatgtgcatatacattcaccataaatcaactaagtaatagttatgttcattcattcaaaggttttagagccctaactatgtgccaggttgcaggggtacagatatgaggaagaaaagctctcttatagcagctcgtagtctagtggtacagatggacatataatcaaaatatgaaacaatcaaataatgtcaagataaaacagaatacagagcaggaatactttaccacatggacttagaatttatatggggaagcgagatgatgtagtaaccacaaaaaattgtccatcgaaaaagattgatgttggtagagcacaaggagcagagacaaagatgaaagtatgataagttccaagtgaatctttcaaactcattagataattttgcagggctctttggaaacatttaattgctaattcttattagtttctgaaatcaatttcattggccaacctcatcccatgcctccaagcaaaacttcaaattaatggtagcatttgtttctcattaatttatttggttttcttaatggccaatttgaaggcttattaatagttaatatgtttagcaatgtaaacatttgcattaataaaacagatgcaaaattactgccccagccaaccactgccatgctaaacagccaggagacataaacactagtagagttgaattgagcttatcctcagaggacgaataatgtccttccagattgtctgattttcacatgattgctgtctacacatctatttcaaaactcataagagatgttgcaacactaaatttgtgttagtttttttttcttaagatataattttaaaagtaaagtgtgttcttgtctaactgctcctctccttatttcaggaatagacatacaaccacaagtagtctatgactgtcttatgtttacctttggaccactgacatttttgtaaactgacaacaataagctaactaatatatgctgaatttaggcttttactcatcagtggaaaacaattttgatttatttatttatttatttatttatttatttatttatttatttagagacagagtcttgcgctgtcatccaggctggagtgcagtggcgcgatctcagctcactgcaaactctgcctcctgggttcaagcagttctcctgcctcagcctcctgagtagctgggactacaggcgtctgccagcatgcatggctaattttttgtattttagtagagatgatgtttcactctgttgcccagggtagtctcaaagtcctgagctcaggccatctgcccacctcaggtggccatccgcccacctcctaaagtgctaggattacaggcatgaaccactgtgcccagctggaaaacaattttcaagctatctcctaatggtgttgctattagccaacagtttattttagacaatataaccatcttagcctatagagaggcatttatatatatgtttgaatatttgaatatacttattttataagaatgagtggaaaatgggaggctaatacttatactaatgataaaaaagaaatacagtctaataaacattgataatcacagaaataattacattttacaaaaattgtaaaattttagctttaattgggtgcccacctgacttaggttggtatattaatcaggatatactaattgttgtaacaaacacaatctcaataaggctttttaattgctcatattacagtaaaatgtgagtcagtaagtatctctctttgttccatatagtgatttagagatccaggcatccttctcctagtggccctgcattactgggacctcacagtcctctagcaaatcccctgcctccagctgccagatgaagagtaaaacaccagttggaggaaggagagcatacagatttgaggagaaaggcctggaagtggcatacatcacatttgatcatattctttggacagattttactcacatggcagaagtgcctaggaagcagagcttggtcttatgctcaagagagaaaacacatgggatttgttgattataggacattgcctctggcacagtcagtcaaatatgtatttgattgtgaagaaacagataaaaagaatatttagaaatgtataaaatgccggaaatagatgggaaaaattatctttaaaaggagaatataaccagggatttgacagacttcggcaccttaggaatagccctgattctcctcccactgctccctggctcagttagctgtaggtttattatgagcttatgcaaatatgtacaaaagaacatttttagtaggactgtgaatgtctccccttttgcagaagttgggttccagagaatttaaagaagagatatgcattgtgaacattttccctgcaagacctagaatgtacctgacagcattcacctttctggtccaatatcctagattattctgtgtgactttcagatctcttgtaacattgaggaagggatctgagtcttttcacttagtctgtatactctgggatccatcagattagtagtcatgtcagagtaatgcccacagagaggcagaagtggattacagaagtatgacagaaaacattttatttgaggggtttctaagaactcagccaatggatgactttcaaatacataagtcaggaaccccagtgacttcctgtacgagtgtccccttttgtttgctaaatcccaacacacaaaataaacattccctaatgggaaacaaagtatcacattttctgagaggtttaaaacaatattaagctatgaatcatctgttgatctttttaacgcacttattgtctctagaattaaatgctgagggcaggggctgtaaccttcaaatcaaattttgtgtcacaaacacactaaacattaaagaactgccatttacagtaacagataggcataatctgctgtaaggcactgaaaaagaagaaactccactaatgctgacctcgaagtactgaggcaatcctcagtcttctcctgggcaatagattatgtgagttctagtctaataactgttcacacgctgagaatagaatatcaactcctggctgggcgtggtggttcatacttgtaatgccagcagtttgggaggctgaggcggaaggatcacttgaagtaaggagttcaagaccagcatgggcaacataccaagaccccgtctctacaaataacaaaaatttaggaaggcatggttatgcacacctgtagtctcagttgctcaggaggctaaggtgggaggactgcttgagcccaggaagccgaggctgcagtgagcctccagcctgggcaacacagcaagactgtatctcaaaaaatataaataaataaaacttactctgctggctgatttcatctttgatatgtaaaagagaacacgtgcagacctttttcatcagtttgtatcattatggagggttatcacttatgcttcagcattttgattagactaaacaaatcatgtaagaaagattacattctatcgacttaggtaaatgtaaatgaaaacaacaacagaaattattcttcttaagaaacttatttcagcagcacctaactctgggttatggtgataacttgaaatatatttctaagctgaaatcccggcatgagggacaaaaaattatatagagctaaaggaagtgaacctgtagtaaatatatatcagagtaatgacgaagaatgcagcttccgctcacaggtacttctaagtcctgcaatcagataagccttacagaggcttttaaaatcatggacaagactaataaagaatggccattctcaatggttttggaatactttgtgtaaccttgctgaaccttgaattctcattattgtttccctcatagagaaatgtttgatattctgtcttatgtgaagggcagaaaactgaaaaggagtctccaacaatgaagtcagttttcgctgctgaagaatgacctcactgcttcatgaggctgagagaagggaggaagggatcttcttgaagtcctccagaagttgcaccgagtggggttacataaagtatcctggagtctttattaactagattttcatccacaccatttcctaatttcatgccatgcaccctgagtgcaactttgtacaagaatggattttgagcaaggtgtgatagtctcacagggctcttccagtccagtgaaatgagtcaaaagtgagcttccttttaccctcaatagacaaaacctcctaccaccctctccccttccccttacggttcctagtcctgggatcccctgtctccccaccaacccagcttccttcccttttcaggcccaccatctgtgttcatctggcttcttttatcccatcaaaagcaattagtcttagctcctttactgtcagtgatctgcttggttgaccaaagctaatctgatggaggaatatgcagtgttactgttggagtacgtttgtctttgccatttatttcactaattcttattgcagacttactctgtgctattttcaacggggtatcaaaatgaataaggaataatttatttccagaatgcattttgtcctctagatctaaatatatgttctctctctgttaacatatttgtatttccaaggcccttaaggccagcagcagtggctcacgcctgctatcccagctactccagaggctgaagtgggataatcacttgagaccaggagttcaaaaccagcttgggcagcaaagcaaaactgtgtctctacaaaaaacatttaaaaattagccgggtaaggtggcatgagcctatagtcccagctacttgggagtctatgaggtgggaggatcacttgagctaaggggtttgaggctgcagtcaactatgattgtgccactgtactccagcctgggtgacagagcaagaccctgcctcaaaaataaataaattaaattaaattaaagacccttaatttcgtagagccttaaaccaaaggaacaaagagtatttcaaatttcagacagagctaatatttctgaaaattttatttagaaaagttcattactggtaggcaaacaggatttttgaaaaacacaaagcttgttttcaaaatcacctgttgattgaaatccactcaatgttttcattatttttagaagcttatttctgcctgctcatggtttagtggaaaggacactgaactaggagtcaaaacaggcaggctctggtctctgctgccaggtttgtggctgccaaagctcccagccattcattcattctaagacctcacatcttacaggaaaagcaggacaaagtggccttccatgttgcttctccagttaaaatgctaggattctaaacaattgtttgatgacactggtctctcaagtcaattggcatctccaatgatccattaccttcctccatttctaactcaatttcactgtattaatctgtttttatgctgctaataaaaacataccagagactgggtaatttacaaaggaaagaggtttaattgactcaaagttctgcaggtctggggaggcctcaggaaacttacaatcatagtggaaggggaagcaaatatgtccttttcacacagctggagaaaggagcagattgagtgcccagtgaagggggaagccccttatgaaaccatcagctctcgtgagaactaactcactatcatgagaacaggataggggaaactgcccccatgattcgattatctccacctagtccctcccataagacttggggattatgggaactacaattcaagatgagatttgggttgggacacagccaaaccatattagtcactttactttccctcaagacctttgttttattcctcagcagagtcattgattgtggccctagactcaatccctcctatcagtgactcttgaaatggtgataatggaaactccaccaaagccccttccaccttcctcttctgacatcctcaggagcagcagtgaccctgaactgcacttataggccacatttctttttttttactgctccttcttccaggcaaactttaaaaaaaataaatttaatcaagtgatataatgctgctaaaaactgcaatgtctctaaggtttttaaggataaatcatattgaaccctcagaatggctgacaactgagcccttccttaagctacattaacaacttaagcagaaaagaaatcacttcaactttccatacataattgtaacagacctagagagagagagagagagagagagagagagagagagaaagagagagaagcaattcatacaccattaccacactggtttaaaggtggaggggaagtcgggggagtaggaggctgtcattggtggcggagattttagaggccttataagactcattaaaagagggataaaggaaaagaaaatccaggattccaaattagccaacttttcatgcttaccctctgccttctccaagtcccatttgctgatttcaagcctgtcagaggcatcagttgaaggcttcaagcttgagataataatggatttaaaatggcaggctacgtggtctttctgcctggtgatgaaagcagaaacttctctcatgggctgaactcactgaggttgtgacttcatctgtccctgcaactgcaggaggccacagcctccattctgaacagtgattcctgtagagttgcaggattttataggtgaggaaacagaggtctagaaaagtaaagtaaattttccaagattatagaacttgttagagacagacccaggataagaattcagatctcttccgctccatctggttcctcctgtatcataatggttttctgtctcagagagcccacgggaaagactttctcctttatggaggacagtgaaatggggaccccaacaccggttatctttagaccattgttcaatggactttaccatttggtctttaaaattctcattccctaaattgtctaaagttttggaaagtaaatcactcctctgatattagttattctttggagcttcttcaatttgcataagaaaacacagataagttatgtgagaactgatcataatttcagtcatcatgatctcaacttcctacccccacattgacaagtgaagggcctgacatctaatcattgaaattctgagtggaaacccaggaaatgtttcatctatctgcattttactttcttcatgtctagagatagataatacttaagcaactttatggggatttttaaagccctttctactaacttccagatgggaaatagaatgttttataaaaacactcaaattcagtaggcactgtcagggtgaagctaatatgaaaataactacttgtaagaaaatgaacatggagctccaatagtggcagaaaataatgtgtacaatgtggataataaataataccattaaattcttgtatcattcctgctttctgtcaagataaaaaatgtgatatttattgcttggcccgtaattacttttatgcttgaaacaggaaggaatggagttgatgatacaggaaggtattagtcaagtgtctttttctatgggggtgggggacagggagggtttttatttaaaggcaaagcgagttcttctcatcagcatctcctttctaccaaccacctaagacagaaagggtttttgccatttcagctattagaagtgattgattctctgtcatacctttccgagctgtgtggttgtgaatataaaagaggaaagagggaaggagagagtgaccaatattaaggacaggcatgaagaacaagggatagattattagcttagagtaataatgatgaatttctcaaaacaacattttttgcctggttatatagattatttgctattaccccagaaactcagatcttgatttcaatcaggatttcaacctccatctgctcccattccaactctagtccatcttcttcaccttatatgctttgaagaaaatcttttgaaataatttcaccaagaagattagttcttttccagataacagctgcatgcactattttggaaagaactttgataccatcttcaaacatttgaatcctgaaacaactgaagcaaagctccagaggtagatacaaccagcagtctcacaaaaatcagcttctttacctacagcacaggctcaatgaaaatcaaaatctgtcctccatgagtttccaggctaaaaataaggtacttgcagcttcagcacctgagggcttaaatcacattttatattccataaatgtggccacattgtctcttttcccttttgttctttttcatttctgacagaaaccatttgaagttttatttcaaatcacctggctgtcggcataacaaaccttagatttagatttgcgattgtttaggggcgtgtgtgtgtttgtgtgtgcattcgtgtgagcgtttaattaaacggatgtgaaatgctgtctgagccgaaggcagtaatttttcttttattcatttaatgttgcgcagattatggcaagcttttcatttgtataatctgtcatataataccactgccttttaagcatgctggtctagtcaaagcattcatttagatgggaataaaagtttaattactttctttcacctttaaacatttgttacaaattaatgtggtgtctctaagacactgccttgaatgaacaagattcccattttagtccggggtctggttctaaggagctgtgtatgactctggataagtcactgtctgcaatagtcaggataggctaactgctaccaaaaaaaccttgcagttggattctatttcttattcaagtaagacttaaatttggatggtaagatgaggcacatattacctctgacataagtaagggaattttgtcgagcatcacttatgagtgctttggtaaaacaataggagagtaagctgaaagtgcagtattagaggattggctcctctgtcctagttgtatgcaagtcaaacacaatttagcagggagcttataaagcaattatatacaaggcagcccgtgcaacaccgagccatgggaaagaccgccagcatcttggcctcaaaaaccagaaccaggcatttgtgtgacatcaggattttcatcctctggctgctccctctgcaggacggattcatttcctctcactgtgggtcaacgttttccactacgttattatgtagagacatggtggtgatggcttgatttatgtatcatcaatctccatcttctgtgaaagaatggacttgactgtgggatcaccattccctgcatcatgcgaagagattggattctgatatggttgagtgtggttcaccaaagccatcaatactagccaagacacagggttgccctatagtcacataagggatgttggaggaggtatatgagtggaggggaaggtagcatcgttttattctttcccatctgaattaccatcttcctgacagaatgccaaaggtaaccagtgtgaaaattgtcggaatcaaaatgaagtcacttgtgtcaaactctgacaaaacaggttcagagaaggccatgaagtgagtgttctcatgcatgatttgcctggtaacagggacttccacaagaaattttcccaaaccatagctttctacaggagtcacacaagggctgccagccccacaaggctaggcagatgcttatgcagaacactcgcccaacaccccatctcacaaaccctcttccaaactgcaagggcctaaccttcactctaagatcacaggttctattgagcaattcctaatgtttgacaatcagaactctccagctcttgtgagacactgtgagcaccaataagtttgatttcaaaacagctttcataacctcctctttccccaataaaccctaactttttactttgttcccaggctggcagtggcacaaacatgtgtcactgcagccccaaactcctgagctcaagtgatcctcctgcctcagcctcctgtgtagctgggattgcatgcacacaccaccataccccgctaatttttttatgtttagtagagatgaagtctccctttgttccccaggctgctatcgaacttctgggctcaagtgatcctcctaccttggcctcacaaagtattggaattaaaagagtgagccaccaggtccggtccctggtctatatgtatatcctgggttacaatcctacattttatatattatttttgaatgaaatttgttacttagagattaatttctcttgattttttatgttgacatcagtaccctatggttgtgccctcaataggaagtatcctatactatcaccattatctttcttcctctcatatcaaatgtgtcttttctttgacctatttcctcatatctatgttctctgctaggttaatctgataaatgaatccctgctgaagggtttatgagtaattgtgatttaaggagttaatcttctcatgggtgcatttcacacaagtctccaatatctttaattgtagaggaatgttcagtgtttactgggcacttattatatgcaaaggcactgtattaggccattctgtcattgctataaagaaatacctgagactgggtaaattataaagaaaaaaggctttattcgctcatgaatctgcaggctgtacaggaagcatgctgttggcatctgctcagcttctggggaagcctcaggaaacttacaatcctggcagaaagccatgggggagcagacacataacatagccacagcaggagcaggagagatcatcaggggagatgtcacagacttttaaatgaccagatgtcaagaaaattcactcattatcatgaggacagcatcaaagagatggggttaaagcactcatgagaaatccacccccatgatccagtaacttcacaccaggccccacctccaacattggggattaccattcaacatgagatttgtgaggggacacagatccaaaccgtatcaggcactgtgctagatgacataggtaataccatgtcaattgaaaaatggctctgctggcatgggaatgaaacttgttgcttctggcattcaattgctaaaaagttcacctttaccacctgagaggtattatctttggacaagttagttacattttttagaatggtgggaataatagtaactacctcatagacttgtttgtgaaagttaaatgatatggagagatatgtacagtgcatattagtacagcaactggctcattgtaaagggccaatgcttcttatcttttaaatacttaagcacatatagattttctcttcttaagaggatggatttaatctatctttttaagccatatttctaaagtgaccttttgtgttactgcctgttagaaaaatcacttaccaccaaagacacatttcaccagcttgaaaaatttaacttagcactgtggaaacattttgttcatattcccttggtctttaatttgaaattttcatctgtagcctgtagtttgtttgtgaatggttttgggaatgttctttggacaattaaagctactaggacatctacaaaatctgtgtaccagtgtccctggctccccctcctcatctctctctctctctctgtctctctctctctcactccctacctccctccaccccccccccgtctcccttcctctcactaagttctatttcaagtggtactctcttccttacacactaattccaaaattatgattgttagctaatccattcaagtgtaatttgaggacaaatgcagacaacattttctgttaagtttgatcttttctgtaccaacatggctagaataaaaagaaaatcaataaggaaaatgaagacttcctacactgaagtgaatcttgggagacaatttctttttttctctctcgtgggttctgagctctgttttaaccatactaagagaagtatttcacggacgacttctgctctcagttccatgctattttttgattggtagcaaactatatcctgacaatagaccctcctactagtcctaagtaaatgctaacatttatggatcatcaattctatgtaatgccctctatatagttctcttgacaacacagtcacatttattattaacccctaagactcagaatgatgaaggaatttgcccaaagttgcacagccagtgagtataagagctgacatttggaactgggttagcttaaatctaaaggactttctctttctcttctaccatctttactattcaatattatattagcctaatattccagaaagaaaaaacaaacaaactgctaaataatttattaaataagaacaggggatagatctacataccttggttatctacttattttaataatttttggcttaaaatgaggattcttttcttgtttctggacattattaaagtgagacaaacaatagaactgtgaatgaccacatatacccctagaacatacgttttcttcaaagagaaagatcttatgaggtctgagttctcatatgtataagcaaacctattccttagaagtgcattggtagagaaccagggatctatcaacacaagtgtcccactgagtttgtgcatgccactttgtataaaaacagtgataaaattaatagcaccaatctcataagcttgtaagaaacaaatgagtgaatatatttgcagagtaattagaacagtacgttgttcctaataaatactcataaaatattaactatttcaattattagaaatgcaagaaaggtgtctttgtgttttctggttgaatttgcccttttggcagccacagatttaaagaatctatagtttttgaagctgcaataatttaatcttatttggatttcttccctgtcatccaaattagccaattcactatggtatttgagatttgaatataccccccaattttttttcaacaatctaattctaaactccaggcctccttttcatttgcctgttttgagaagtccaagtatttaggaacatctctttaaaattactaagagtaatttatttcctttttcaaacatttctttcaccatgtacatcttagagattaaatgaaaaaaactattacttttaacaaagatgtccttgaatacctcatctactcatttcatatataatggagataatttttgtgtgtaaactcaggcacaactaaagaaagcaaacatacttattgaggtttaaatattttacttcattttcatgcaaattaatttcttcaaattcttaaactttctcaggcttaggtattggttcaacccatgggagtgaagtgttgacacaagaatgcaaatattgtagaggtgcgtgccagcctggcgcatgtggctgcaaggctgtattccttttccttttgggctcacacagttggccaccttccggctgtcacctgcaatcctgggagtggtgctttccaccttacaacatttgctatttaatctaccaagggtaggtgagactgagattttacctggccagggaaacttacattccctctattgctgtactacccgccacccccggccctactcgcagatttactctgattttgaggcaaagactcaacaccaaaaaatgcatagacacaactttcatcttctgatggagtatttccagcagttttttttttaaaccaaggttacgtgcatacataaagagtctactagttctacaggtttgttaaacagcctgtccagattcccttcctgatattttctaagaaatgctgaggttaatgttggaactctaacagtgacgacttagggtccagatctggctctgacactgtctgctgtgtatgttgcctcaaggtcctcatcagcaaaatggggataataacacctccccatgagatcgttttgaagaaaaataaatgagtaaattatcaaaaaaatctgaaatgtatgatcatgtattactaaaattatttagctttaaaattatatttatttcattaaatattaaatatcttattaaattattataaaatgtattgttactttccagaggatccatttgatatttcctaccatatcactaacatgcttaaatagtgttttagtcaactttcagcgtcagggatttcgttttatcaaagaggaggcttttgctcattccccacttttgccccgccatatccactcacccacccatatgcaacgcttaataccaacccagctgcacaccacacaaacacttgcacttgcacatgcactcacttccacccctaatcctcctaatagagttgtatcataattttgattagaacaatactcactatttacattactatgactcttcactaatctttatttactttttcattctaaattgtatttgcttaattacctaagtacctcaccccaaattatttgccagttccctaaatctccttttgcaacattagttgtcaccaggaaggagtctattaatgtcatagtcttagctcaggctactataacaaattaccaaatactatatggtgtaaacaacgaacatgtacttctctaagttctcgtgtctgggaagtccaagatcaaagtgctggcagatgcagtgtctgatgagagctgtttctgttttagcagatggccttcttgtatcctcacatggtagaaagggagcaagaaagctctctggggtcccttttataaggacactaattccatttatgaggtttccaccttgcacaatttagtgacctctcaaaagctctacctcttaatcccatcacatttggggtagaatttcaatatatgaatcttggaactacatagattctcaatccaaaacagccttcttgaagatttatcttccagagccaattcttaacttgctgcagttattttgtgatctctcttcacctccatcctaatgattctctttacccctttcgtatgttggatgtctcattttccatatccccttgtattagggctgctgtcctagggctgctttaacagattatgataagcttggggactaacaataattgaaatgtatttattttcagctatggaaaccagcagtctcaaatggaggtgatagtatgctctccctcgaaggctcctgggataatcctcctttgcctcttccagcttttggtgactccagacatgctttggcttgctgttatataactctaacctctggctccctcttcatatggccttctctcctgtatctctgcgaaatccgcctctgccttcctctaataaggatgtgtgtcattggatttagggtagcccctaaatccaggatgacctcatctcaagattcttaattacatatgcaatgactgttttccaaataagatcgctttcacaggtctagggtggacatatctgttggagggccatgcagccaactatatctttagcttctattctcattttacttcttcagtttattatacttcagagaaagtagaacactttctccaatagttggagaaaaatttaccttgcacttttttaatgaaaaaaatgcaaggtaaattttctgaaacatcacatgtccaaaatgtccttattttacttataaatattattaacaatttgtcttgaaatagacttctaggttgtaaatcatacttcttgaacgttttgaaggcattatattcttgtctagcttaaactagtctaagcaattttcatgtcagaccctttttatgtgatcttttccctctctggagtcttgtaaattctttttgcctcagttcatcagtctttttagaatcatgtaagtacttttaatctaactgtactaggcttttcctgggtttctcaatctggaaaaccatgcttttcagttctgtgaaatttttttcaatttattgatgattttctctgttgttctgatctctctttctggagatcctattcttcgaatgttggattttctagtattgttctgcttttattatcttttctcacctgtttactattctttgatctttgtgcactactttctgagagatctcttaagttcattttctagctatttctgctaccatatgtttttaatatctaagagctctttctgttctctgaatgttccatttttgtagcattatgctctgggaaaaaataatattgatttaaattttattttgttttgacttttcttccccaccttaaacttatgtgaatgggctaggaaataggaatcaagaagccaaccttatgaccatgtaccttctggcaatgggactttttctttttgtttaaaactgcattctattttcaccatcctgctcaaaggtaatttatcaagaccatcctactcagtctgcccattcttagagtacagtagagctttgtctgagtctcatttagattcagggcagagagacatttgcttttggttggtcatacctcctctggccattattttccattttattatatctgttttgcctgaagggagaggcggaaactgtgataagccccaatccctacttcaggaggaactctatcattcttattattttcccattcagcattccttgatcagcttctgattttgtatgatttagtagaaaaatcaatgaactgtgaatcagacacatggaaactggtgaaattctgttattaataatctttgaggctggagtgcaagtaatttagctcctctaggtctcagttttcctcatctgtaagatataaggagttgtactaaactggaagtttctgagctcagctaggtactagttcttctatagaagtgcccaaacagattgctaccaagagcaaaaagaaattgagtggcttgctgcacctatcaaaccaccatggcacaagaatacctgtgtatcaaacctgcacatctctcccagaacttatagtaaaattttttaaaaaggaaaaaaaaaaaaagaaattgagtggctctcactcccttctctctccagtcacagaaggacacttttatctgtttctacctaagtgcctaaaacttttgttgtctgattgatatttttctggagaccaggctttcctgtccaagaaattgttttaaaatcatccggtcttagtggtttcaatgtttctgtctctaaattctgtgaattgatatgatacttttgtcttcttgcctttaagacttggagcatgaaggacctacatgatgactgctgatctatagcatttatgagtacactaacaatctctttcataacatgacatgtggtttcttctgtagttctcgaactggactgtgtatggtgctgcagagtcttggcaaacagcttaaattaataaagaaatatggaacagccaggaggtcccacactgaaggcttcaaaaagattattatggttctgacagcatagaaattgttcttaacttcttaaaaaccatagaatacctcagcaggcagatacttgcagattaataatcactttacagcactgttggagatcagttatccatcatcgcaatatggactatatcgccggagagaattttaggaggtttgaatgcagaatgcacggcaaatacagcactaaaagagttatttcttccatcttatgaaatgtattttagtctagcagataaattgtgttattagacatttttatgcactgtctggctgtgtactggcatcaacagcttttatccactccccaccccaattacaaaatacaggagagcaaatggcaactcttcttgagtaccaggagacctgttgtacacgtattatgagtgtttcatttggtatattttattatattccagtgtaatttccagaataaattaaggtgttaacaaataactagagttcaaagggcagaaaacattgtttcaatgacagaaagagaatatggttaaacatgcaaagcaacctcttttaaattcaaagaataattcaacagtggaatatgatctgtgaaattaatcaaaaataaaataatttttatttgaaaaacaactatatttttagatcataaatatcatataatttttatgataaaaaaagcatgcagaaaagaaaacaaagacactggtatgtttctatcctttcccagctgatatttatttattttgttttattttagttttagagacagggtcttgttctgtcacttgacagacagcattcgtgcagtcatagctcactgtaaccttgaattcctagtctcaagagattctcccaccgcagcctcctgagtagcgatatttattttatcgccttatttttcaagattatagatacagtttagatcacagtattttaaactttagtgagcatcagtatcacctgcaagacttactaaagccagatgaagagcatcccatggttactgattcagaaccctggccagcgtttagaaacaggtcttcaagagggtccagtttataacatgatccaactaatgccgtaatgtttactgaccagccatttgagtagtagggatagagttcagggatatagattcctgaacagctagacctgatatacaccttatagcctccaactgatttcacaaaatagaaagcagcttatttataccaactagtcaaatgaattcatattacttgctgtaacagattgtgtgatagcaaagaaacaaacaatcactgaagagatttgtttctcttttaatcaacaaagatggataatctagttatgctgctgtacaaagcaggaataacacttatggccctggaaaatttctccctggctcattttctttcatcgccatgttttactcatcgtaaagatagaatacgaaccacaaatctgcgagtcttatatctgttaattattgactaagagaaagctttatggcaaatggtgggtttcagctttaataaataatggggttgattctgcccaatgacagatgtgtgtaattctcattaaaatcagtggcagctacacaagtgaatcaaagcaaaatggtgtcttttacagaacgttctgattttgtaaattattcactatctctcaaacatatgagacatatgctattgttctctgtagggaacaagaaaaactcttttaggcagaatgtagtttcaaattttagacttagaatgtgcaactaagaaaagatataaaatgtttttacccacagcctttaaataaaactgagttaataatcgtttttgaagatgcttccagatacggtggaatgggaagtgttgaaaatgcttccaatgctgtggactgggagggttggtggatgaagatacctgcttatctctggattttgcaaatataaggttagtctagcagtctttgccaaactgtggcaacaatcaatagtatcacaaccagtgactaagaaatataaagggcacctcattatcgtaaaacacagatgcaactagaagggctcaaagtgttgaaaattaagcaatgagttaggaggctgttaaactgaactctggtctttgttctatcattgagatactcagtacctagaagtgcttcagttaacacatctataaaatcgagaaaatactatctgctcattttgcctccctgggatgctgtgattaacaataatgaaaaacttgaaataacgaaaagcactaaattaattagaagaataaacgttagaggaagtagaccgggcacggtggctcacgcctgtaatcccagcactttaggaggctgaggcgggtggattacctgaggtcaggagttcaagattagcctggccaacatggtgaaattccgtctttactagaaatacaaaaattagccaggtgtgctggtgtatgcctgcagtcccagctactggggaggctgaggcataaggatggtttgaattcatgaggcggaggttgcaatgagtttagattgtgccgctgcactccagtctgggtgacagagtgagactccacctcaaaaaaaaaaaaaaaaaaaaaaaaaattggaggaagcacactaatgcccactgtagcagctccttgacaaatacataaacctagactctctgattaacaggataatcgggatgagtctccttcaagatgttcaatctaatgcctgagatctttcctaagccacagatttatgcactaagaaagatgatggcaaagcatgtcatatgatcaattgttcccatcccaatcaaatgttcccttaattcttggtcagcaatacatctgcataggtttgggaagaaaaagaaagaagcactttaaaaggaaagaaacaaaatgatgttttgtgtttattcttggttggttcgttccaccactgttttgttttcccagaattattcctcattttttgcagactcttctttgattagctatgtttcttaaaatgctccaatagtctttaattgtctgtagttccaaatataaattttaactggaaattgttgattaaatacaatttaattgaaaaaccttcctactttaatgaacttatagcacttgagaagaatgtggaaacaacgtaactgggttttttcctccaatattaatgtgcttgtgtataccattaggataggataggatagatctgaggtaggactgtatgatgaggaaatagaatattcagtggattgagcacttgcattagtgtaggaaaatctgcaggtagaaaggagagagaaaatgcataaatgaaactagatctgaccgctgctttgtcatttctctagagatcttcttgtgaactggcattgaattgacattgactgctctctaatttgtgggaccttccaagcttattctaaaatgctgtaaaagtctcaccccatagacaccaagacttgattatttaaatgcaacgtttcaagctacattgaaaccacctgccacatcttgctgtttctaggcaggaggcatctataagactgttttattaaagcaagatactagggatcaaataagttcattgtgttctctgcatgccctaaatgtgaaaagaatatccaccataaatttgatgtcagagatttggttcaatatagagcaaatttgggaaggaggagttttgcaacataacttcaacaaaccacctttccccgcctcttcccccttcttctcttcactctttttcttcatcatcttttttagagttatggtccttgtggtatcatgattaaagtttcctgatacacacatcgatctcctactctctgtcaaccctttattaaaatgtttctcaaacattaatgtgagcacgaatcctctattcagtgtgtactgaatctgaaattgcaaattctgattcagtaagtttgaggtaggaagagaacctgcatgtaaactggctcctagatgatactggtgctgctggtccaggaagctctccgtagtcaactttaggaaaagtatagatttagattcctaccaactttctggctacatagttgtctcaaaaagatctgaaggcaaagattcatattttaacctgacctcagttttctacaattattattacacactacagaggttttgctgcataatgaagtatgattttgatagtaaacctagaggacttagagattgctaaaggcaaaataaaaccaaacacacagagggagatagaaataaatgttatatgctgagatctcaaaaacgtgagaggtaaatctttctgttgaattagaaagattgattctcagtagccggtggcttggagaggggaagcaataatttctggccttgattctactcactgctgccaggagacctttgctttgttgctattttatccacaatggatagatatttgtgttaagtccccacattgtttaaaatgcaaaagatggtgcttccctcactctcccccaggtgaagatcagatttgcctatcactgtcctagacaggactcacagaacatagaagcttcacctgggaatgaaatctctttcatctgaatttgctgggttgacaagtctaagacccgacaccactcatcaccctgatctgacctcatctgagcccattatctttaattttatatgcagcttctacagtaaatatgaagtggaatgttcctctttttacaaacatttattgtgagtagcataaacattttgacactgtattattttataagttttctgatgcatacaattagtgtagatataaatcaaaatgatggcagtccttctacggttttttgaagttcccaggagagctgttgggctctttaattgcttactaatgtaaaaatatcattgttagtaaagcataaatcatggcaattttgccccactagaggctaaaagcagcacaagatgtggtaattaagatatactaatagacctggcaatttctataataggagcttttaacaaggtaggaaaagaatgtcatctcttatgctgcagtgaggcaacaaataaaataggaagttttcctcttgcaaaagagatgaccctgcttaagaaacaatagccagaaagcaggtaagaaagtgtttttttctttcttattcacttgttttcctagtcacatggcagcttatgaatataaccttagggtgagaattagctttgtaaattttaaagatgagaaggatctttggaacctactttctttgttttcatgacggggaaactgagactaagacaaataaaatagctggttttaactaattgggagcagagctgggactagaaaccaggcacttgcttccccgtgaagggcgctttctgttttgttagctttgtatgtcaccaaagaccttcaaacgttttcaaatcttgaatattctttttcctattttgtagtccccctcctttttctgtgatgtttggtgtatctcctttgaagaatccttgaagttgggcatcattggtaacatttggattgcatagtaggaaattatttgttttggggtattagggacagcaaagaccccacctcttgtgagggataagaaaaagaatatgtctccagaccaatgctaaagcttacctatggcttctaaagtgaaacaagagtctgtgttaaaataaggagttgtgcttttcagacacgatgttcaggagctgtatgcaacaacaaaaacaatcaatttcttctttgacacaggtttaaacccaattagcattaattagaagtaaatacacacagaaggggggcccacattgcaaaggcaagcaacttcagttccatttaacacctcttcactcttatatggagccttccatcaaaggctttcaagatgttttcagacctagaatgttcttttcttattttactaagttttttcctcttttctctttatcttaccccatttattcattgatccattaagctagaacacctgcaatatgttgtatgtcatgctctctactaggtaatagggatagaagatgatcaaaacctctattttatcctccctgatggaatttgcagtctaatggaggagaaatacaggaatcaaacatgcaaacaaacacatatataattgcaaactgtggtatgatacataaaagtaaagttggttgcttaattttttatggggtgacctggacataatatgtgagctagggaagaattatcttaggagatagggagaagagcatgtgaaaagtgtgagtgattggcaaggtcagtatgtttattttatttttcaaaataaaaagtttttaaaaaatagatttctccagatactcccagagaatgcattatcatggcgtaagcccagagagcattgaagaaggcatttcaatagtgctggtgaaagagggtagtggccagaattttggtggtgacaatgaagacagaaaaatggagggagaggagatgtattttgtagatacaattgattggacttagctgaaacatttgatgtatgcaatatgggagaagggaaactcacgaatgcttaggaagtttacttgagtagctggtttgtttacaacgttgatgtgtattaatttaaggatggccagggaagattgggttagtggaaactgggatgtttggggtgtatctgaggtacataggtgatgattcctgtctggagcgcagaggagtggtcttctaggggtggtgtgacataaattggataataggatatgatgagacaaaaaatatgtgtccctaataccatgtcctggggaaatcagtgattagatgttaggggaaatatcaagggccacggatatagcatgaagaccaggaaagaaccgtcgtttacttcaaggggggaagtaatttcacaaatgagagggtggtgaaatatataaatatttctgagagtttgagtaggaaatttgcattcattagatttagcaacacaacatcttgattgccttgataagaaacttggggggtagtgggactggtgaacatttgagagaagacattaagtagacgattctcgagaaggaaacagggaaagatagtcacaactggagatagatgtagaattaaaatagttattttaagaaaaccagggtactctacaatattgataagagtggtcaacgaaggtgtgggagacatgatggagagataagatcactaaaggaacaaggttcttgagagaaaaagatgagatgtggagtgagtggccttaaatagaagcaggggtggtttcttcattgagacaggagaaagaagaaggatgtttttgcaggtaggtgtgagttttgttggttggaagatgaaatgatttgagtttcatgatttctccttgctgaagtgtgaaaggaactataagaaaaatagggaagtggatatggggcaagtttaataggaagaaaaaaaaagacataatactttgccataagaactgagcaactgagacttccccaacacgaaagctgtgttgccccgcagtgtgtgtgatttttctccagaaatgttcagctactcaggtgagactcattaacgaaggtacaaggtagagtatgtacacccaggatttggcttttgccagacatggatttctgtaaaagaagagaggagcatgacagttgatggtatttgcaaagttgttactatgatagccaatcatatgatagcgggcagtcagggttcacttaagaccataatgtgaaggggcatgttgagataaagttgaagacataggctcatttgctgcctatccagtggcaattgcagagcatgcagaagagggtgtgaaagaggaaaagaaaggatgcagatatacataaatgtgtcagattagaagataaaccaaaccatagggaatggccaaggaaagtatgacttccagcaaatggctgagatacacaaaaatcctgatgggtgtttggagaaaaggatgtgtacattttccagggagtgatagaaattccagaatggctgctcctcccagacttcagggctagcaccttacatttacatgagctcacaggaagattagaggattgactctggcaagtaacatgaccagagtcaaagaagtctgcaggacggttgttttgtaaactcatctttttttcaataaaaagcactagtccacaaaatacaagaaaaattaaaaaacccaaagaaacaattgaattctcttttctagattggcttatattcctggaaactcttcaaacagaaaagtgaaagttctgatattattataatcgtaatagtttatgttggcaatatttgcatggtgaatcattttcaatcctcaaaatgcccaggtttctgtgtccttaatgttatattggggttcatatatattattttatttgttttctatttgcctcaatgatttcagtgctcccatttcatttcatacctttttaaaattaatcattttataacttcgagttttctccctattaacttgttagtgaccgattaatttatgattttttgtggataccttagagatattaacatgggactttgatttattacaatcacattgaaattattactgtcagtaatggtagaatctgagaatactttactgcatttacccttttttgtcctctgatatgtgttatgtactttaattctaaatatactttaaaggccataaaacactaatttcccttgaaatataatcacatatttattctttctgtttctcatcattccatctggcattttcttgtttccttctgcttaaagaactgtttttagaatttccttcagtgcaggtttgttaatgacaaattctcttgctttctgtttttgttaaaatgggttattttgccttcacttttgatggctatttttgctgggtatagaattctaagttggaatttattttctttgattttcctcatttctgttgagaggtcaactattatttctcctttgagaaaaatgcctgttttctctgtttttaatatggttttcttggttttagattttagcagtttgattatgatatggtatggtttgtgatgtgtgtgtgtgtgtgtgtgtgtgtgtgtctgtgcctgtgtgcataggtgtgtgttggtgtttatcttgcctggagttcacttagattctcggatgtgagagttgatgtcattaatcagtttggaaagtcctcagccattatgtcttcaaagattgcttttgcctcattttctttctcctaatagtattccaattacctgtatattagatatttatactgtattccaacatcttttatgtactttccgatatttttcattttcaattaatgactgggcttttttattgacttccttcattttactaatcctgttttatgcaatgtctaattgtctgataagcttatatattatgttcttaatattagttattatgttttagagcttcagcattttcattggattctttttataaattccagttctatgatgaaattattcattctttgcatctgtttgctccagcttgcttttcttgtatgtatttgataaactcttcgtcttctaattaaaatacctggctcactgtggatctatttgtgtttgtgttgtttttattttaaaaattgcatgttagtaatattatcctgtatcttgtcacacctagtaatttttttattgaatttatttactatgtataaaaatttagattattgagcatccactgtcttccttcactcttttctctactaggaagataaagtgggagctcactaatttaacccaataagggactgagctgaatcaaggctggattatatttctctcattcacctttgtttctaggatggagtcctcaatggctttcaaccaagagcctactaagatcaactgggcccctcccctgatgggtctcacactttaatccttgtctccgtcaccaaaggactgtcagaaaactccattctgcttctcagaggctttgtaattagctttttatcctctcgtgtagcttcagaatctggcatgtgtgttgagaaaactggcagtatttggttttcatttccctcttttaagtgggatcctgacagttcaagtcttcgtttttgtctctgcagggccacaaaaatatttcttcttgtttctctatccccacccatagtctctgcccaagtgaaggttggattcttaagttcatttcatgcaccaagaattgtcaaatgccccaagagagaagtttctttagaatatcaccccagctttatgaagttcttcctttctctgaaatcttcaccccttagttctcactgcttcagcaaaaatctgatgtctttaagcaaattttggcaagtacttcctacttttctagttcatcttggcagaaaccatggtttgctatataggctactccatcttgcccgaaacagcagaaatttcaaacaatgtcattttacaaagtaaatcatcttaagggtgtttgtctttcaattgagtgagcttgagaagctgtaaaggctttgaattctggctgcattttttatttattttatttttttatttatgtattttttttttttagcaatttggagtgttgtgatgcattgttctgagacaatattattagcagctaagaatggtggctttgacatcagggaattctaaccctggctgtccgatgcaatcttggccaaagaattagatctctgtagacttcatttttaccatctatcaaatggggaagaaaaccctgctttctatgtttataaggaggattagatgatcaaatatttattgattacttactttagctatactaaatgccttacatatattatctaattttaatatgctatgtaccatagtacacactaaggattcagtaagggatagcagtgttattacttatcctgattacaaaccacaccctattttggcttcaggtaaaatcacgaatccccccatggttcatttctcatcccctgcccttttaactacagaatatcgacaaggtaaatacaggccaaagataattttttagcttataatattcatattcatatttttgtgctgcagttagcaatcaagagtatgtacatcaataaaaacaacaaaaataaagcttaattattaataaccatgagcatcgggacaatgtagaaatatgaaacatgttttcccatgtacttttaaaaatagcatagctagttttatatgtgggttgaatatagtcaaaacatcagaaaagttattcaggataaagccttaaaatgccaggttttactttttggtgaaaatgacatgttggactgctgcctgatgaatttaaacctagacagttgcacatttgtagttcacaagttggggagcctgtagctttgggtctcagtagctcctggggtagtatttgcacttcatttctggccctgtatatctgatttgatgacatctgttaaggagacagtggagggaagacatgcatatgaaatttcagtgaacacagcctgcatttcaatgatctgaggctgctgttaccttgtcatttattttgtagcctttggggctttgacaggcaatacccaatctgtttctcatcagtttaaatctcaatatttacttttagatgttttattttaaaatctttaaaaaatagaagattgtgcttgtccatatcatacagaatttgcttctttcacatgaaaaaaaacagatttgaatagaatataatcaaggagaaaagagccactttacatataatgaaaaaaattatgaccaggcatggtggttcacacctgtaaatcacagcactttgggaagttaaggcaggagggtccctcaagcccagaagttcaagaccagcctggacaacatgacaagacttcatcccttacagaaaattaaaaaaaaataattagccgggcctggtggtgcacatctgtagtcccacatattcaggaagctgaggcaggaggagctcttgagcccaggaatttgaggctgcagttaactatgatggcgccactgctctccagcctgggtaacagagtgagaccctgtatcaaaaaaaaaaaaaaaaaaaaatatatatatatatatatatatatatatatatatacacacacacatatatatacacacgtatgcatatatatatacacacatatacatatgtgtatatatgtatacacacatatacatatgtgtatatatgtatacacacatatacacatacatataaagaggaacaacataagtttttttaaaaaagcagaactattaacaaactatgaatgctagttttgcttgatatagttttctttccacaatggtttgcaattgccaacacctaaactggaggatctttttcttttttattctaaccatcccctaacaagtgatttttaaattttaggatgaatcccaagagaattgctattagtagtaggtgctgcttatgtaatcgacaagatcattaaggcagatattcttctaaatgaaagtctagatcttatataacatggatcttgatatctccctcatcaaggggtggtctatacacagtagcagcagcatcaccacggggagcttgatagaaatgcacaatcaaaaactccaacccagatataaggcagcagaatctgcattgtaacaagatctccaggtgatccctatgcacatgaagttttgagaagcttgccagactagaacagggattgacatatttttgctacagagggtcagatagtaaacattttaggttttataggctattcagtctatcttgcaattactcagctttattgtgcaaacagcaccagagacaatacaaaaaggaataagtgtggctgtgctataataaaacttcacttatggacattgacatttgaattttgtataatttttacctgtcacaaaatgttcttctttttttccccaattatttaaaaatgtaaaatccattcttaactcaaaggccacacaagaacaggtggtgggccagacctagtttgctgactcctaatcaagattctatcattttcttgaccttgacctttcttgggttgcccttggtgcttgtcttaggctgcttgggctgccataagaaaataccacagactcagtgactaaaatgatggatactggccaggcacagtggctcatggctgtaatcccagcactttggggggccaaggtgggtggatcacttgaggtcatgagtttgagaccagcctggccaacatggtgaatacctgtctctactaaaaatacaaaaattagccgtgcatggtggcaggagcctgtaatcccagttactcaggaggctgaggtaggagaatcacttgagcccaggaggcagaagttgcagtgagccgagatcatgccactgcactccagcctgggacacagagcgagactctgtctcaaaaaaacaaaaaataacatataataaaataaaataatgaatatatattttttctcagagttttagagaccagtaagtctcatattcaggtgccagcacagtctggttctgatttcttttcctggcttgaaaaggctggcttcttgctgtgtcctcacaggatatagaaagaaacctctgatgtctcttcctcttgtaataaggccaccagatttataggattagagacccactctcatgaccttatttaaccttaattacttactttacttatgtaaggaccttatctcctgttaccttgagaattagggctttaatatgtgaactggagggtgaggaggcacagcgcagtccatagcagtgcccacatcttctctctgacatcttctctgaccgtaccacccggaatcattttcctgtccatgatgtcccattgtcactgttaactgcctgtcatctttgctgcttaaatttggccttatacatttatgacagcacattctgttccttcaaagaaactgcaagctccctgaatgcagatggtgctgatcaaggatctagtgacaagttcaaatgactgcgttgagcttagaagttaatgattgactgatagcaatgacgcagcctgactttttctgctcttgagtctcccagtttgttaaatgattacaggatccttatgcatccttttgggctattttctcatctctaaaatgggggaaatgtggatgtgaagatacatccagcttctctacggagggatgaaaattacctattagcggcctgttttgaagagccagtcctctgtagtatcaggcacttagaagtggcagccttatcttcactatttcatctactttttggatgcaataagaccaactatttcatttcctgatcttctgatggagtgtcctttcttcccttccatatgctttctcccatcatatttctatttggcagccatcattaacatgaggtccttgcttaacaaagacctttcagtgcattttatttacctttaatgtttcaacattattcactatccatcttaaatatgaggtcactgtgagttgattccctagagagccattctattattcctcccttctgtatattttctagtgtttttcctagtccctttttaatgactacccacacagagcttccttcatttgctgtggaaatgtttgcactagtgactcatggtgcaaacagatggggactcgggtaaggtcctcataaatcattctcaaggattatctatgtcacaatcacaatttaaagctttaggagagactgaatgaattagggataaatcctatatatcatctcatatgctttgcaggccgttggctgaaatcagcacggattaacacctttcccagcctccattcttctatagtcttaatatttttagctaggaccagggtccctgattttattacagttttagacatacagtgctgttctggaaacgttattttcactagtttttttttttttgctcacaccaaggagaaatgcaggtgacaggacacaagtgttcttgatgtgttacaaacatttgccacaaactggttgcaccctatatttcctggttgaagtgagctcttgtcaaatgcctgcaaacaatgcacctcaagtcaggggagcaaggacgcgtgtaaaggattcatgaatggcaaatgaagactgaacagaaacactttgagcagagctgttgattagcatcctgaaagagtgatctcttagggaggaattcacctcttgatatttcattgactctggacttatcatgtgtggaatcaggcagtcctgtaggatttaatttggaataagtgaaaaagaaacaattagaaccattgtaatacttgttgcagggaatgccaaacaagcttcctttgttgtacaattattttggcgctaataagtatgtctttatgccctctagattggtgtcttggatatttctctccctaccttgtctttccgtgtaaaaactttagatgaatacaattttctattaaaaattaacttgtatcatttgaaattagcatacattaacatttctttaaaactagagctctgcaaagctttttcataatgtctctctcatgagtgtgaaatgatttttgatttttttttaatccagctgcaaggagagaggataacaacatttctgcatttctgagttgtgtgacttagcctttttgattcttaatttcctcagctgcaaaatggggataaaatatttactccctaaggtattgaaatccttaagcaatgtacacaaagcatttgaccaagtaattgacacgtggacatataagatggtcaatattttttctttgttattattttgaatatttgaagtatgcacattaaaattatagtagtatccactggttataaaatgccacagattccctcaaataactgcgtaacattgagaggaaggaaaaaatcatctcttagtgagagcatctttatttgaaatcttcgcacgttggtaattttatattagagattttgctcatcagtttctgtacagccaagtgcatggctttacacgttgctgctgaaatgataagcaacagccgtcttattcctaaagactctcagcacaattttattaaagatggagcaggtatctggcacagaattggagtatagtaaatcgtgcaacaaatggtatgccagaatcaatttactgcaggcccccaatacagtcgctttctccttaccagtttccagcataaatctctgtgcacaccttatatgaatgtatcacaagtagctgaatgcctttacgttgtctctctaagcagaagtttatgccataaaggtaatgtgaaaaatagagaataactatcaagtttcagtcttcctgaattgtattcagggaaggggggagaagagggaatcacaggatatcagtgttgggtcagtgcttggtgattgctgctgacttttcaccgatgaggaaactgtatcacagagtacggaagtggcatgttggagaacgctacctgagaatgaaagagtcagaatttaagcccatgtcggtcacctctgaggtccctttctcttttctgtataatatattgctgtcaaaatttctgagtggatattttttctaattagttgttgcttagggcacatatactttcttctcctggagcatgtgatagaaaacagactaaggtatcttcatctactatgtgccatttgctttggatgcagtttctcattatctgtgggcagtctctggtatcctgattacacggatagtgcagttaaaaattaaaaatgttaattctgtctctccagggcccacagttcgtaaatgagaagggggcttaaaacttgtctcagatccactgattcttggggtaaagttaatggataaatagaagttctaaatatgagaaactgtgaaatcctgccttccagctctgcatttgcatgcatgattaaaagacacagcacctcagaaacttgaatttgtacttcatattgtatataagtttgtattatagatatatattccaatggataacttggttctaagcctttttgttttggtaaattagaattaaagaaattataaactagaagaggaataatgcagtaaataaagaaaaaaatgttcaatccacctctgcagggacaagaatattgactatatctcaaaggttatgagttataaataagaacatgttaattatttctgtttccttggggtggatgttcatttctaccagcctttcctacgaaactatgcatcttcaaatatctttgattctcgacactatttaacattttttccaaatatgcacattttcaggaaagatactgggtgatatccttgcctgttgggtgggactctattttagattttctgattgttataatgataagatatactgggccactgaacatctagaattgatccttccatccattacacaggagtaaaggatattgtatcatgcctatagaaatagcagggttgcaaatagccaatccattgctggttccaatttggaagctgacaaatacttactttattgccctgccacatgcgaagtctatctttctgcctacacagcacaagtcagtaacctacataattcttccaggatattctaaaagccccgaggcgggagttcatactctgtatatttggcatttggaatctcatatggaagtgcattcagtgacatcgtgggagaatttccaaatataccaaaacatttattttgcagttcttcctatttgcattatttaatttgtgctgtcttgctaatatttgcctttgtcatatatttgtcatattatacatttgccatttaaaaatttgacgcagcagtacaaacgtatttaagctgccgtgctgctcagaagggcctattatatatcaggagtctgaagagtcaaatcaaatcacagaggatctacttttatactcttacttattttactgaggtttttcaacataaacaaccacagcaacatcttaaagtcatatatatctctttgattccaaagtgaaatactccattcataagacaatgaggagaaaaagagaattagaagccgaatgactatacaagtcactgttaaactaggacactctcgagagtaaaagggagctagtagtcatcacactgcatgtgttttatgcaaactgggactcagagttacccttgttaaagatgtgttatattgctgatctgaactgagttctcaaaaagaagcccaagcaaagtagtctatttgttgtgctaaatctaagcccctccctactcaaaaatccctgaaatacaatatatttatacatagataagtatacgtttacctatgaaaaaatatacagtaggaaaagcatgcgattgtgctcagagtttatgttcctgagttcagcatattttgtgttctccgtagttctggtgacagaattctctccttgttccagtctgctgagatgaccatgggtccatctcttcttggccttgtcactgccccatggtaacatcttctgaggtggtctcatgctcatctgaatcttaactagccagtccattcctcttgattgcagggtcctccattataaccaagagaaccctcttgtttcacccaggttgggtgtctcatttctgtcacttatggtcacttgaagaagatatttggctgcttcctgagccctgatggggtattcagcctactcagggaaacagtgttagatgcatctacccaaccatcctacacaggtgactctactgcacccttctctgccatggggaaatagagaactctttaggggtatgtatgccataaatgcttcaagtgggaagcagaataaaaacaccctctactctcaaccttataaacataaatggagcatttctgccagtaagatcccaccactcttttcagtcttagagatactaaccaggatctcactgacccttctttcccaccccttccagcttcccgttcaaagaggatgcgttggggaggggggctggtacgggtgattgctgggtagcctggatcatgtattctcttaatactctactctatatctgtatcatggtcttcccccaccaataaaagccaagactttgacagatgtattctctggttctacttttagcatcatggaggccttgagtctggcagtgtcaatgggagaaggtcacagcaaagtaaaaggatggggatgacagggaacatactggtaactagtgactggctagtacttcctgtccttctacccctctgagtttcttgagggagcaggaagcaagttcgttcagctttgaatgaaagctcgcagctcacaaaagactgaacaagctagggcctccttagactgatgttaaacacaagtaaagcacagtggctgtggggtctttccttagagtcatattggcttggttgggatccctggcccctgccagcttggggtgactgtattttataggtcaaaatctattggaagatagagcaaaatgaattaagtgatagtcagaagtgggatatctcaaaattatgaaaagtttatctgctcgggtgttaccacactctctcctcctgcttcccccctcaacttcttcctatgctctacctttgtgccgcccctccccccggccacctcagtgtaaaagccaccaacctcagcctgcttctccagctctcacaacttaaatcccacgcactgtctacagcaatccgacaattctggttttggaaagaccatcaatgtctgtcttgacatacagtgagcaccctattaatacctactgaatctctctcaacctttttgtatatttcaaaaaacatttgaaatgatcctagaaaagctcagaataaagcagtcctaattgtttttctttctaaagacacagctgaaagcctcaagagtttttacagagcacctattaatttcagggcaattagaagggaggggaaagatcagagaacgtatcaacttgctgtaagaggcaaacctgtgcaaattaagtttgtcgaaattatcagcaaacagttggtttctgtctgcccctaactggatttcagcagcattttattcagtttccacctcagtattttcatctaatgctctgtgcttttcaaataatattcatgtataattttatttttagaaaatcccatgagttaatgaagatgattcctatttccacaattttgatctcaaggaaactaagacagagagaaggtaatggaattgcccagtttacatggctacagaatagttaagatttcaacacagttcttctcccttggtctctgattcttctctaacacatttaatttttagaacaaaatatgtatttaaagaaaatattgaatcttcgctaaacggcacaaaagaagttatatatatatacacacatacaatatcagaggaatttagattatttaatcactttctaattgctagagcaatcaaaaaattgttgacatcataattaaagaaaactggtagaatctgcccttttctttaagtccacaccatctgagaattgagttaaagttgaaaaattccaagactcctattttgcctatcttgtggacacattacttgtcataggaggggtttacttgaaaattaaaattgtaaaaataataaaatgaaaattagaagaatggctgcccctcatgggcacatctgattctgtcagaatagcattgtttttttcaaagaaattctgaaacagctgtaatatttttgaaatacttgttagtgcatatcagttgtgctaaaaaaggtcgtttataaaaatctgcaaattttatggaaatatttcctttggttgtgagaaaacacatttccacatgtcaccatgttcacagagctggctgacagggttaagaaaagtgtgaatttattaatgtgatcatagcatcatccttctatattacctatgccatgccaaattcccataggaaaagtattagggtaatagttgtcttcctctttgttttacagctggatattttaattttctataattataatttggtgtgtaaattatttgcataatcctatactatgtcatacatttttaaaagacttattgacaagctaaaatttggaaatatcagctataatagaatacctttttaatgttcacgattcaatataaaatccttcatgtgaagcatatgatttataatctattagattttttaaaactatttaaggttgacctgtgaaaacccatataaacacaatttatgatataatagggtttagctggatggaatacagtaataaataaaaggtacacaaacaccgtttaaaatgcatatccatataaatggttaggttgtgttatgatattgtctttgtagattctggttgtatgtgctcaggacaaataaagcaatatctattgtctgataaaagaaaattattaaaccaaaggtatttgcctatgttacttcaatctgagtcactatgattaatgttatatgatatttttctttaaaaatctatttttatgtctataaatcctctctttccccactctggaaatagtgtctttctaccaagaaataaatattcagcattgctgttaatgaaaccatgattactgattattgttattttatcatctctactgtcactgctggtcatagatataattatttcttcatttcagtaaaatgtttgaagaataattttagcaatgtagtatatggggaatttaaagtgacagttgttacggatattgtgtatcattgatagttgtagcattgatattttaaataatcgtatttaaagttcaaattggtgatggattctattgattaaaggcagaaaagtgaaccttaaaaaagtttctaaaagagagctttggaatgaatccaaagatgatatattgcaaaatgcaaaatgggcaccaaatagttaaaaaaagactaagaaaatgaggctgtttgctaactcaagataagatgctaatcctttatagcctaataggaatctcatatcctcccctatgagtcttattctctgttgagctttagtatttggttcccccttgttattattattaatgtgagccaatcaggttgaactaattaatttctgtcaaatgaatcaaagtctggtgaacaggactaagatgttattttttctaatcatttcaaatttctccgagtcaaatatattaacacagtgcttgtaagtgtattagtataaaactgattgcactgaaggttgatgtataaaaagctttgaccaggaagagattaagcatttgcattcttaatatgtaaatcatagataaaagatggaatagtaaaatggctaaaactaaatcagagatagtcctgtaagaaaacttccaaagaaacagcagtttcttttgctgaattcaacaattaacctgttctttgccaaactgtacatttacatgagaagtaaaatattgtatctcctgtgttcccagcatgagccacaaaagtgaagccagtccaagaagtgtctcttttgtccatcaatgtgtccccagctaaaccttttcttttgctttctcaaatagatcaaaatctaccatttctagagtgattgaatcctcagagcatcttttggtatcaaaccgttttttctttttttctggtttccctctgctattagaaaatacaataataatttcaggccaggcacagtggcttatacctgtaatcccagctctttgggaggccgaggcaggtggatcacctgaggtcaggagttcaagaccagcctgaccaatatggtgaaaccccgtctctactaaaaatacaaaaattagccgtgcatggtggcaggcacctgtagtccaagctacttaggaggctgagacaggagaattacttgaacctggaagcggaggttgcagtgagctgagtttgagccactgcactccagcctgggtgacagagcaagactctgtctcaaaaaaaaaaaattattattattatttcatcctaatctacggggaccagtatttataaatgaccctcttcaattagagaagaaagatgtctgcttttctgttatgtctcattctgcttagggcagtatttcacctactaacagtttgtgctcagttgaggatctccttgttttagtgtagttatagatgtattgggtggagtagagaatcatctttatacattttatcattaatacaaacatacctaattctccacaaaagctgagaaggttcagagttccagtctaaagaaagaaaaataaattctttctatagatacatataatttcagattacacagcatgcctttatattaaacagatgttgaaccacacctataatattattttcaaattttatcactgagccacataaaagatatgaaaaaagctggagaagtttcagagaacagtaactcaattgattggggctgtaaagtaattccacacagcattgactttaaaagattggggatttatattcaggaagtgttcagatttagaaatgatatcattgaaaactttgaaagcattcctaaagaggagaaaaagttacttaatcccagaatactagtgcaggaaatttcttcttaaagtttgagaggagaaatattcaaacaaataagattctactctacacataagttataaaagagatgtaacaaggcagtgttctgatttacacaatttacagatgaaaaaaggctataagagggaagaagatgatgacagagttcacatgttgcttgagcagagatgcagcctagatttgcactgccaagcacagtagccactggccacgtgtgcctgaaatgcgactggcgtcactgactgaaatgcgggtcttcaattttatttcactttaattgattttaattttatttaagagttaagagtttaattattggaaagacgtttttgaagtaagtgtggaagaacttgaatatgtaaacctattttttcaactgtaaattttataaaatctagaaatagataaaatatttccaatgaaaattttgcatttgaattgaaatgtgttgtaaatgtaaaaatatagtaatacgaacaactaatttatttgtaatgtggtattactattttagctcattggtaaatgtttaatattgatagattttgaactgataatattttgataatttaggttaaaatattttcagttaaaataggttagtgaaaatattttcacttgtttccctttacttttttcatgtggcagctccaaaatttaaaagtacctctgtggctcgtattacatcttatatttccattggacagcactgatttgaccatgaattgatttaagtgattagaccaattaacaaagtgtttagacaagcctatcctaagcttacccacaaaactgagggaagattccctttatgagatgaatgtcagcccacagctcattgccttcttccatctcatccagaacctcatggctacataaacaaatgtcctacaacagctggttcactcctaatttcttctcctatctgcactgactgtcacatcctgcacccacttacccgaaggcatttactgcgatttaggatcttgtggccttatgtttctccaaattactttgaaggcagcaagatcttagatgctacacccccacggatgaaccgagttgcccctctcttgattaagtctagtcagcatgagctgggcacggtggctcacgtctgtaatccagcactttgggaggccaaggcatgtagatcaccggaggtccggagttcgagaccagcctggccaacatagtgaaaccctttctctactaaaaatacaaaaaatcagctggcgtggtggcagacacctagttatcccagctactctagaggctgaggcagaagaatcgcttgaacccaggaggcggaggttacggtgagctgagatagcaccactgcactccagcctgggcaatgagagcaaaattctgtcccccctgcatccccttcaaaaaaaaaaaaaaaagtctagttagcatgactgggcttctgacttagggccactccttggtccattcagcttagcttgtcttgtaactcaggaccctttgaagacataagcccttctctgaatgtgggctactgtccaaagtatatgcatcctgtcattcattggctagcactctcccagtggctggaactggccttgcttctctgcattccagctgcgggctcaggtctttatagacatcagtgcctgtaggatccgtggcagcctgcctgtctcctaggtagatttgcgatcttggattccccatgacactgcttgccttgcctaacttaactgatgctgaagacatttgggcttaataaacactgggttgccccttagagcttgatactttaatgctctattttcctggagaaagcctccttacccatcaccccactcaccatggtgcccttatttccactcattcctaactctgaccccatcttccttcttgagccatagagagtgaactgaggaaacctctaattaagtcagctaatatcatggagtgttaacaacaatatatttttgtgaaacatctttttgtgcccttatcgtagggaatgtactctattagaaatatcatcggtcttccctggaacactacttctgagcgtgaaagggtcttcccagaatctctgacggtgtcccacagagataatcacctattgtatgtttctgtatggtgaactcagctcctctcttaaatgatccctgagagagttatcattacagtgtcctgatttacaaacttacaggtgaaaaaaagctagaagagggaagagggcagtgaaggagttcacttttctcacatagctctagggtaaactataaaaaactaatttgtctctaagtttttcaaggtgaatacaacagaccaggtctttaacaagagtctagaaggatcaggagatcgaaactatcctgactaacatggtgaaaccccgtctctactgaaatatgacaaaattagctgggcatggtggtgcatgcctgtagtcccaactacttggaaggctgaggcaggggaatcgcttcaacctgggaggcagacatcgcagtgagctgagatggccccactgcactccagcctgggcgacagggcaagactctgtctcaaaaaaaaaaaaaaaaaagaaagaaagaaaaatctaggagaccttagagcctggtttgataaggggaattatgtagataaaagctctgggaaataatttgaaagaagagaataaatagtctctcatttagtattaatgcatgtacctcttcgacgtggaaaggaaagaaggtaccaaaagtgtgcagcaatggctttcaaactgggaaggggttgaggttgtactccccagggacagttggcaatttctacagatatttttgaatgaggacctggggggcagaggagtgctactggtgtctaataagtagagaagagagttgctgctaaacctcctacaatgcacaagacagcccccataataaacaatcatccagtcccaaatgtcaatagctccaaggctgggaattctcgcgttaaagttcaccgacattttaatctcacaacattttaatcccacatacaaatagactgaagctcacagatattaaacaatttatttaaagtattaggactaattagaaatgtgattggacgggaacacagagagtttcattttcaggactggctttctcgtgctaacatgctgtctttcccattattcacatgttcttctgaatttattaagaacagtttcatgaaacttttcaagtttgatgaagctgttgaaagggtgcggctgtgtttatatgatgtgtaaagcctgcctttcctgaaactgaataaataacacaaagacagctcccatttgacaatgctggccattaagcaggatacaagaagtctaagttattattcttactttacctgaaagaagctaatgatcttagtgaggagactgagctcagcattatgagaatgtgtgtaatagattaggggcttaggactcaccgatccaactataaaagggttgtgcaattttattatttgattagttcatcttagccttgtgtactttcctctaccattcctgtggccaagtcctccatctacatttcctccttagctgctgctttttatcaagggaattatttaatcttggtgccactaacaaatttggccattactttatggcttcctcctccacataatcacatgattacatcttattagaagggtaagatgttcagtatcctggacaactgcttttaacttctcgcccactgaagttctttctttgctggatttagctaatttttaggccataagaaaacatttttggctttaaattttaattaaatttgataatggatgttctattggattttaattttttcatggtgacatgcattcaaaatccattgtcatatttcttgaacacctactatgtgccagataaaaattatgagcgcttagtattcagtcatacataccataggcagaagccctgtcctgatggagcttacatcttagtgaaggatacagatggtgaactagtaaatatacagtagaacatcaaggtatgataaatgctggggggaaaaaagaaagcaatgtaaagggatagggattgacagtggttactgttttgaatgagatggtccacatctcattagatgtggtatctggaagagtgctaaggatgatgaacaaaaatatgaaaaaccctgaagcagaatgttttttattcattcaagaaatattaggaaggactgtgtggcctcagggtggagagaagaaatgaagatggcttataccaatagagagggagctaggagtagaaaatatagatccttgtgggcctgtgatcctgatcctgtgatccctaaagagaactgctcttgctcctctgagttgaaaaactataggtggaacaagatgggggcaggaaaaccagtgaagagtctattatagttctcctaggaagaaatgatagtagcttggaaagaagggatagtaatagacagtttgcttgttttgttttgttcttttcctaagaatgttcataatacaaacaccttacatttaccatttgcttttatatttggcaatgcaccattctaaaccatgagacacgacttcctgagtttccatcctggatccatcacttgttagcagtgtgatcttagatctataacctaatctctctgattcttttccttctctgtaaaacaaagttaatactggtacccacttcaaggactgtgtgagttgaaatctgtataaagctcttagaattattactggcttatgttaagcattatggttttttaaattattattatttgttcttcaaacaaacctataagtatttgttttccttctagaaagcaggtcagtattatttaaaataatatatgttatgtacatttacttatttactttataaatgaagaaacttaatcaacagctaatagatgagtcagaatgcaaaccaaggtcttttggctctaaaactaggtccctttcctccaaaactaggtccctttcctccatactacatgatggtcaggttgtcagatgctacccaaagctatttatgggcctgcactcctcagtctgctattaaatatctcaatcacattcaacagatgtccagcaaaagttctttgaggtttgtttcatttcgattaacagagaagtgctgcagcagggatcaggatggtgagaagtaacctaaaagccacaattccatcatgccatttttcccagtatttcaccttcacagtctataggtatcatctgttcctattgctttatttatttttggctttctcagagtaacttattacttccacaagatagtttggactttaaaagcatttttaatctattaaagaaatttttcttaagagttgcactcttctcttgacaatatagggtaatcatttaattattttttgataaaatcctctctctctgtatatatgtgtatatatatataatgtatgtgtgtatatatagtgtatatgcgtacacatgtgcatatatgtgtatgcatgtatatgtgtgtgtatatgtatatgtgtatagagagagagatacaaagttatagttgggaatgtattgaaagattcaggattgctgcttagacatggttttttttattgatatttgaggccagataatgctttcctgtgaggtgatgtcttgtgcattgtaggatgtttgacagcatccctggcctctaccctctactggataccagtaacacagattacctctcccccagttctcaaacaaccaaaaaatgtctccagacattaccaaatatcccctatggggaataaaaattgccttcagatgacaaccagtgggttagagacttggaaatgtgattggttttatttgtatgcatgagactgctgatttgtctccttaaaatgtgaactctgtgcctttttagaaaagtctgtgctgcttattatcaaatgggtatgttatcaactgagtataattttccatatgcctttcaaattttccaggcataagaatagaaatacaaatgtgattggctcattaccattcaaatgggaaatgagaagatcaaagctatatgaaataagtagcttgatcgaaaataagtggaaatattgccatatttagatctaaattttagtgacattgtaccctatcagtaaaaatgtttgaacatgaactcctcatctatgtatatttattggaaaacaaatactcagtctttcccagcaaacagaaaaggagagaatattccccaactcatcctatgaggctagtattgccacgataccaaatccagacaaatacagtaaataaaaactacagttcaatatctctcatggagttatctgcaaaaatattcagtcaagacaatgtgatattagcagaaggatagacatatagaacaatggaacagaataggaggctcagaaataaacccgcataaatatgctcaactaatttttgacaaaggctcaaagccaattcaatggagaaaagatggccttttcaacaaagggtgctagagagattgtgtatccatagccaaaaatataagaaataaaaaatgaacctccacgtatatcttataccttatacaaaaatgaacataaaaatagatcatagacggctgggtgtggtggctcacgcctgtaatctcaatactgtgggaggcccaggcgggtggatcacaaggtcaagagatcgagaccatcctggctaacacggtaaaaccctgtctctactaaaaatacaaaaaattatccgggtgcagtggcaggcgcctgtagtcccagctactcgggaggctgaggcaggagaatggcgtgaacccaggaggctgagcttgcagtgagccgagatagtgccactgcactccagcctgggcgacagagcgaaaccctgtctcaaaaaaaaaaaaaaaaaaaatcatacaggtaaaatgtaaaagaatacaaaaaaaaataggatattgtctccaagatcaagggctaagccaagagtcctcacactccaaaagaacaatgcataaaaggaaaaattgagtcactgggtaacatcaaaattaaaaactgttgctttgtaaaagaccctttgaagaagttgaaaagacaagctacagactaggagaaaatgttttcaaaccacatctctgaaaaagaactactatgtagattatataaggaattctcaaaactaaacaatagaaaaaaaatccagttagaaaatggaaaaaaaaaaaaaaaagaaaatgggcaaaataaattaagaggatacccagatggcaagtaaacacatgaaagattttcagcatttttagtcattggggaaatatgaatggaaaccacaatataatgtcactacacacctaacagaataaaaaatagcaatgactccaaatgcttgtgagggtaaggagaaactggatcacccctagattgctggtggcatgtaaaatggtacagccactctgaaaaacagtttgacaggttaaaaaaaaattcaaatatcatacagttcagcagttgtactcctgggcatttatttcagagaaatgaaaactcatgttcacaaaaataaatatataagtgtttatatcagttttatttctaacacacaaatctttaaataggctatgtgttgttcagcaggtaagcggttaagcaaattgtgatttgtgttgtggaatactactcagcaataaaaaggagaactctgaataagattggtgggccacaccaaagtcaatatttgtgtgtgatactttattatagttttgctaaatgttaccattaggaggaactgaacaaactgtacttgatcttctttatagtatttcttacaactgcatgtgaatctacagtcatttcaacaaaaatacgttaaataaaaatgaaaaagataagataaaggtgaaataaaccacgttatatagtattaatgataatggcttaatactgtcatatacatcaaagtgcattaaatacctgaaaaggtcattattgccttattagatatagattcatagttcaaatagtcttcttaataacctttattttttttcctggcttcacatcagatctgattatattgtcttttgagaagtaagttaccttgttaagaattcattctacaaagattggaaatgtctattcttctattttcctatttgcttagacctgcatattacaataattattttccacctgccatttatttgtaggaatctttttgaggcacttgttcattttaagagggatttttaacataaggtaatctgtgtctgtgtaaccaggcacacgtaagctaccagatactgcagcatgctgaaaacagtaaacaaaccagtaagagctccactggcttcccttggcatcttaggactctacactcatttcaggaagctttgcatgtggaccataagtgacacccaacctccgactttcaatagaggaagggtgccagaagcaatctgtgttgtaaacattaatagagttaagtgtctttcatatctgttctagatgaaattattattataaaaagaagtccaacattttcatcttgaacactaaaggatctttctcgatagctgcggtggtatttgccagttcagagaccactagtttaaagaataaagccatgtgtggatcaaaaagacttgatacactgcattgcaggtagaaaggaccaggcagtgagaaagccagcaaggtgctgcgtagaatttaggttaactgaatgctacaggccttctgtatcttgcttatgacccctaaacccagttactagctaattgagaaagtcctagaaatgaagacatcatcatatctaaacatccaagttgtaccaaatagcaactccttaggtccaatttatctctttcctttttattaagtaaacatttccttaaagtataacacacagatggaaaagtgcatatgtcataaataaacagctcaatgaaattactaaaaaggaaaacactggcataaacggtccccagatcaagatatagaatgttactagcacttgtcaggccctcttgttcccacttttctaattctgttccatggagaaccactatcctgacttctgataccataaattaatgcttatttgggggtttaattttaaagggattaggaaatacatagtgttctgggtctggttttatccatgccattgattatgcttgtagttcattcattctcattgctgcatattattcttttaaattattataccacaatttattttattgttgatggacattttttccttcacttttgactattatgaatagtgctgttaaatacattcttacattctcctctattcttattccagattgtggcattgttttcctgtaaactgtggtactaatttccctaaaaaatctttgataccttatattgaaaaaagaaaaagcaatcctcctagaaacaattagctttcttatctatacagtaatacaaataattcctgatcatctatagagtttgagtccaaaggctatgatagcatgaggctgagtaaatatgggatgttgaatgagccctctaggtctgagattccgtaagaaaaagccattgccatgtgctgggaggggtcagggtagagttcccaaggaaaggtggaacccagagtttggaccttgcaagttgcaatatgtatttacaaggaagagtagtggttcaaagcaagagaaatataaaaaggcatggaatgaaaatattattggcttgggttgaacggattagaataggataaagtgtaaattactccttgtgtcgtttcctctttgattctccaatttacaggaaggtagtcatagaataacactgaaatccttctgacttggtgtatcttagaaaataaaacaaaactgtgctagtctcagaaaaagggcagtgcagaaagtagatctgaatacatgtgaaatgagccggcatgatgaatatttgtctgttctcactttctcttctctgttctcgtgtgtatgtgcccacttgcaaagtgaacagtgatggtaattattaaaaccattctttgctcataaactgagaatgtttgaaaacagagccagagagacaaaaatgactggacccctatggtgcatttttgttttatttgcttttacgaaaatatctacctgcctctacatactgggttgaggctccttctcaccttacccttctctcaggcagattaatcacctgtctaagcatttgaggtcctgattaatttgtaaccctaaatgaaggccagagaatgctaaccatgtcctctgagttgaaacagttttcagtaggtggatgaaaacccatcttgctaattatagttttggataacagattaaaatatgtagaaaggtttcctccttagatgattagatctttctgaatgacaacttttctatttattagctctgcatgccttagaaaaaatgtgcttgtgtgggagagctccagaatgtagctgccagattgggagcagaccttgtattcacgtgtgcctttctgaagctcagtttacagctttcctaggtttatctgttctgtgcctgggttttgcttataaagtaaggtcttgcatgcctcaagaagtggactttgttaagtgcagtgcagttaagatctgcagtgcagtggggacttttttctttatataattttttaaaaagaagctgatgggagaaataagagccccagggaatggatgcttatgtgtagattttgctgatataggagaagaaaagataactgtgttttgaaaagacatgtgcaatagtttaatcatttccactagctttactagttaggatatctggataagttgcaatgagggacaggcaatgggatgggggaaagtaagagaggaacaggtaaagcaaagttaaaagaaatggaaggaatttggttatgtttgcctctttgtgttgaatctttttgctctaaatcagggtttttgcaggtttataaagtggagcccaggagggatccacctcagctgttatcaggccatgactatgtaatgtggaactgaggatggaaataataggatggctgacatctggctaattgccattgcaattgaaagctgcctgacagttgtgtgaaaattgcttggagatgaagaactttcaatgaaccatgatggacagaagtatctgagcaaagaaatagtgggcaatgaaaaagatggactggaggacagggaggaaactgcctgtcatattctctcctctcttgtcttctcctcccattgtatctcaagagtaaaagcttactcagttaatggcaagttattttcaaagagaaaacagaaagcagaggtttgcaagtctggagttacattaatttcccttaattttgccttcacccaaagcctactgaagcaccagtcatccaagggtctcttcctaaaccagtgcttccaagctgctcagttcccaagccctcaaaacatgagcccccagtgctgccctccacagtgacaactccgtcgtcctcctccaagcacctagtgctgagaagtgacttctgaattgtcaagacatttcctatgaatggtcaagacatttcctatgaatggtcactcccagaacaggcttgccgaaccctgtagcataagtggttactgctataatcagtaaatccaagttaacttacctaatcaacattgtctccttcatctcttcccatcctctcaacagaggcttctcaggtaatacatacacattttaattttggctgtgtggaaaccattgttgatcattaaatagagtaatattaatggtagggtttcccggagatgtccaagattgtggataatggtcctaaagaagaaatttgcggggaggccttgctttatgaaacccttcacaccacccctgacttgtgaggagggaatagctgcctactgcctgatccagttctttttatgtccctataaatacagtcgttcagattgagttttaaatactttttgttatattatgacaaggttttttttaagaatttaggcaatgattttttttttaatttagaatttcctaatagtgttaagggccagagaatcaaagtattctttccattttataacattggttaaaagtgccttacaataatagtttgtgttttgctgctttagttagtgttctcatgcatgagttacactgctgtggtcaaaacctgtaaacaaattctttggacttacaaacagttttggaaattgccatatactgtcctgacaagtaattttactttctgtttaattatgcaaacttaaggggactattgaagaaaaatagtgtatttttcaggccaaaaatatacatggtggtatatttaaagccaaaaattctgttgagagaattcattttgtctaggaaacattcgtattctttttctcgctttgcatgtgtacattcagactatgatgctcaggatttgaaaaaaaatgcatacttgaattgtgaatttttttttgagatttaactaagttaatttttgtaattagaggaaattaataaaatattttggaagaaacttaaatttatatgtcaacctctgggtcaaatagattcatttgaggttcacatttaaactcccatcatgttcactgaataattttaaggctgttttagtcatcttgggctgccataacaaaacaccatggactgtttgctttaaacgacaaaaatttattgtctcagttccggaggctgggaagtccaagatcaaggtctggtagggttcagttttcagtgagggctttgtttctggcttgcagatggccaccttcttactgtgtgcctacatggccccatcaccaaatgccatcactttgggagttagaggttcaatatattcgtggcagggtggggcaggggatatcaacattcagtctataacaaaggccttaggactctgctgataaactctgtatttgtcttcagtttgggggaggtatacaggaatctgggttacactagtttgaggaagttatcgtaattttaaaactaaactggaaaaggtgaatggttttctccataggttgtttattaataaacagcagctttctcttctatgttgactaaaggtgacataaaacttcatattgattagtagctgagtttctatccctcatcctactactgcctctccagccaaagcaaattgcagagttaagatggcactcaataaatatttgttggaaggattaatgaataaatgaataatttaggcaaaatctatcaagcctaaaaaaataatcctcaatcttattcagtaaacattgtctgcaagctgactttgaaaaagagcaatggaatagaaatgcccaaattttaagaaggtgatgacttagttgaaaaactgagagatagaataaaattactaaataatcataaggcaataatagattaagacatagttttgggttactcatggataattacatggtccagggataattatctacagatacatccatggcagtatctacctgtacatggttttaccatttctatggcataatttttatttggttcaagataaaatcaaataaatttttacaggcattttgtctagatctagattccatggaaattatggacattcccatcgttagacacaataaccaagctgagagatgcctcctcttgttctcttccaggtgtagtatcttagtgctgtccaaggactacaccaaattctcaatgagaccccctgatccagaactaacaacactctcccgaaaatctctccttttttctttctctaatttcagagtgccagataaaatataggatacccagttaaattttagaaaacaagtactgcatattgcgttatttacttatatcaaaagtatcctatttttatttgccgaattggcaacctttctctaagcctgtcccaagtgccactttatcattgcattgtaattttaaccacccttcaaaacacagtctatttgaaagaaaggattgcagtcatgtataaatgtctcatagctagattaatgtatagtcattaaactaagtatgtttgtatatttatccagaggatcagtcttctggaggttaattttgaatataaatattttatagtaccccacctcaagagagaattgatactttcttctcaagtttgaatggtcaagaagaggttgggtgtgacaatcattgcagatctgtaagagtggtaattctagcaccacagtttgagaacgggacccagctatagaaagcatgtgatagtcatggccacagactaaaattattctggtaatattggtatgaagtgattgtctgttctgatgtgcagaaacatttatctttttatttacttactgtcctctgaaatgtggatgaagaacactgggttaggagtaaggaaacctagatcttattcccagatctgccattgttttttaggtggtctcaagtgtactgggccttagtttctcacttgcagattctacatgattgcatctcaactttatataagaagcagctgaggtgtctaggggaacatggagatttctgggtttcccatcagacattttgattctggcaccctaggagtgggccaggatgatgaatatttttaacaagcacacaagttgatcaaatgcaagtagttctgtaccatgttgtcaaacttagagtagatgacctctcagtccctttctatttagttttacaaatgtggacatctgtgattcaaagaaataaacaaacttgtttatgtagaagtgtgttttcactttttagaaacaaattgtttattttagaaaaatcaaaaaatatagaaacataaaaaagcatccattagaagtttaaatgtcttataacaatcccacaaaatgcacaaaagctaatttcaaaagctgcattaactctacattgtgaatgcctctggttacttgtttattgggcaacttaatctaaaaaggttctttcatgaattttcatcaattttgcaacaaagccctgttgcaaattgtgaattatgcattaacatatgttcatgctaatttatacactggtgacaggtttttggcatgggatcaataacttacaattacaatttttaaagtttgtttattaataccagcagggacttgggattatcatttagttaacaatgtgtaatttgaacccaattttttaaaaagagcaagttctgccgttgtcttaagtcagtatatttgtccaaggaacaacaaatgaatctgaaactaacaagataaatgcttcctgctcttctcaattaataatttttatagttccgtaagattgtctgatgttggtgtcttgtcatcagacgtaaatgtggggtgttgttacaccaagtttctctaatatctaaataattataggcaagcctatttaggtcacaatacttaaagataaaaattataatttcaactagctgcttctgaaaatttaatgtgatgcttcatttctttatgcatattctttaaagttaagacaaaaaattcctaaaaagaaatcagaataatcttaagaagcttcaatagtatgtttctctctctccagcatgcttttatttaaacacattggtttgtaaataaaccttcttttgaaaagccctggtatacaaaaaatattctaacaaaacaagtaaattagaggttgattatttgcaatgcttcaaacattttctgctttaaaagtataactgcatttcccttgaagaagctcctgcttattacactgaaatgggatttgtctcaaataattttatgccaactttttggaagcacattgttatgtaagtggaagctcagcttttctatacacagcagcaagtatttgatcaatcactattactaatttgtagagcggttttagctaccacatctgacaattatatttcaatatttattttataaaaatgaagttactaagaataaatcaattatatgctcactttatccctctggtgatgaacagtggagccaaagggagtgcatgagctttgagtatgcctgctgttcatccttattaacaactttgcaggtgcgccttgctggtggtgggagaggtaggaaagaaaagagcatatttttctaattagcagttctatatcagatagcatataatagaaggccaagggtaattattcctatgcccacaataggaatttttaggtttttagatttttttttatttttggtcatagaaggaatacaattttgaatagcagagagctgattttaaatcttggttctctccattgttaatagtgtcaaggtatgtatcttctctgagattttgcttcttatctttaaaataaacatgataatgctctgtttagtgggttcttgtaagaataaagttaaattatcctcatatatatatccttaccattctctcgtatttaggaggcaattaatcaacatttaagtgcacatttccatccactctgaaataatgaagctgtctctgtggtcctgatttgaaaccaaagctttctatgtcccctatagccactaggatgtctagtctatatgatatcattctgtatctgttggtaggttgctttacgtttgttagtaaacctatatggtcatccaaactagcctggtagaacctttagcccctttcatgcccatcttccaccctctgcaccacaacttccctactcctacccatctgtagcaatctgtcacaagcattgtcaaactgtggcctgtgggccaaatccagccactcacatgcttttgtaaataaagatttatctagatatagtcatccccattcatttacacaaagtggatggctgcttttgaactgcaatggttgggatgagtagttgtaagaaatctgaccgcataaagcctaaattattcactatttaaccatttgcagaaaatgtctgtagactctggtcaattacctaatagaatataactagggtttttaaatatggttgattaaaaattaagtacttgttgacaaatagatgctgattaagtggagaacagaaaaatgtgatagttattgtcatagacagatcttaactctcctactaagaatgatgacaataaggacagaaagacaaagtaatttaagagaaataacggaaagatggaagccaaagatgatgaatcctccattaactgctattgcaccttatttgagttatgttatctttgttagcctcagttttcttatctgccaaatgaaaataataatttctgctcaacctaacaccctaaggtccaaatgcacattgcactaactaatgatattcttacattatgtaacctttattttctttatataataatgactcctaacttaaatttagaattcaagatgcattcattcttcttttctaaaagtttcataagaagtggtggttgtccttgtaggaaaagctaggtgtgagttgagcaaagacaaagaagtatctttagacagtgtttgaggatttagtaaaccttatctgacagggaacaaaatttctggcaggcccagtggagagaaagaagggagagtgtgtgtcagataaaagaaagcagagcttggagaaagaggaactaaggggaggagacagatggccaatggccttgcaatgagaatattgagtatggtgaattattagctgttcagtgttcccaacaaaatcagtgacagcagcccctgatatataggcaatcaaaggcaaggtcttcagacactgcaaggggctagaaaacctggtagttggtaaacaacaattcagaacatttgatctttaagaggtttctgagggccacgaaatgggcactgatctagaatgcagaaaccaatagatttaaggccagccttttctatctcatgtcatcatgggtaagtctcagtttcttcatttgtagatttagaatatcttccttaggtacttcatgagacttcaaagaattcaatgaggtaatttgtgtgaacatgttttgaaaactcaattataggcccgtattattattttattgagtacaatagctgaataactacagaaggacatgggcttttaatgtatttctagaaaagttgatagattttctgcctgcacagacacagttacacacacacatggtcagacttatttcatagatccatctattttggtgatctggaagtaggaatatagtaaaatgctctctctgtattaatctcatgggtaattattttcctctcatcaggttacaggtatccccagaaatcttcagaatacaatctacaggtggtgtttaaatatccaaagtcacacgccaatgctttcttatccagtgagcaaaaagaaagctcaatgggaaccttttggtaaaactgatgcacagggatgacattattcttacaggtgtgtaacctaaagcttttactgggttccatctatctggattaacaaagagccacattacaaatgattctgttccctcggtgataaaagaaaaaattactgagaggggatatcatgtcataagactagaatactaggtttagagcaatttgttcttctttttttcaattatgcagtaatggtatccacatactgtattcagtctacaggcaatgtgattagaaagaaacaaacatagccttttttgaaacaaagagatgttatgcattaatacatgaagtggtggttcttttgctataataaatgcatagctggtgattccaccaatgagcaatttgttggaaatgttttattggttatgatttatggatgacaagtttgagtaattgttaagcttaattgcacttaaatgatggattttttcctcagttgtttatcttcagggcatggatgaaagcaaatgtgttggaaaaatgcagagttcagtggttgctaaatgagcttattaatgtttacatatgtaacaatttaggccattagtatgtatatgttggaatgagatgaccatctcatctctcagtctgcagaaattcctgcacaaactatcactattttatttttggataaacacacagctgttctatttcaattacaaattcaagttgtcctgagattaattttgttctatttgtggctggtaaaagtattttcaagaagaaaatgaaattactatacctatttggcatgtacgagggcattaggtcaagagcatctagcctctgacaactctggggagggagagcaactggtcagatccccaaagacttggccttatttccacagaatgattttctaggcagcccattttacttgtaatacagagggtcagcaaggcaaatttgcctgcctttccaaagccagaatgaaacactgactttctaagctctaaaatattcttgttgccctttattacagctaaatatgatatagaatcttgttatggactttatgtctgagggcacacatggtttaaaattctcaggtatgaatacttgtataatagatggagcatgagttaggttgacctcttgcaaaacaaaacaaaacaaaaacaactttctttcctctcattttcccagtatctcattagcttttcaataaatacttgttgcatgagttataacattcttcaaaaataaggctgatacatatgtgcatatatatattccaagatatatttcgaatataatgtgccagatgctttttgttgctaggaacagaaattcactcagttgaactaagaaatgagagatttattataaagatacatatgaaaataaggaagtaaggaattttgaccatatttctgagttttatacaagagtctagaaaaatctgcactactaggtttccaagaagagcaggtacactgttactgccaggttctcaaagactggagcctggattaaaagctggacctcaggaactgggcagacagcattttaagatccatcagccctggtgacctgattatcacattacccctcaagagcagggctgatcctcaccctaaggtttcatcatcagggagatagcacaactctccacacttctgcttgtctgctcctactgtcactgacttctatgacagggctctcctgtcttgtggtttctgctttctcacagtttttagtgcttcatggactctgcttactgcattaagtctacagatgctcaactttatgtttctgcacaaatttcctgggataaaaatacgactggtttagttagtcaccaatattccagttaggccaccagttatcatatagatttgctacacttgagttacatgcccaatacttatcaactggctgtcaccaagttgatacaaatgacaaactgtatgaccccctagtgccaatctatagacaagaggctggggactttctaagtctcaaccttttgctacaatgtggtttctcaactgactgtgacaattagacgtaggccaatattccagtactcatctttgtacctagttttctaagagaaaagaagacatggtttcctaaatgttattgctatgcaatagcaaaaattaagtatctacaaaaattaattggtcatcgtgatagaactggtctgtcatattaaagaaagagcaatcccattcctattgctccgacattttaagcagctgtgttttttggtttgtttgtttttgtttttgtttttgaaacggagtctcgctctgtcacccaggctggagtgcagtggcacgatctcagctcactgcaagctccgcctcccgggttcacgccattctcctgcctcagcctcccgagtagctgggactacaggcgcctgccaccacgcccagctaattttttgcatttttagtagagacagggtttccccgtgttagccaggatggtctcgatctcctgacctcgtgatccacccgcctcggcctcccaaagtgctgggattacaggcgtgagccaccgggcccgtgaagcagctgtttactgcagtaacacgctgttatttcctcaagttcttccaggtttcttcaaagtccatttccttttcctcagagtttcagactctgtccaattattacactcactcatgccaaggacttgcagatataagaattatccttgatcatataagtcctgcccttgaagatgcatccgcctcgagctgtcttcttatccaccttcttatctctcttcttctgtggatatgaagatgataatgtctgctccaggaacagttcttatgatgtgattcagaggaagaaatgcatctacttcctttaacccatttacatttctggaaaaaagtaccatggttaagtcttctctccaatgaaatagaaaattttagcaaagtctataaaacaaaaatctctactagaaagcttatagtcaagtcaaaaaccctcaaaattttgaatgcaattaaacgttaatatattttagtgaaactatatgatgtatagtatatatgacataatgaaatgtaaaaataatatagtatgtgttcaagcacttgtagtttataaatattttcatgtgaattgctatgtttcattcttgcaccaactctattaagtggacaagaataatctctcttcaaggaatggtacatgttttacacacacacgcacacacacaaacacacacgagctgaggcattttttggatgtggagctgtatgaggctgacagcagttaagtgatttgttcaagttcattacaagaaaaacagtaagttggagggaaaaaaacatgagcttttgagtgggtctgtctgtgggtttaaaccctacttttacactttcaagttgcaatgactttgtgatagttactaaacatttcttaggaagtctcagttttctgagatgcaaaatgagaattgttgcagagccataaagaaaacagagaatgcacataaaacatacttagtaaatggtacataggaggtgcttggtaggtaaaactggaacttttgtctttttcttcagtgttcttcctactccactgtacttcaagaattaaaaatatcattttttcagggaaaatgaatgaaattaccaaaaactgaagaagatatgtcttcattatctttatcccaaagcatttacttggcatccaaaaacatattcagaacactgtgctaggtaatggaaaagtcctaagacacccagagagagattgtttccttactctcacagtggatgaaaaatactgagaggcaaatgagagaagatgcctatgtcagcttcctgcagcatcagtctaaattattttaacaggctttagtgacctcaaaatagcaagaaagccttaaatgtaaaagacctagataggtgatggaagatagagacaaacactgaaatttcagcaagagatattatagataaataaggacaacttggcctctaaacatcttctatttactgcacagttcctgttaatttcagtatctttggggtacccttctaagcattcacacatctactctgaagcaggcattgcttataaacagccttctgtctgctgagctgtttcatggggaattccttatcaccagggctgcatttgaactgatgagtcaagcaagctacctggtgtattatcagttccttcaaacttgctctgagatgtgtgacatgtatagaaaataaaaacctaagactttgatctacaaggatgcagcatttgcttggctccagtaagaaaaagaatcctctagaaatccttaaaagcagactggaaaaggctgaagttctcttctacatttgccaaaacttagttaacaccagctttaactaaaagaaatatgatagtcaaaagacaaaccaatttaaatatatttgaaagtaaggcaatatattcattacagtatggtttgtatttggcatttaaaaatatctaacttctttgcctagagagatgtttactatttcatactatcttccttcttaaagtagacaattgaaatatgtttctctgtgtgtgtgtgtctgatctatagcctgtctggtctccatagttttaatgagttttccatttttttttcttaaactcttcttggctggtgaaaattactcaatactgctatcttagactatttcaacgacatcccttgacatccatattcctacctcccttttgtagtttcttctgcttcattgttacctattgtcattactttctccgaggctgaatatctgtactaatacctcctaaggtgttccggaatagtgaagccaattctattttctacgttcaagcatattcttgatcttaaaaacaaaaaaagatgaagagaaggaaattaaatctccagaagcaacccactatcttatgcaactattgccttctgtgagccaatctcatttccataaccacctcctctctttcctttgcacaatgcaaaaggtagagatttcatgcaatttttatgacagtgacttagctcccctcacagccatcatcaaatctacaggtatattggagtgactcctgtgcttttgcatgcatattaaggactgtgtacagaacttattctaaattgaaaaatgatgcttatcttctagtttcttctattataggaataaaatagttatgttggcacttagaaaaaaagttcaaaaaaagcatcctaggcatatacattttgcatgtgattaatgtgaggacttcttatcaaagttatatctattaaatctctcaagaattccttaattttgtttctttttaatttgtgcaagctggagagatcacatttaaaattttaccaaaataagttcaagactcaagaactcgatccattgttgccaattgttctgtgtagtatgtgttcaaagtacaaaataatattaacactaatttggattcaaatgatctttctccacaaggcaaatgacattttaagacatattctgggagctggatcttctgtttagatgctgctaatagggagacaacagctgagaaacgtgcatcaccattgactgaaggatatgggtgtgggaaacccttttttcaaatgagtaattcattgaagtttaagggaacaaatttattgtccatagggtacaagagagaagagagctgtctataaactgtttttttttctgagggcctcttgctttttttctgagggccaccttcccaaacctggagatgaactgtcatgggtggctgagataaaattcacataaaatatatccttctaaagtagaccattcagtggtttttagtatattcaccaagttttgcaaccatcactgctatctaattgcagaacatcttcatctccctaaagagaacaccatacctattagtagtcagactcattcccaccacctctcaccaccccagtccctcttctactaatctactctgtctttacagatttgacgattctggacattttatatgtacaggattataaaatatgtggcctttaaaatatttgctagaagtttttattgaaataatcatagattcaaatgccattttacagagaggtcatatgtaccctttaccctgtttcccccaatggtatcatcttacatcaccatagcacaatattataaccaggatatcgacatttgatacaacctgtcaatcttattccgacttccagttttacttgtactcctttgtgtgtgttgtgcactcccatgaatttaattctaaaaaatattgttacatgtgtaggtttgtgtatccatcactacagtcaagatacagaaaaatttcaacatcataaagatccttgtgttcttgtgtggccctttgatgtgcctgccttctaccatccctagcctctcgcaaccactaaaccgatctccatttctaaacctttgtttttcaatgctatataaatggaatcaaacattatttaatcttatgggattgacttttttttgcttatcataatttcccagagaccatccaggtggttacatgtatcagtagttcagtcctgtctattactaagtaacagtctgtgacaaataccacagtttgtttaaccattcacccactgaacgacatctggatgatttcaggtctttggctattgtgaataaagctactgtgagcatttccatatatttttgtatgtgtgtgaatacaagtttttatttatctgggataaatgcctaagaatgcaattactgggtgatttgctaattgcatgtaaatttcctaagaaattgccacactgttttccagggtggttataccattttacattcacatcagcagtgtataggtgatccagtttctcttcaccctcaccaagatttcatgctgttactattttttttattttagctattctggtaagtaggtagtgaatatgtggactttgtgactggcttatttcacctagcacaacattttcaaggttcagctatgttgtggcgtgctttagtagttcattcctttttgccaccaaataatgtcctactgtatggatataccacatttggtttacccatttgtgaattaatggaaaaatatgtttagtagcaggaaaaatgttttcaattttttttcatattaggatattatttatgtctaacatctattattaaaactatcaggcactgtattagatatttgatgtgtgttttctgatagaggttacataacaactctaagatccaagacttgatgggtaaactggaaactcacatattaaatcaagcatatgaaaaaataataaatttgttaagaatacttatttaacttggccaagtcagttttgagaacaaaattttaatacctccatttccctacagaccccaacataagcttccttacctgtcattagattaattcacacattttggccagcttgccctaatgagaaatttgcatttcccagaccctccctatggtctaagtcatcttacatataaagaaattaagatgtattcatttattgcgcaaatatttactgagagtctaatgtacattaggcccgcagtaggtgctgtgattcagaaagactaacatagctaaggtcacaaatttagcaaagcaatgatttaataccaccttgcagattgagagtaaaattttatttttaatacttattttctctggatcctaattaaagcaatccagggaaatattttaaagtacttcattagggatctttaatttttttacataagtgaactattaggcattattttgaaaacataatttctacttagcttgtcaaatgcatcctattatttaactttacagggaaagaatccaatagccaacctacctggcatattggcttcccattgtaacttttgtccaaccttattatgtatagctggaatacagatattgagcacaatatatcattaagtcactaataaacttcagttgcccctttaccactttcccccatctccccctgtcaatgagtaatttatctccagcagcaatatgcataagttgtctttgaaaaggtgggacatggcattatcagtcactgcatgaacgagttatagccagctccatcatggaagagaacagatgattacaatcaataatcaatcaaagaaccagtgacagtaatcatacatcactttccactgtggaatcttcactcactcaaagcttagtaatgcaaaatccactttctgggtatattggtgccttgcctttgtcctgaatctgctcctggtttggaataagcctggaacgtggagcactcctacttggatttcacccttttgggaaggttagcaacagtagagccaaactgaacgtgagagaagaaaagaacaattgttgtaatccttgcctaagtccttattactcattgtatcccattttgtatacagctaaggctgcactggctaaatctttgtagaatatctcttgttaatcaagtgtatgcattttgtgaagcttgtgggcagacattttataactagacgtgtaaatcatgtccagtaaaatatactgtccaataaaaggtataatctccataaaaccagaattaattgggaaaattgtctgggaggtttattggaaagcaaatgattttgcaaaacactaaaataattatttaagggaaacaatatttaaaaatacaaaagccattctatttgaaataaaaataatatattctgagaaaactgatgcatggggattttctaaactcatacattcaacacccatttgcttagcactcattaagcagtgggaaaacatagatctctgcccttaaggaacaaaatatctgttataagaaaagagccaaagcctgattacacagtgcagagtgctcaaggctgtaagagagtttgttcaaaatgctttgggagcacagaggaggaaatacaacaacctgagggagtctggaatcttccatgagaaggtagcttttacactgagaatggaagaaaagtggtgaaaggtcatttcaaacacaagatcagacagacgctgagatggggtaggagaacaaaaaagcatggcattttcaagcaacaaagtgtgtggctagaaagtagaggaagggaacggggctacttgcgggaggaacagtgatatgtggggggaaggaggaaatggaaccatgtgggtatatgtcggagccagattgtaaaaggtctcatataccaggctttcctagaggggaagtgaatagaccaacttggcacttcaagaaccacttggtcctgaccacagacatggagaaaagacaaaaatgggaagctgcggacagatggactaagtaggctgctgctcctaagttaggcattttgctcggtgcaactttctaatttcttccaaaaaaggacttttagagatataggcttcaccagacatgtctttcctcacagatccaaagaaaaattaccaaactgggagcaagacacagttttatcagcataaaaattctcagtaaatctcaaggtatcaatcatatgaaaacatcagtgtttctcaggaagaggtggcctccatcctagatctctaaacagggctctcaatcttcaagaaaggcaaggcaaaagttgctatgtttgatttaatcacatacctaaaccttccaaaatgagtttggcaaaaccccaaattccatctatcccctaggacatgtcgcccttttcttcaagctagcgtgacttttccttaaattttaatattgaaattgctcttatttgaaggatcctttcaatatttttatgcaagaagcttaattcctaagaagactctgataaatttttgcagagaagtttggatcttttaaaatgatctctttaaagttctgtattgtggccaattatattctttctgagaaccagtttagttattattttcttcatggaaggtttagactcagtgcagtgccttttttattttaatcatccttaaagaaatagaaaatgttaataagagagtgcagggagctagtgctgttaaagtggcaggctattggatttgattatttttgtaccagagagtttaattgtgaactctgatttttcttcatctgtttgatgatgaaagttctctctaggtccttatcttatcatgagtaaaacatctcacatctagaggacaaacagaaactgaaaacaataagttgctgtgcttttgcttcaggaaataaataaataaatgcagtaataagttaacaaatggataaagtaatatttaaaatctcctttatgatatatttagacttgggctgcaaaacataaacaagaaactgttgggaagaattttgaaattattagctttcataggttctaaaattaggctgttgtgggatgggtttttggaaattaagctttttcaaaatgatgttttccattcaatgttggaaagtaaacacagcgcctgttgaggctgctgcctggaggcaaacacatagttagctgaaatcctcctggatataaatatctcctgggatttctaacttggaggcttaaaattacagtctaggggaggcagctacagtccacagcatgtacacatttttggacctcctatagccagcttgtctcaccaactattacaagcagaaaaaaaagaaaacaatgacgacgaatgaaaggaaataacacaaagagaacaaagatgcagattccaagagaaaatggcatatggctcttcactgtctgtcaatgcagagtatttaacgaccattgagagattgtaattatgcctcatgccacttgtctaaagccagccaatgatgtccccatgttttatatctccccccataccttaaagtcctattttgcctctctgatcaagtacagctcttttccatgattactagaattttctgtcttctgcccttccctgcaggattaatttttcttgcctataattcaaatgttacactttttgtttaggctctagctgtggctacctaacagaacttcctaccctggattccacctgtgcatgaaccatcacaaagaggatctttctaaaacattccattccagcatgtaaacaactgttggatttggcacctcatccatcctcagcttggcatcagacctctacacctgtatcccaatcttcctccgaagtctcccagtagtcttgcctgcttacctccaactaccatcacacaacttggggctctgaaatttaatagctttctgctgcctttctgccttcttcacagtactaagtcaacctcaactttccaaaaaattatttctatccttttaaaatcctacctattgtaacattctcttctctcctccaacccactgcaatttatttttacttctctgaacatcataatatattactgttacagtaagacaatacacacacataaccacacaaacgctttcactaatatctataaactctttcctgatgtaccctgttcaaactttatttctttcttttctagtctggccacattttgtctctattatttagtacataataaatcctgccttattatttggtaggttttgtctatctccttccattcctccttgctccagactggatacagttcaggataccatgtgaatcttccttatcttcctatctccagtagccctttcacagggccagccttgctatcctaacacctcttcagagagctgtgtccctactacagtgtcctgcttttcttaatataattttctctctagtgttttcttacaaacatgtttttttttcttttaaccttgattgcaaattcttctgcagcagaagttatctgttctccttttgtactttcccacagagctgtacaaaatatcagccacaaagtagaatttgaatacagtgtatgaaatgaataaataaatgaatgagtgaataatgtgtggtggatgacatggcctcggtactgaggttggttagctggtctgaggctgatagacatgtgagtaaaaataataaaattagcctcttgttctttccagatggaaaggagtctggttgcagtgattacatgttaatcagcaatttgggtttggatgtttgttagaacatgaactggcattgggatttcattgtctctgagtcaatgtacattttgagtttcttcttcaattcaagattttgtggggcttaatttaaactgtagttaacttggaaccatagagagatattttaagatttaatgaatttctaggtaaagttctcagagttactgaatgaaatatcctctaccaagatctaagagggagttcaaggtaaatccatgaaaaaaaaaataagcttgattcaagatttacaggagatctattgttccaggagtccccaaacccccaggccgtggactagtattggtccatggcatgttaagaactgagccacacagcaggaggtgagtgcaggccagtgagcattaccacctgagctccgcctcctctcagatcagtggcagcattagattctcataggagtacaacccctattgtgaactgcacatgcaagggatccaggttgagtgcatcttatgagaatctaatgcctgatgagctgaagtggaacggtttcatcctgaatccatgcccccggcccatcccatggaaaaaattgtcttccatgaagccagtctctggtaccaattatatttggaactgctgtattatacaacataatgatgtagttaataacaatgtattctggaaaattgcttagagagtagactttgagtattctcaccacaaaaacaggataactatgcaagataatacatgtattagttagctcaatttagccattccacaaaacatgttatacatgataaatatgtataaattttatttgtcaattaaaaataaacaacaacaacaaaaaaacccacaaaatttaggtatcactaggtaaagatcagtgggaaatcctgctaattccagtagaattggaattctgaaagctgtattcatgtttttctggttgtgccatgtgatgttcagtggcattatcttgatacagtagaatgattcctagatcatatctcaatgttgggttttttcattttctttaaatgtacactctaggacattaatatctctctggatatcaaaactttatcattgcttggcctggagcagtgtcttatgcccataatccaagcaccttgggaggctgaggccagataattgcttaaggccaggagttagaaaccatcctgggcaatatagcaaggccttgtctctaaaaaaaatttttttaaataatgatgtgcacctgtagtcatagctacttgggagactaaggtgggagggtcacttgagcccaagagtttgaggctacagtgagctatgatggcatcactgtactctagccccagtgacagagcaagaccctgactcaaaaaaaaaccatattttaaaaattattgtccctttttattgacattgctttgtcttttgtttaaaagtcattcaattttagtggcatcaaagcatttgatattcagtatagttactgttatttctcgaaataaatgtgttattcactaccgttaggtgtattcaactgcctttttttttttttttttttttttttttgagactgagtcttgctctttcgcccaagccggagtgcagtggcgctatctcggctcactgcaagctccacctcccgggttcatgccattctcctgcctcagcctcctgtgtagctgggactacaggcgcccgccaccacgcccagctaattttttgtatttttagtagagacggggtttcactgtgttagtcaggatggtcttgatctcctgacttcgtgatccgcccgcctcggcctcccaaagtgctgggattgcaggcatgagccaccgcgcccggcctcaactgccttttattagagggaaatacgtgttctggggcctcaaacatgaggttgtattgcaattgggtggtgatagcaagaatatcaaggatgaaagtagtgttttattgtcctaaaagtcttctcaaagtcatggtcccgtttgattctcatagctatccggtaagctaagtaaaacaggtgactgcctctacagctgagaataagatggctcagtcatttcacgtgacatacccagataacatcgtatacaagtggataagtcaagacgggaagctggagcttaatatttctagtgcagtgttcctcttgccattcttggccacctcactcatattttatccttgttcaaggaccagatggtcttctccttctgctctattgagcaaaagcaattgagctcagagctgtgaagataattttaattatatcttctcattaccctcaacactgttgatgattctctttagtgccaaaaaataataataaacttgggtggattaaaatttttaacctctgttttctatgatgaatggagatagcattcataattctgagaagagaaaaatctaaattctactcccaggtcctctgtgtcctagtatcattacctttggaaagtcatttgggtgcttattcttagaactggagtatcaagggcatggacagataagcacaagcatccgttctaacctcaatattttataaggtttgggcatgagtttgccttgttcatggaacagcgtggagaacttcccctggacttaatccttgataagaagcaggacttggcttttcatccttgatattcttgttaaatggtgtcagtggttctgaaatttatatgacctggtccctctccactttataatgaatgaatctatggctttggtcttgttttgggaagctccttgtatggcatctagacatgagaagagtggcttaaaagtatatgatgtgtgtgtgtgtatatatatatatatatatatgtgtatatatatatgtacacaatccttttagaagcaaaagacttagactatataaaatatatacactatattatatcaaatatgtaatatataatatctcagcaatatgctagcaatatattatatataataaatatatatatttataatacagctgtccctttacatttatgacaccattacctttatacttaaaataaatctatactaggacctatcttgttatattcaattagctcctgaagtaaaaatgcaacaaaatgtatagtttttactacagaatgatccacctctcatcttggatgcatcctctgaatttgaaaaatttttctaaatatttaattcaatagtagccactcgaaaaatgctgaaaaaaaataaatgagtgtaaatgttcaacacaggcatggttgaaatacatgaccattttaaggtttgaataaattttttaaatgaagtaagtgtcagcaaaagtaatttaaattaagccacagaaccaaaatatctagctatacagttggagaatcatgtatgctgtgatgtcacaaacactgtagaatttctgttttaaaaaaaaccatcaaacattgtaatgaattgaaggggtcaggggtagttctttggaattctagtctaaaagaccaagttgaagagcagggccgggtgcagtggctcacacctgtaatcccaacactttggaaggccgaggtgggcagatcacttgaggtcaggagtttgaaaccagcctggccaacatggagaaaccccgtctctactaaaactacaaaaaaatttagctgggtgtggtggtgcatgcctgtaatcccagctactcgagaggctgaggcaggagaatcacttgaactggggaataggaggttgtagtaagctgagatagtgccattgcactccagcctgggtgacaagggtgaaactccatctaaaaaaaaaagcaactaggaacaggattgcagatttatcatagaaggatgagttgaagatgttgtgaatgtttatcctggagaagaaataggaaaatgtgttaaatgctattgaatattcgaagctgggcttaacctgccctttagttccatgaattcaaactagaggttaagatgagagctttttacctcagtatgagaagtagtagtttcttggtcagatctatcaggagagagcctgggctccctggggaggctgagttctttatcaaatagaggctagacagaatgtttaagagaagtgctgccaaatagaaaataagaatgtgaacagagaaagatgtgtagttttaaaatttctaataaccatattcaaaaagtagaagaaatagattattttaattgcattagtctcctattcaacccaatatatttaaaatgttatcatttcaacattaaatcaatatataattattaataagaagtttttacatttttttctactaagccttcaaaattcagggtgtattttacacttaacagctcttctcaatttgggctagcaacatttcctccatagctacttgtgtctaattcgtgctgtactgagtagtgcaattttagagtaagcaagaataaaaaccaaccttgaattgctgtaattcaagaaagtattcttatttgactatcacaggggaagaatggacatccttttccaaataaaggcactgtgtggtcaagaaacagatttgggctgatgggataattgtgaaacccttggggctgtggagaaaaggtgaagacaaaccatcatagatcatctttgtcccatataccactctcgtatgaagtataaaacagagccccctctgaacagataaaaaccaaaaaggtgcccctgacccttctcccataccaggacaaaaacttaaatagagagcagagctgggatccagccctagccttgcccattgagctgagcatcctgttgaggcacttcctggcatctgtgtacctgtgtcctatcagaaccagtttctgtagtagctgcaaactgcagtcttcaacaatgatactgcaactttaaataggtcacaggtctctctcagaatctgataaatgctatgaaacgcttacaaaagaaaaattgtcaaaaattcaaaactcatgaacactttgaaatctgtggacctgtgattaacaaaactggccacagtagtagctgactgtattttcttgtgaaagctttaatttggccctgttgttctgagggacaggagaacaggaacagaaagaaaaatgtatgcttatcccacccgtgcctaaaatagctttcatgaatgtgaattgaacgatatttgttttcctttttattttgccaagtcattattccgtttgaaccatctgaggatttttgtcctgctgtcattggctcttcccgacattttcaccttgtcatgctgggggaagagtacctggtgataactaaattgaagcactgaatattttgacaccagccaaggaacaagatggtcatttggtctatttttaatgtcatccccattggcatttccttccaggtagtttttttttctgtttttctttctttctttcttttttttttttgtggcaccacaagacattccttccctgctgtctgcttcctgctgtgatcaatgctgatgatcacacaggttacattttatatcaagaacagttgactcagtgtgctggggctgtagttcacacccccagttcttgctctcctctgctattccatgcatgtcaaggctttagaacagtgagcagaaaggaaacttgtgggactttagccacctgtatcataagtctacagtatcatctggaaaaaatatatgtagatatagatagatatagatagatagatggattgatagattgatagatatatctattctgtcttttaaaaaaatacccccttagtttgactgaatgttgtctggaaaagttaagagtttggcacaacaggtagcaggtttctctttccacctgagttataaccattattctcacccattaaacctaatgaaggttagattattgagagaaatactgcactgtattatgcctttgcaattgccactgcagctcagcttggagatggaacaattaagaactttttaagaatgcttagcagttcagaggtgtgtgataaatggataagaaggaaaaaatatagctctaagaaaccaacggaacatccaacctgcagggaagataagatgctcaattagatggtggaagcatggaccgctctcattcttagtaatttttataccttggggaagagttgcttttgggatttagtttatcaggatatgtgagatactgggtcagacttgatagcttctccctgggaactgtggggaagtactggcctggagggcaattctcgagattgccttggtggagggatgccttcttgtatcaggaagtgctgaagagagcaggcttttgcctgccctgatgctttcctgcagtgatccccagaagctggtaagtggacaggttctcttggttggtcactccacaactgtgagccaatcatagtgtaacttttttgaatgatgctcacagcctcaagccggttcagctctctcaatggtggcttcccagaacttttgttatgggaaaaaacaggtaaaaggttcagtatcaccatgagggggattggtccattggacagtgcttaatgaacattgaaggaaatagttcccttgtacccggataatagtataaatttacatatactgaggtcccaggagattatcataggttattgtaataagggtcatctttgaagaagggaatttttcttagtttacttctataaacagcttcatgggaagattattcatatcttgagaccaggggtcatatattttctcactttatgtgttagcagtagactggcatgtgccttctataagggagtgttgaattcaggaataaatagtactaactgtttgttattacttacacatccctacccatttggatacagtttcttacttcaatggccacttgttacacaacttttccaattttatattgggctaaatgcagtcaggagtaaagaaattaaatatgtaccaccaatgcccgtcatttaagtgtcaaatacacattgcttacttagcatgtctatatgtggaatactattttaggtcctatgaagaatttctaacaaaccaaaacaaaatgattcctaccctcatgtggcttgcacttgattcgagaggtgtcttcctaaatgtatatatgtatgggtgtacgtgcacacacacacacacagaggaaatccagatagctagaaaactaaattaatacaaaataagatcacgttagcaaagtacactggagatctatagttaaaacagagaataggagtggtgttgatggggatgtgtggatgcctggggatgtgtagatctggaatttgtagacgagaaccctagattgacaaagaagaaagatcaaagccacgacagtatacagcaaagaagtagaaacaaataacatatatgtagggagcagcacagcctgggttgtccagagcttatgaagtagatttttcttcctctctcagacaacacctacttacctctgacagttcttgactggggacacctatcagaaggggactcatagcctagcatggtaacaggatgaaaagatgttactgctggatagagcgtgggaggcatctgggcctagtccctcaatttgcaaacagagaaattgaagcccagagaaattatatagaatgtgatcaataataatatcatcatcatcatcatcatcatcatcatcatccctggtaaattgtaaagctggtattggaacccaggtatctcgagaccttgtagtgaactctttgtaccatgtcattctatttttcaattggcacttgggttgctgcttggccaattctcatgctctgtaaacctataaagcagatgggaactgcatgtagcttggggaaagaaagccaaagaaaaattgcttctaccaaattgtgcacgatggatccaatttagaagtctgtcagaacacgggcagctaatagagatatactcagaggctgtctggaccttccaagccactgaagggaaaagagcacaccgtctggagtcaggggatttggtgtgagaaactaactagttgccttatgagaatcatttaatctaaagttcctcatcattaaaatcattaggtaaacttagaatccctttgaaatgctaataaaatgtcactgaatttatgctgacgtgactataatcttcaagtcttatccaagacatccaattgcaggcacaaactgatattcttgccaaattggcaagctgctctatgcacttaaccatgtagcattatattttattgggacttttaaaacaaaattcttaatcttaaaagcgaaaatgttgttaccttgccttgatcatggaactattgtaaattgggagaaggaggaaaatatgtttatcaattgctgctggatatgcattaattttagtccactcattccactccctcatttatttgaatgtgtacctgcattcaatagctatttagtgagttcctattggtaaagataaattaggcagtgtgggagatagataggtaaattctgcccacagcatgttcatagttaatgtgaacaaagccagttacataaataactctatataccatgagatgagttgtttagacatttgaaagaccagtgaacaaatactcataactgaaagccttataaggctttatagggaaaatgaaagtttaaaagacctgttaggcatactgggatttcgttacacaaaaatgaaaagagggggcatgttaaggtgaaggaacagcatgagcaaaggaacaaaggcagggatgttaaagggaggaccataaattactaggacaatcatcgggacacatttttggtaaagggcaggatagtaaatattatagactcttcaggttataccatctctggagtaactactcaactttgccatgtagcccaaaagcccaaaagcaaccatagacaatccataaagattcatggctatgttccaataaagccttaattacaaaacaggcagtaggctggatttggccctcagcccaaaatttgctgatttctatcctcaggtatggagagaaagaacaggaagaacaggctggaaaggaagctggatcagaatatctaaaaccttctattagctctcctaatgttaacgtcttatttgttaacatagccttttcttttcttttccttttacaacattggactcaaatttccaatttgttgccttttgaaaacacaggaatggttgcttccatgattatgcaggcaacactttcttaaccatccttaatataggccaatattccaaataagttgtgaaagtcaccctgactcaggggcttaaatgtaaataattaatatgtgtttcccatcatatatatcagtgctggggtaaacaaccatcctgcttttcctgagactgaggggttttccaggagagaagactttcaaggctaaaacaggggcactgctgggcaaaccagtgtgcttggtcaccctaattagtcaacgttagcatctcaagtaggcaacaagcgtccacatcagttctaggctggttatatatccagttaaagtgggcaattgctaagctagccattgtttcacagaaataacttctagaaagagagagcagataagctaagtaagtggttttcaattcgaaaactgggttagtgtaatgcaaggcacagccaatacaggcatcagcgaaatctcccagaaccccagcctggagatcctgagaaagtgttggatggcatttcagcaaaaatgtttacattcagatggaatatttggggtctcaaattctggagaaatttcccatttgtagacaaaatgtaagtgatttgatcagtattacccaataaagtatctgcttctatataattactcatttctatgagatactgaagaaaatgtatgtttagacattgagattctaaaaagttttgtgaaacattcttcacagatttgactatacttggatctaaatatccctgcactgcattcttcctacacatatttcccttttttcttttagaagaaatcactgctgagatactgaaaagtgattagaggagattaagatattaaacacaatatgagcaattttctgatatgggactctgaatgcacttttcatggtctttacaaacttaaaccttcagtgatggaatttgatctagtatttgaagctcctaattggattttggagagaatatatagataaaaattaattcatgccatgttatacactgtcagttcctgcatttagcatctcattcctgatgtgacaactagagacaccctgtgtacactggagatacggacattctagctttgatacattccatctaaatatttttctcccctcttctaaccagctccttctatcacatgcagttgctattctcttatccccatttgtctcctgtctggacacttaccttataagcacagtccactttttgctcataagcaactttccccctccgactaatttgtctttgtacctccttcctaaagacccaacaaaagaagtgctaatgacttgtcctccacacggtgaaccagtgtttttctacctattcctgtagcctcattcctaccaccactactagagtgaataatagaatactagagtaataaggtaactgaccatggtctaggacattcatttgaattgttaatttcatctttttgtagtagcatctcctattttatcaagcagccttactaacacagagtttcatcttttgccatgcatgacattacctgatatttagaatataaactatgatttgtatggctaacatttattttatactttttttcttttccaggcactgcttttttttttcctttacagaaattgtctcatttattctttataactctacatgttatgcagaagaattttgaataatctaagtagatactcccctttctcaatgaggtagagcatgactctgcacttcctcagtgtagtgtttaattccaaagagtaacctatggaaagaccaaaaaaagtaactttatagtagagaaataggacacacatcaccttagccaagtgttcaaggtggatatcaacagcaataggtcatgttgatagtatgtaccctttgtaggatgtgatgagaatgacactttacctctgtgttctttctctctaaaaaaaacatcgcccaaacataatcatgagaaaaataacagaaaaaaacccaaatgagaaacattctacaaaacacctgaccagtcctccttaaaactgtcaaggtcatcacaaaccaggaaggtctgagaaactgtcacaggcacaacgagcctaaggagacatggggattaaatgtaacgtggtctcctgaacagaaaagagattaaaaaaaacaaaactaaggacatctgaataaagtatggattttattttaaaacaatatatccatattagttcgatatctgtatgtgttctatttgatgaacggtttctcacttggcattctttgttttagtgacttatttgtctaagcctatgggctttgatatctagaagtccaggcaaaatcattactaccttctgtttctcttacatgtatcaatactgccccctgacacacacaccaaatccacacaaggctccaaggtacatatcctaatacaacaagaggaagatataaactttgtctgcaacttaagccctggaatagacaatactgctcatgaggatagttgaaatccatgataggccaccaaagctgactgtggtacctctttccatctctcctctattaggaatagtaattcatgctgcaaagtgtgtaacagatgcactatactagtgtaagatgttaataatgggagaaaataggtgtggggtgtatgggaactctgtacgatcttcacaacttttctgtaaatctaaaacaatttttaaatgttattttttattatttttattattttactatttttaaaagtttatttttaaaaaaatgaatgctaatgataacctggaataagaggtacatgtgcagatgttagggacaaatgtatttgtatctttgtgaataaaatgtttctacttttcaaattcagaaacaatactgttgtctacagcataaaacaaggtcaaagaaaagagtattttaaaattatccaacaagcagagaatgtggtcagtggcaaaagtactagaactgtgtgccaatgatggagatcatggcagagcggacataatgggcacttggcaggcatgttctcttaattgaaatgtcagccctgttgggtacgatctatgtaggagggctcggaatagaaaagaaaaaggtagcaaggtagaatcatacttctgaaatattaatagtggcaatgaacttcaacttgacagtgaaattgatagtaaagcatttaagaagaggacacagcaaatggagaaaaataaagaaaacctcagtgacgctctaccatagcttgttatagtaatatgattacctttgaaggaatactcacacttcagaacataaagttgtgctaacaaaaacagaagaatcaacaagattaaaagcatttccatagataagacaatgatccagaagttcaaaagagggaaagatgttcttcctacatttttagtagtaacactgctcatttttacaagcaggctttgaataatgaatgagctactcaaattcatgaaatgataatacagaataacttatgaaaggtcatgcagcctccctttatcaccccttactctcctctacacacacacacacacacacacacacacacacacacacacactttgcagcatgaattactatttctagtagaggagagatggaaagaggcaccacagtcagctttggtggcctatcatggatttcaactatccccatgagcagcattgtctattccaatggttgagctgcagatgaagtttctatcttccttttgttgtattggaatatgtatattggaatcgtgtgtggatttggtgtggggggtattgatgcatgtaagagaaacagaaggtagtaatgattttgcctggacttctagatatcaaagcctataggcctagagaaataaatcattgaaacaagtaattccaagtgagaaaccactcatctaatagtagaacacatacagatacagagcttacaaaaagtggcggattgataggtaggtacatgaaaataggtacatgtgctgaaggtcaaaggcaggtagattctacttttaacattaggaggagacccacaggaattaggagggcaaagcaaaatgaccagagaaagcataggccattcgaaggaccttgtttccaagaaaaggaattgttatcacaggaaacctcttatgtgatttccggtaccattcaaaaccattcttgagatatgtgcatcctagggcctgagttgaggatacagttttaaagggaaggttgaataggttggaaacaattaaagttgatttgggtatgagaaaaatgtggcagtcaataaagaacagaattttttaaatgaaaaagttaagctgtttataaagaaacagaatggataagaagtgtatatttatcaaactatatgagttcatttttaaaaatttggggacagtaaaagcatctagcaagattcagtgcaactatttggatattttacctaattgtctacaaatttttccacgtgctactaatgcaatgagtaatcaaggcagttaattaactggcttaaggcaaaaaaattgtcttcatttattttagtaattaagataattctaattgacttgaaattatctaattgacttgataattctaattgacatgtgtagatgtaggctacatgtaaagaaataaatgggctaaaggaaaaaagaaaaaagtatttctcacacttttcactgatgatatgtatacaagaaaaatagcacatacaccaaaaaatattttaaacataatgtctatttgtacctaagcatttaagtggaggaaaatcatatgcagtttcacaggctgcaggttacagcattattgggtttaaaggttcaaagggaaatgtcttttttaattcaacattaagattttgacacatttagttcattccaaaacggcagaaatctgatagtaaagggttaaatattccaaatttgagtttaggtttttaaaattctcaggtcacttctgattagagagaaatgtatgtgtatatatagatgcacatgtatgtgtatatacatacttatacaaacatatatacatatacacacacacacatatatgctttaagcagctgatggtgtaataccaagggatgccagagagacagcagatcactcactttttcctatctgtgtttcctctccaagaaccaaaagaccttttgacttgaccatcatagaacaaatatctgtaaagacataggctaagcagggactgaagtgatggagtgggagggtgaagtggtataagttttgaagctgccctgaatgagttcaagtcagcttgaccaggcgacacaaagagaatggatcaatgaaccactgccaaacatgaatttctgttcaacaaacatttattatgcacctccaagaggcaggcactgtgtgaatttctgagaatacaaagatgaatgagtgaggaaccctgtcttcccagtgtgagtgcacactctgggaaggaagccaaaaatggtagacaataatgacagtgtaaggagggcaattatagagctcaaagggggtctagaggagagtaggggaggattaatagaaaggatgctgtttgtgctggttaaggatgaataggagttttccatatggaccagatgtgaaagccatttcagaggaaacaatatatgcaaagtcatataaaaacagcacatgcaaaggcatataatgaagacataatgatatatgtcacacagtgccacattacaagttgtcatgtgatagtgactttaagaaagagtacagagccaggaggaaataatgctaggttcaattccctctctatagtacaccagctgtaccatttgaaaaagttatttaccttctaattttcagtgttcttatccataaaatggggataataagggagactaggtcaaagatggttgtattaagtgaaacaagtgctctgtaaatgttagctgttactgttatcagggttaattaggcattgttggatcacaaagtagaaatggcctcaagttaaaggaaaaatggcagatataaactctaaagaaagataactagtgggttagtaataaaggaatgcccaaaggatgggattaatgagacattatccattttcatgacatgccacaggtttcctgtttatcctgattaacatttccatcaacctggatgaatgcttctgaaactcatagatgacataaagttgcaggggctgcacttgacttggagtgacattttccagcttccaactgatattgattgactagctgaaagaattgttgaaatctgacaagatgaaatttaaattttaacatgaataatacacagtcctgactttgactttacaaaagatcagtgacagatcagaaaaaggcctgtattagcagaaacgtgaaaaatcaatgattggggattttagttggtgctaaacttgatgttgttcaacaataacacagagctaatgtgatttagattacataaataaaggaaagggatacctagcatgatagagacaatggtctcattcttctgtgttttggccagaatatgtcttccatgacaaattctcagagacatttacagaccaattaaagtaaattcacaggctcactatcaggatggtgaagtaacttagtcctctcatttaagaaatgtgtataagatctgaaaaggaaaagactcaggaggacatagtttctgctcttaaatatatgaaaagtggtcatgaagaaaaggaattaattaatttgaatagaattgaagggtagacttagggtgaatgaatgaaagataaaagatagaatttaggcttggcataagtaaactctaagctaacttcttttgagttcaaaagactgaaggtggaaggtgggggtgagctaataaagacttgctggtctcattgtaccaggtaaaaactttatggaggaaactattgtcagtagagtgttgtgctagctggcttttaaagtgtcatcatacctgaacatttctgagtctgtcataataggttttgacaaagaaaactcacagtcgaagagcagtgtaggtattttagatatcgtctaaaagttggtcaaagaaaatttggactaacataaacctgaaggaggactaacaaggtttaaaattatcatccacagtaaaaacttttctagggtcatgtgctgtggagaatttcaggcaaatgttgagttctaattcaatttgctatgtattaatgatttgaagaatgaatagcatggacattagagtcagtcgatgtttcctaatttagtgaatacagaattataagaagaaagcaatgtacatttttttcttttgttatgccagtagagccctataagctgaaagaagaatgaactagatgatctattcacttctgttttgcacatctatatttctacagtggcaaaaagaatatagtgaagactgggagcatggatattttgatattggccattaataatgcacacaggaagcagaaggactcaggtttgctttttagtacagattttggtttggtaatttcgttctaagaagactgttttttaaaaaatctgttattatttaattatatcaaacaaaaggatagcatctgatttcgattcatttaaccttaatggaaaagaacaagtcattacttaaaggatgttttatagactgtgttatttctggtatttttagaaatcatttattcctcttcaaattgatgtaatataattattcattaataactcttcttgatgtctctggagtcatcccattacccacagtcattatgcatcattgtgtgaatgtttgctctaatactgagatatctatggctcattgagtcattacatccattggtgtctatccttttagtgaagaatatacaatttattttgaatcaaatttcattgaaatactttccaggaactgtataagctgctcctaagtccagggagaagaataatacagatgtagcccctaaataccaatcctatacattcctcatagaaatcgctaccttggctagaatattcaattcctgttgctgaggtggtgccccagaggagacttgttcgtaacttatgagtccaaagttgtaacacaaaacaacttcccgtagaatcattgccataactatattatacatttaatggtagtttgtactagaacccattatagatgggttcagtagccatgaaaatgtctaaaaacataaagacaacatagaatatgatttcctctggataatggtaggtaggttagatagagtggtcatagcttcccttgaaggagaacaaacttggtaaatagatggagagaacaaaccacattctgtgctcatggttagaacatcctgcagcaaggaggtagaagagcagaaaggaaaataccccaattcatgcaagggcagaactcatgattagtgtccttcattttcacagtaaaaatctcacccctggatggaaatttgagatgctaatgagacatgtaacgtatgtactagcatgtacaacaatagcacatgcacccccaggagaccacccagaacatgcttaatggcaacactccttccccccacctcatgaataattgcacatactcccataaagggagtttccccagtgtcaattggtgccgccgtctcacctttgagcagctccctctgatcagccatcagaatgtactttcgttttatgaggaattatttgtattttggactaactctcaaattctcctgtgtggcaaagtcaagaacctgaactggcccaatggctataacaacattttggataccaagcaaccacagtgtatttgttaaaataggaatacagacactgcttcatagattgaaatacgtagcacggtaaggataactttttaagttacaatcagctcaaactttaaaatcactagctattttctttaagttaatctaataataaattatatgctgtgtaaatatttacacatattcgccccatttcttagaaaagcacaagtataatctttcttcaagcaaatccagtgtatgaaaacagttaacaaagtatgttagtgtatggttattcatatcacaagaggtttttagttacaaaaggatagcgcctagggtttctttaaatgttgcgtcccattatgcatttaaaacagtacttagattatccaaaccttcaggaataaatctattatgtaaagtaacagatacatatattaccttatttgtgaagtttggtgaaattagttatttggtagatgattgacacaagtctggcagggagccagcgctgtgaaaaccaggaatttctgatccttggggttgttatataataatctgcttccattagaatatttatgatgagttattttaaataataatactattgatatactactttcaaaattaaagtataaagtttactttctcaactacatagaaactttaggaatagtttttaaaggtgagaagtctgaattcattcattccacaaattaaattttcaaaactaaatgtctctaattcttctacctaatttactctgtcactcaggctggagttcagtggtgtcaccctggttcactgcaacttctgcctcccagattgaagccattctcatgcctcagccccccaagtagctgggattacaggcatccaccaccatgcctggctaattttggtatttttggtagagactggttttagccatgttggctagactggtttcgaactcctggcctcaagtgatccaccctgccttggcctcccaaagttctgagattacaaacgtgagccacagcagaattcaatatcaaatatttttgttcattttgttttgctttataaataatgttgtgagtatattatatataaatttgtgttcttatgttttccttcagaattttaatttgtgagcttttcatactatgttaatacaaacttttaataattagcatttgaatgatcacagtttcttcatgtagacataactgtttattattgaaaatttaatatcattattggaaaaaattattgggaaaaacaatttattgagaaaaataagatttttgttagtgtaaataacatttattattaatattactattaattaacatttattatgataatacatttattacttggaaaaataatattttgctattatgaataacgctatatttagcaaagcttcgtagaaccattaagaatttctctacacatattgtctaattgctttacctactgttttctatacatacatattatgtatttatatgttacatatgcacacatatatttttcttatttatgggtgaaagattactagtattcctatcattggcagtgagatgaacatattcctctccagattgcatatttgcaggatactatgttcctctattttgccgtgttcatattgtgatttaatacaaaattcctagaaacttggtgaggtcagtagaacggggtttatcacacccatgtagtggggtctcctattatccaaagacaggcatcaggtcagtggaaggagaacccgggtctcctcagtcctggattaattacatctacccgaattttaaatgaaaaatgaaaaacaaagagtgcatctataatttctagccagcatctgagatggaaaaggcattttctagtgatgaataggctcattatgttctcataaattaactggtgaacacatagttagaaatatagaattttagagccaaaggaagcctcagctaaccccatctcccatttgatagacaaggaaaccgaggttgggacgggtgatgtagtttgcttacggttatctcatgaataattgcagaactaggattaattgtctcgatttctaactactcgtttctccactaccccaaacaaactactgcttttgtttttctttaacccaaatgttaatttgcttcattattaagacaggtttttttgttttgttttgttttgttttgttttgagactgagtctcgctctgtcacccaggctggagtgcagtggcacgatctgggctcactgcaacctccgcctcccaggttcaagcaattctcctgcctcaacctcccgagtagctgggactacagacatgtgccaccacatgtggctaaatttttgtatttttagtagagacagggtttcaccgtgttagccaggatggtctcgatctcctaaccttgtgatctgcctgctttggcctcccatagtgctgggattagaggcgtgagccaccatgcccagcctaagagaggttatttgaaatatataattccatctctattaatttatctcctgtaaaaagagattccctctcctttttcatgccataaaggatccagacagccacaaggcttagcatgcaacactgacaaaatgcacaaaagaatcaaaatcgaattaggtaatcaaaaatgaaaaccaaggtactgcaatatgaaataatgtaaatcatgcacagcaaacctatgtataatagaaataccatgttcctgcctgtttctctaacccaccagttattcagtcacaagtaatttactcttagaaaaaaaaaagggccccaaatttgatttatttccccatccaagtaaattttaaaaggctgccaaagctttctacataaatctcaaatatcttcccatattgtggaggagagagagagaaagagagaaaagagcttattatttatgaagctaatcaggcaggcagaggaggagttagcttttaactttttcatttattatttcctcggagttaatatttcattgaaaagcaatctataaacaatatctttgggagcttatacagaaatgacttaaagattttttacattgtaaatgagtacctcttattgcgtatattccatgccccaccatttttattagcaaggttatttaaataacaaagaaaaagttccaacttttagttatttattggtttaagccaaggatcagcaaacattttctgtgaaaggcaagatagtgaattgtatatatttctggctgtgggcgcatgatctctgttgcaactactcagtggtgcctctgtcgcaggaaagcagccattaaaagtatgtaaataaatcagtatgtttgtgtcacaataaaactttatttatggacactgaaatctggattgtatataattgtatataattctgtgtatcatgaaacattgttctttccgtttattcaactattaaaatatgtagtaaaccattcttagctcactgctgtacagaaagagctagacttgccctggggccatagtgtgctgctctctggttaaactgaataccctcattgcaaggattttggtatctatggcctctctcataaacaagtgagcctgtttatgaactagtgagctctcccagatagtctcccacttcatccttctgtagaatagaaaaacaaaaaatgaaggaaagcaaaagacacctcttaaatactctttgatcttgatccttgttgagtatgtatagttccacttaaaaacctatacaccagtccttgatgcttttatctttttaaaataaactattactgtgcatgaaccccctttgaaatgtatcattttctgccctagagatgtttgtatatgtgtcttttatttggatgtgagaatgtggtatggtgtgtgaaatatggcaattactggatgtgatataaagtatttgcttattttcttaaacattgtaatataaacattttttgaattcaaatgtcttaacagaatgattcagatattgcattttatgtaataagtttctgtatcaatttttccttacattataattttatgtgttcatgatgctaaccatttggatatttggaagcatatggaaggttgaatatttcactttatatccagatgtttggtgttattcaatactgatatataggaaaagaatatgctcagccatctttattcaagattttttttaatttctttattgcccataaaagtgatgatttacaaatgtacaggtattatataggagtttggttaaatatattttattggtgtgaatgcctaaatatgatttagaataaaatatctattcatattttagaaacattgaatctgtaattctagagtttttatgattttatgtgtgtgtatgtgtgtatgtgtatataggcagagatcaatatgtgtatatataatagatatttaaatacacatgtataaatatatacattgatctttacctgcatacacacacacacatatataaatatatacatatatatatgtttgtgtgtgtatgtctatgtgctacacacacatatatatatatatacatatacacacacacatctggcagttttggaattgatctctgcctgattcttatctgtaccttagtttatacatactttaaatattatgagtgtgctcgaaaaagcgaatgtggaaacactaagtgaatgaaactttattttttgagctggtaactattgtgaggattccctcacttgcctactgtaacaaccaatccagggctttctgctcaaaaaagaacttcatccttagagctatcatgaaattatatggtgatattcacttcgcggtgggttttacattaaatgagaaaatgtgtgtgaccagtgctttgtaaattgaaaaatgctatacgcccattagctgttacctgttcaacttcactgaaactcctcaatccatttttctccatcttatttcagaagctatttctaaatcagaggataagtgtttttatcactggcttttcttttagtagcccatggatgcattccaattttattatttcacaagtgttaattaagaatggttaattgtctgctatccttagccctacattaaagtgctgtacagaagacagagacatagcaaagtacagactctcaggagactgacatctagttagggaaataaaaacaatctagttagggaaataaacacaccaaaaatgcattggtacaaaatgggatggtgttgagcacaagttcactaagctctcagaggagggatactgagtatggcaaaatcagattcactggtgagttaggattttaccttggccctaaaggaggggaagagttttggaaagtgctatatgaaccgacattctttaattagtaatttggcacattctcctgaaacggtctcttgttaaggtaacagacatgaattttatatggagctaaatgtctaagtcagcctttctgacaatcaacattcatgggtcccagattccttactttatatataaagggattagatgacttgtatcaaaccactgttcttactttatttagccacatagagtttgtttaatatttaatttaatggaaaatagcaaatagaaatgaccttgccaagtttccaagaaatgaagagtggtcaatcatcatgttaactttcagtttccttttcacctttttgtgaacaaaataacaatattcagttttgcatctccaaacactgttgccgcacactatgatttatatacgagtatgattaggaaaaaatgaagagttgaatattgtcagttgtatgaaaaaatggtgtgagctttatgtctatctgaacatattagagcacataaaaagaacaattttaatcattttctttatttttttatttttattttttatttttgtagggacagagtctcaccatcttgcttaggctggtctcaaactcctgggcttaagtgatccttctgcctcagccccctaaagtgctgggattacaggtgtgagccaccgcacctggcgttaatcattttattgaaacaacagcagaaaaattgacttctgaagttagcatctgctatgcatccattagagacttacattaaacattaggacaaaactctgatactttttgaccagttcaaatatcagttcataaaaatgaaattcatcatctctccgttaggtagaagtggcaattttcatcacatcctcagtaattaaaaagtgtctacacaatgggaaaaggaaggaagtcaagattggctatctaaagctgggtctatctggataatcaaagctacatgtaaatattagttttttgatgctgacttttattttacaataaataaaattacagccatcactactgtcaactcataaacataggtattagaagaaataaaaccctcttcaactcttgtcagaatctataagtatgaaaacatacaccatgttttttaaacactaattgacaccagagacaatttgccaaattcctgctcgagcgtttcattcaaatctgaaggagggatgtgtctaaatattagtatgaactctgcggtgtcttacatcttgtatgaaacattccatcttcagcaggcacacataaggatgggaaaaatgatcttttgacataaagttttggaatctttcaggaacactaagtttaaggtcagttgtttcctagtgactgtgccttggtgactatgcctttttgcatttgtatacaattaaaagggccacttgtcattaaatagagtatacacagcttttctatattgctttaaaaattatgcaggtagatttttccctggaactatatagaaccctatctttaaagtagtctcctcggaactgcattgtattagcacttcctgtttcctggtgtcttatttaatagtttctatttagcacatctaattgaaatctgttgtctgtcatttggccaaagccaggaatgccccttagtagggttctgtgccaaaatccctgagtctcacccactgtgttctagtcaattgacttgcaaaagcaaagctttgggaacttatgtagaaaagtaggtcaccggtccaatatagcattcctaatagtaaaaagtagaagcatgttgctggttgttacatttcatgccaattttcatccagttcaaattatggcactcttctatgtttcttgtgacctgctttaaattaaagatgcttactaatagtatagattctgtaccattttaaagtcttctccttggattttcttgtcttcctcaaaggattcagggttccaaaagtaaaagatgacaataaatgtagaagaggtctatgagagaatagattctccatttacatacatgtgcatattatttgctttatagtcattgttctaactttcagagagatgaagttattttgaaagaaattactgggctgagaatccctagctcttctttaagtttgttaaatgtgtggtcctcttgttcagatttaaagttcttaagcatgcactaatagtcatcgtgttttcctcatgttttcaactgtggcagtaagaagtaatatatacctaatctcataattttgtcctctaggttttgaaagacattttgacaaattacatgtgcattttaaataggtttcttcaaacagaaattttaagaataagtaacttcagtaatagaaggaaacaactcttccaaatttagatgtctcttctttcattgatctttgggcccagggtatgggatatcttttattataatattgggggggggggtgttaaaatgcctctttcagcacttgatgacagttggagagtcacttaagtaaaatttacctgtatacaaatacataaaatttcaaggatttcatggaactcatgaagactattcaggaccatggaacccagtaggaggagctctttgtagtctagagagaataaaaatctctgtacatgagcgcagattgcttaggcggccttacatcaaaatgggtacctagagtgtgttgctggagagtaatactgacttcagtagaagccaagaagctgatctctcacactgcttgcgaaagggaagcatgttgaaattagagggaaatgtaaaatgtgtaagggactaagaaggaggtcttgcttgggaagaagctggacctagttgaacaaattgtctagctggaggaactgcagtgtaagacttctcttctaacctggacctcactggattctatgtacttttaaacatttatattttttcaaaacaaataaaaccctgtctctgttctatttgagcatggttaaaaatgataatgtgtcacattttctttatccagtctatcactgatgggcatttgggttggttccaagtctttgctattgtgaatggtgctgcagtaaacatacgtgtgcatgtgtctttatagtagaatgatttataatcctttgggtgtatacccagtaacgggattgctggatcaaatggtatttattgttctagatccttgaggaatcgccacactgtcttccacaatggttgaactaatttacactcccaccaacagtgtaaaagtgttcctatttctccacatcctctccagcatctgttgtttcctgactttttaatgatcgccattctaactggcatgagatggtatctcattgtggttttgatttgcttttctctaatgacgagtgataatgagctctttttcatatgtttgttggctgcaaaaatgtcttcttttgagaagtgtctcttcatatcctttgaccactttttgatggggttgtttttttcttgtaaatttgtttaagttctttgtagattctggatattagtcctttgtcagatggatagattgcaaaaattttctcccgttctgtaggttgtctgttcacgctgatgattgtttcttttgctatgaagaagctctttagtttaattagatcccatttgtcaattttggcttttgttgccattgcttttggtgttttagtcatgaagtctttgcccatgcctatgtcctcaatggtattgcctaggttttctttgagggtttgtatggttttaggtcttatgtttaagtcttaaatccatcttgagttagcatttgtataaggtataagggaagagtccagtttcagttttctgcatatggctagccagttttcccaacaccatttattaaatagggaatcctttccccattgcttatttttgtcaggtttgtcaaagatcagatcgttttagatgggtggcattgcaccatggaatactatgcagccgtaaaaaaagatgagtccatgtcctttgcagggacatggatgaaactggaaaccataattctcagcaaactaacataggaacagaaaaacaaacaccatgtgttctcattcgtaagtgggagttgaacaatgagaatacatggacacagggaggggaacatcatcacacgccggggcctatcaggggttgggaggctaggggagggatagcattaggagaaatacctaatgtagatgaggggttgatgggtgcagcaaaccaccatggcacatgcatacctatgtaacaaacctgcacgttctgcacatgtattccagaacttaaagaataataaacaaaaattgaaatttggacatttaatgtaaactgacccaggtcacgttgcaaaccacagatggtggtagttttataccaattttgtatatacctttatgtgataaaaattaaaattttaaatttaaaaaaatgatattggggctacagcagctttttgagaaggctggaattgggaaaacaagattcacgagactgaagaaggcctaaaaaatgacttcagactctttggggtacagcaaagaaggagtttgaagctatgagctccctgtgcagggcaaagtaaaatggtttatttgggcttgccattaatacgctgtagaaatttggattcaacctagcttggatacatttgacaactatatgacgtaccataaaaatggatgaagttataaacaagctatatgataaaacttctagaatgcctaaacccatgtaatagcatagcagcaaaaagcagggacttttcatgcatttatagtgaagttaggttaagaatatcgttaacttttataaaatacctaggacagtaatacttaagtaccgattgttattaaaattatattggaccctatgaagcggtgatatccagctgtgttttaacacaaaattataatttcataaagctcaacttaacattccttgacagagctaagttttaattatccttccaaactttataggtatatacctagaaatattttagaaaccaatttgatatggtcattcaaatattcattaagttgataaatttattaaattaataaatataaattttatctcttaataagacaggtctaccaagtcacatcatctttagccattattataagtgctgccttgtgtgaaattgatcaaaatggcaggaaaatgtagtgtggtgggaacagaatggaccctggagccgtactgccatggctgacatcctggctccatcatttgccagctgtatgaattcaggcttagcctctactcaacttctctgtgtcacaggttgctcttatttaaaacagaagtgaggtctcaaactcgtggtctcagaaacagaaagacaaataccacatgttttcacttacaaatgggagttaaataatgtgtatgcgtcaacacagagtatggaatgatagacaacagagattctaaagcagggatgaaaggaggatgagtgatgagaaattacttcggtacaaatgtacattatttccatgatgggtacactacaagcccagactttactactaagcagtatgtccatgcacttgtaccccttaaatttatgcaaaataagcagtattgagcttaaaaaaaaacagagaggtgagggaattcctttatcaggatggagcagttctgtactttgactgtgatgataactattcaaatttatacttgtgataaaatgtcacagaacttaatatgcatgcacacacacagagcacctacaaaactgatgaaatctgactaaagtctgtagtttagtttgtcatattgtgcaaatatcaattttttggttttcataatggtttgtttggctaatgacagttctttaactggtttagtacttggggggtgcactgagtgatgggtagacaaggtctcactgtatagtttttctaaattcttttgagtttatatttgaaaataaaaagttagaaaactacacttatcttatgaggcagccgtcctattcttagttattttccttagaaaaataaaaacatatgctctcacaaaaaaagctacacaaatgtctacagctgttctaatcataatcactccaaactagaaacaaccaagatatctttcaacaaatgaatgaaataaatggataaacaaactgatacatccaatgtattattctttagcagtaaaaaaagaaacaaactattgccataagcaacaactaaaaaacaaaagataaaaatgaaaaaatggtgactctttacagagttgttaaatgagcttttatacagatatatgaagttcctctaatagagaccagcatgcagtgtgtgcttcataagtgcttgctattattatttcttcaaaaaaataattgatacttcaggattctaataaatattattttttttcataacttggacaaattaaagagtataattctgtgagtttcatatgtttactatatgtcactatgtgtgtgtgcttacacacacacacccccacacttctcatttagatgtacccatagacaaaaagcacaggtgagctgcgagaattcagcagtgaacgtgcaaggtgtggtctctgcaactatagaacttccactctagaatgatatttttttaaatgcctaagtttaaatttttcaaataagtgcttaaaattattccaatttattacagtttttaaaaattacactaattatgggattgtcttgtgcattagaaatactatgatttaaaaatatatttgtttgtatatatatctcccattgattgagatacaggactaacacttaccatacgtgctgactgtgtaaagtcagcttttataatggagttgttatattttgaagaacatgctttgaatcattgataagtctgtgtaataacaagatagatcataacaggatttaccggatgtttattgccagctacatagccgtccagcactttgccatcaatctgtactgtgtgtgaagcactgggctggataaaagaggaacacaacgcatttcagcccaagctatggagtaagacacacctgggtctatttcctagtattgtcgcttgctaggtgtatagatttgcacaaattattcaacttgcatgctcctccatttcttcccttataaagtgagcacagtcttaatgatcaacctcacagagttaacagtgaaggaaaaaacttgtcacatgaccgggcacatctaaagtgctcaataaatcttagctatctttattgctatgtatactaaaattatttgagggaaacatgacttagagatttaatgatgaagaaataaaaagtggtggaaaattacatactctatactcctatgtagaagcttgtgttgaagggagtctcaaatatattataggatacttgcattaacttcacaggcaatatggaacttcctctagggcttcaagtactgtaaggtttccgatgtttatctagtgactactacaattctggcattatgctaaaaggggaatgatatgagaaaaatgtgatgactgagtaaggtggggtggagttggtgtaccagggataagtagattagcattaaccatttatgttatagctagagaaagaaatgtgggctatgaaaaatataaaggcaatgtgtattacatatcactgctatttgtatttcccaatataaagggattaagtgcaatttgaattatatatatgtatactcaaaataagttagagaatacccatttgtttataatcttaaagtcgtagttgaattcaaagaagaaaaataaaatggagaaagtacactggattaggagtcaaaatactgggatcctagtatgagtgaactagttaatctcttatttaaggtatctagctccctcagttatatatagacacattggacattattaatttaatgttatttattaagcgcattttatttaaataattcaaactgcaagctgcctagagctagcaaatctctaacggcctgacaggtagtttgaagtagccgtaattacacacattctgcctattggattatctgctgtggcttgcttgatggcttaaaaatgaacattaaatggcacttaaatcaaaattcccagtggccttcttaggtggaagcagatgcttctcccgtttatatagaaatatttagatacaggaagcaaaggagatgtatagtttaaaatgtcaagttgatttgacatgtttctgggtttgttggttttgcatgaaactttaatgttaaacaagctttaaataaatcatctcttggtatttgagggggaagatgtactataaatatattgattccttttagtaaaatggtttatgggttcattagcaatgatgctgcaataacaacaatttttagggaatatcaaaagtgaaaacaaacctgttagcataattttcacatttgtagaaactgttttgtgtcatattatgatgtttagaatggatttagaaacttgagcctaagcagcagtttggtctcatgatactaaattcactttaatatgtgacataaagttgatatttttaaaagatttggtagacatgagcttgtgtttttggggcaataatgatcattattttgctgaattcctttccgttattctgtttctttctgtactgtacagttcaggaagttaatcctcaaaggtttggtatcattgttttattaatttttttggtcagagaataagactaattagtttttctagctggctgtgtcatgctaagaggttttagcttactttaggggttataatttgatctataggataaggaaatctatatggatgagtaattttgaaatgcacattctttccttcttttattgacttttgactctgtttttatgccacgattagttacaaggtgcacaaaaactttttctagcttgagtaaaaaatgcattttatttgaaaggcactagaaaatctgaggaacataaaccagagctctgccaggaacatgactcagctccccaaactccaatgtgtggagtcttatttgaaaattcaaaatattcagatggaggaatctgacagagaaagagagagaaggagtggtgactatgaggaggggtcagagagtagcctctatgggtgggggaatcaccctatatatattacgggtaacttccagagaaaagggcaagcatgggtcagtgtttctattgttaatggtcacctgtttttatagaaagaaaaatatcccagttgtccctcttatttcccagtattcttgcccagaccagcttaagaaaattgatagaacaaaacttttgactagtcttactcctgaaaatggcatgtaacttcacactagaattccattgcaacactgcagccttcaatgggctttgcactacttcccagtgtccatgagccctgactctgtgagcctcttgttcccatcagcggtgcacccctcattactaccttacctttgttgccacaggcacaaaacaggtcaaggctgctgagacagtggaggctggtgaggtcttgctatcagatcagatccataccagggactcagcttcaagcctgggagagcattccatgctgcaatcccttgggaaactggttcggttctggtctttcagtcgttggaagcactgacttcaatatgtccatcaattttccacagtagcaacatgtatggaaacatacaaagattccacaggatttttgtattaattattaagtggcatgcgctgagtttgctgagtggtcaatctaatggcaaaattaaaacacacatagaacatatatatggacatagaacatatgtaacatatatgttacatggaatacaatatgactgaagataataacaatactattttgggaggccttaacatttttagcagcataaaaaaataaatgtttggaacatccaaagtcatattatgtgtgtcctgtggagaaaattccatagaaataattcgggctttctaggcttttgcagacacccagcgcctgctggcaataaacagaggcactaaagcaaagcacaagtgggcagccagatataaatatccccctcgtcgacagatacagcgtgggacactgtgggctacagaatcaggaaggagggaaaggaaaaatctctagtcctaagtttttttactgccctgtcccatttttttttaaactactctgtttttccaaccctgcctaatcgagatttcaaggcagcttgagcctgtctttccctggttcctgaggtctccactgatgacagctgaagcatgtttcctgacagaattctgcctcctggcaaggtagacacagactccggggacatagtgtgtcagagcttctagagctcctggagtccaggcacctgcagttgagggccgtgactgtattgttgcccgtggggctttgctttgaaggcgtgctaagggggagagggagtggggccctgcccagaggtgcagcctctgcttcacctcccattcttgacgtggggatccagagcatgggcagaccaagaatcttgtgtacagttagaaaggtcaacgggaagaacaggctctcttcctgggagtgatataaagtgcggggagggagactccttacattaggaataattgaatgtggagaataatccctattccctcagggtacattttaataatgcaagtgactgatccacttaatgtctgcctgatttgaactgtacattgcctggcttttcattaataataaatccacaggtaaacaaatgcttcacattaaatgcctcttaaaagtgtttagtgtctactgccagaaaacctattaagcaccctggcctaagaaaggcaaaattgaacagaaaccgtatgtaatgtgatagaaacacctttgcattgtcttgtaacaggaaagttcacatatacctttagaatgcattttgggaaaattccaaataatggcttattctcttagttataaaataataaaaatgtaataaatcttgtatggttaataatacttgatttactatcaataataaaaatacatatttaaatgtatatttaaacataaatttaaaaaaaataaatgcatatgctatatacttctctatcctatggatataatgaagttagggggcaagaaggagagcttttattcttgtctgtcctcagcctttaagttgcctgaactaaatcatccttgaagttatttctcctgcagtaaaaaggaccatttagacaggtgtcaaggatttaacaataagtagcatttacttaatatatgcttttttattatgttctcacaacgaaattaaaatgcaactttccttaccagatggcctaaaagtgttctaaaatcagaaacttagattttagtgttcttagaatttcatttgtggtgttttcatttctgttcgttctcttttaattaccaagggctgaattaacctctggtgagatcatctgctgtctctttctatttcactggttgacctagcccactgactctttacatctaagatcagagaattttctgaatttggaaaagcccataaagaccatcttgagcactgctcccttttttaactggatgaagaaattaagtaactgtattaagtgacttgtaacagatcaagttagtatcagcagtttctagattttagatgtccagattcctagtcccagactgttccctcttaggatgaccacctcttatcagtttttgccctatcaccatacttttcatgggtttctacatgctctgcctattttccttctgcttctgatttctaagtagcctatccaagtatttaaccacatgcatagccagaaaatttattcttaagtccaacacacatctgtataattgcctccacctcatcttttgtagtctacagcatgtcaatcattcatccatttgttcattcagcaaatatttgaatttctatgatgttgtttaacgtttttaaatcactttgttaaatcattttaaaaatgtaaaagtatattgattatatgcttccgagtttttgatctcctgtgaaatgtcaagcctttcttttcaacccattgttattttggctaaccatttatgaggaatatgtgagtgtggaagcctgcatttatgaatgtggatgtgtataaaataaaagtgcatactttggcattgaggacaaaacaaaatttgatataagagaattcataacagctgtgagaattctaagtcaccatcaataatagcaatatctctttccagcaacacccattttccttaaggccactgaagcataatattataaccttcttcataaagctgttagatagagctatggaatagttctttagaattaaatgtagaaaactccagaatttcggaagtgaattataaagccagactgatttaagtgtaagaagaaatttcacttgaataaattctactcgctgagtcattgcaatcatagatttaatgtagtttgaaaccacaaaacttttatagttttaggccatgaaagtaaagaataaattcccctaaacaactttgttgttttctttctttttggttatagtccactgttgaagtcactctttgtccctttctttcaacatggtatatgaatgttttctttgcctcatgcatcaactagtaacaaaggtgagttgactgtgagaacagtgtccaataacttgtcatatgtgaataggcttccatacaaatgaagcaaatttaacacctgtttagaaatgcaaagtcatagaccttctgaattaggtacactgtactttcaatgacttgagcaagtcattggaactctctgaggctcagatttttggtcactgcaatgaaaaacagcatctgcctcgtggggtttttataaggattaagagtcatagctaatcatgacatctggaatttagcagcccatttatgttattactttttgttgttgctgatgtcattaagatgtgagtagcccaagactttaatgagttatatttttctggaccaattctattttataccacataccagaaccatcttctctctgtatccattctgtagaaaacctgagaacttcttcatagctttgggcatttaaaattagtaaattactaaaatatacatactctatgcttatactaaagaggcaaacctaagtgatactgagaagaagtgctaatggatagaggtgcgttatactcagaaagatagatggtgtaggatatttattactcacgttattcactgcatttacgtggtcaggaaggttctggaaataaaatgttctattttgtacccaatcctaatgtgttagtgtatcagttggacagaaattttcttattctttcttaagatcagttataggtctggaagtcactaaacatgatttcctaccattctttgactatttgagttagtttcttagttgtttttttcctacctttgtagaaaaatcgcactcatagtgtgatttttaggatagtgataataatagtaagtgcctttgaaaaaggaaggcaatttatgtttccatagttatttcatgtgatcatcacaactgctccataaaatagaaatttcgttgtaatttattcttttaggtataacttagggatataaaaaataaagctatatctgccccatctacttgagtcaatacactctttgcccttagtaagtaagtaacctcattgaggaaaggtgctaaggtagtggaacaattgcagacagaatgtttctagcaataaatacatgccaaaaccaataaagcaggcatctgggcttttcattcagatgggtaagcgaaggaagatctctctccagacttcttcatcctgaagaggagattgttatggcgtctactgtttacaagtttaacaacttggtcttttgtggttctttaagatttttgcggcatgaggtttaaaaagatcagttaatcatcttcatggcaggcaaattttgaggaaaagagaaaagataccggaaaaagaaatcaagtttcctttgctagacgccattacagaatgttcctacagagaagaaatggcaagtgcatagatgtccgcaatccaacaacaaagtgtgaaactgggaatggctctgtactagagttagctatcttccagtctagcaatttccgtagccctgctataattgactagcgggattaaggacaaatgaagctgcctggacttttatttttttatcgtgactaagagtatatatgtagaataattttaaagagggcacctcggcggtccattctgatcagaaactggaatgttgccagctctcagaacttagtgtttgcttcctccaacctcatgttttactacctctggttcattcctaaagaaaataatgtagtttccgccgggcacagtggctcacgcctgtaatcccagcagtttgggaggccgaggcgtgtggatcacgaggtcaggagatcgagaccatcctggctaacatagtgaaaccccatctttacgaaaaatacaaaaaaattagccgggcatggtggtgggcgcctattgtgccagctacttgggaggctgaggcaggagaatggcgtgaacccgggaggcagagcttgcagtaagctgagattgcgccactgcactccatcctgggtgacagagcaagcctccatctcaaaaaaaaaaaaaaagaaaataatgtagtttcatctatgtttgtaatcatgctttatgcatccttcctgtccttccttcaatgagcattatatttgtgaactctacacacatttcatgtgcagttttatttcatttttcttactgtataatattccattttatgaacatatggtaatttatcaacatagtcaatatttgggtgttttcaatttatagctgttacagtgcagctctgaacatcttctagcatgaatcaagatgcacttaggcaggatcaacttcagttatacttaggagacacattgcagttgtttagaatatgtgtaacttcctatttatatttccattaacagcaaatggcagttcctatttctgcacatccttgcagtcacctgcattgtcagacattttaatttttgctaatctgatggaagggtaatgatatctctaggtgacttttaatttgcatttactaatcactaatcaacttgattaccttttcatatgcttatcacttactgggatttctgcttttcatggtgtcttttcaagtattatagctatctttccattggatgaacagaattatttttaaaaaatgaaataaaatgccacttgagagtttctgtgctaacgtttgcaatagaaagttcaagcagaatcccaaagttgaattcttaagttgatggttccatagttatttttaactgtcatataattgaaaacctttattcccttcaaatttctttttcttttctagataaagtcttgacagttcttttttcttatcttcttattcatctcccctccccacttagatgaagtaatgcaaggcttgtaatttagagcttagagcaatctctaaggaaagaaaaatgcaggaagattgcccttggccttaggctttagagaatcttccattttgcattggaaataggcatattcttggcagagattgctgttgtttaaacctcttctgatgccacctaatgggaggctaggaaagggaaccttcaagagatgccaggcttaatattaaaaacaagtagttggacagcgatttagtgagcataaggaacataatgacaggtaaggagagaggagatgatttcacctacccgtgctaaaaatggctttggaatgatttatatgccatcaactcattacagccctaactatcaccaaggatcaccaaggcaacgaggattattcttcacacacatccctcaggctttatctccatcttctaaagcaattttgctattccttccaacctgattatttacacatggatggcagtatttaggtggggcaaaatggatatgctattgccatccacccatgtccagatttaatcttagacagtcatatgtctcttatgcagacaacaaaaactgtattgttttatgcttattgagagctgttatggcagaaatacagaaagtgaggtattccttgaattcaaacttggagtcagagattcaattttagttcttaccagctaagttcttatattttgcccacatgtatcactgagcagagggagtcaaacgtacgctgcatgagataatttcaggagctgatgatacattttatggatttaagtttccataacccttgatagacatttaggtgttgtttttaattcgaagtttttgttgtatgtgtgttatttgtatgaaatttttgtcctctgtaactctgagtatccatgatgtccagcattactttctgttttgttttctttttagcatcctttattttttcactttctttctttcaatgaagttttatttttgagaggtctaaggcacttgccttatgaaactatcttctgaaagcacactaaaagaaaattacttaaaagtgtattccaaaacaaaattagaggctgggcacggtggctcatgcctgtaatcccagactttgggagaccgaggtgggtggatcacgaggtcgagattgagaccatcctggccaacatggtgaaaccccatctctactaaaaatacaaaaacaattagcctgtaatcccagctactttggaggctgaggcgggagaatggcttgaacccaggaggtggaggttgcagtgagccgagatcacgccactgcactccagcccagcaacagagtgagactccgtctggaaaaacaaaaaatagaaaagaaatcaggttgttaagcaactgaactttaggtaatttaagcaactgcttataaattttcaaattatcctataatatgtaataagataaattcacatatttaaggccagcacttcctcttagtctttgctcacatccttaaaataagaataaattgattttttgataaagtagttgtaatcattttataagctgaaatgaaatgttctcgtttgctgccatgagtatttcaggttggtttcccattatttgagtcattatttttgcttgggagatttctttataaagataaatatatacaaagtattataagaaggctcctttggaatatgcaattagaaagttacagggtatcatagctgggatggtcttagaattcatcttctaactcttatttcaaatatgatttgccctaaatggcacagcataatatgcaatagggcaaagactagaacagtcttttttttgaaattcttcctcctagaatagtaataatagtgataaatcttttattgtgtagtttataagtgtgtgtgtatgtgtgtgtgtgtgcttctgcatttataatcctcacacctctgttggattaggctgaacagataagacctgtatcttataaaccaagaaaccaaggctcaaggttaagagcatagtttgaacttgaatcttcaatctgcatgcagttctgcactgcctttgtgtgttagtcttcttttaaggaacgttaggatggacctatctggaattgtcatgagtcaaaaatgcaaactaaaaatctggaagcaattgaattaaaaaggtacaactgattttagaaaaggcaaaagcaggaagttgccaatagtttcatttgaagagaaattatgtcaaaatcactaactcagtacatagaatcaccctagaaaattgtactggatcaagaaagaagggaaaattatggaaaattttaaatatatcccaggaaagaagaatgaattaataagagcacatatgctaatgtattggacatatgcttttgcaactaaaagttgctattcacctttctttcggggagggaatgccaggataattttcttctagataaatcacgacccgcactcttagcctctgtgctgcaagttgggctcaatttccactcaagagtggaccatgtgcctggtctaaacttatcacaatatcttgttttcctgacattatgcttgattcaaggatgaccttaaggcccaatcagaatcaaagacaaaatgagacttttgttttgtttgttttgttttgttttgagacagagtctcactgttgcccaggttggagtgcagtggcgcgatctcggctcactgcagcctcgaactcacaatgagacatttttagagacttctggataagagacttattactgaaaggagttgctgctgacatcttttgtctctgcagagaaggccagactgggaatgttgcaatttcaggttaagagatatggagcaagagaaacctcgccacagggacccagttttactccctgaattaagccatagctgaagccatctctactgcagtatttataaattacacagacaaattattttttgcttaggaaagttatctggtcacttggaaatgaaagatttatcacatcacatagcttagaaagactatggatgcctggaagacctggaccaacactgagttgggatgcgcacaccagctagagcagcactgttattgacgttgttgtcatcatcattctagctaaggttgccttttaagtgacatgaggaatatctgttttaattatctcagcaattctgaggctatgactatccccatttttcagatgaggacactaagccctgccttttaaccactgtggtattcacactagaaccaggtttccaagattagctatcagtagtcttttgaatcacattcagggttttttaaatactccagatttttccttcaagtatctgttcaatgtgttcagttctgaagctgttatcaattcaaccactgatctgctcttctttcccctctccagctgaaaagaatctctctctgtcctctaggctcatttagcaatttagccatcaattataacttacatacagatttagatataaatatagacagataaatacataaataaatatatagttatacacacacaaacatctctttctatctatatatcttatctatctatctatctatctaaatttgtagtttctcatatgttttaagagtgagtcttggtaccagaaaacatggattggcatcactgcttcataaaggcttgttgtatggccttaggcaaactatttaaactatctcatcagaaatatgctcaaaataatacccaagccatgatattgctgggaagattagatagtttgagaaagaactttacaacctgcaaaattctgtataagagattattatatttatttttactccccatagcactgaagctctagatgtagttggagctcaataaatatttgtggaatgggattcaattcaggggtgagtgacagcctatataagtaagaaaagagataagaatctcttgttggctttgatggcatcccaccttcccatctatacatgtcactttttcttttttgcctctttcttactactgtttacccttcatgctctatgttatatacctctgatttcttcaccccttcattttttttagcaaactccaggaacatgtcagagacatgctggtgactttctagactaacaggctagtgattctgagttaaactttgcaaattatttattcacaatcacaatatgctcaaactgtctttggaagttgcactaacaactttctgattgacagggtaggtgcctttgccaagtactcctatggccagaaattaatcaccagacttagggtgatgaactaactattggtggtcatgaatgcagttaacatacgctagaaaacaataacatgcactagaaaccaagggacttcattccattatcttctaccgtatgcaactttttatgattccttttttagtccatcaggataatgcactgtaaatcatctgctagacaaggcatctacaaagctctattaattcatcataaatacacacatgtgattgtgcacatagtatggttatcatttctgaactctaaatatattaagtttaactgatattcttcagcccaattgcccccatgcacaaatttgcacagtcttccaaaggtagctaattaatgaaggacatttttaatatttgctgagtattgctatttatgtgttattagaaaatgcacccctacctctgatttcccctttaataggaagatggctttcagtttggcacgcacaatttctctcatgctgatgtaaaaagtagttgaattatgaggcttaatggcatttagcatctttaatctccctactcacagttctgctggttatttagccaggggagttcttgtggaaatacgcagcatcttggtttatagtagcaaaccaataagcaaatgtacctgtatttgaagtgacaatgccattgaagttttggtcaccagctctaaagcttcaaatcagagaaaagggcttgtgcttggaatagtgcctctttacatttttactttcttattctccatcactttgtgggaactagataaaagatgactagggacagggccattactttctttgatggcttcaatatatcagaagggggcagcctttcgtgtaaagttcctcaaatgggaatactctcttttatagctagccaccagctgtgaaattgagactagtcaggaaatcagtgaagaagaggaaaatttaggcatggccctgggaaaagagggaagagaagaaaatgacaacttttttttctggtgtctttgacagtttaataacatctctttcatggtggaacacatgagctatctgtgccatggctccaggaaatatagtcaagtccaacatacgtgtttctgaacactagctttgagaatataatcaacacggcaaaaattatagagtatctgagagacagaaaattcaaatagggacctctttctatattggctctctacaatatcattaaaaaaatggtcctgaagcaatctctttgataaatcaacaactataatatctgatattttggtaagctgtatgaggatacaattttttgatctgtttcgttctcttttgccacttcagtgcctacaaaagctagcgtaagataggtactctgtaaatatttattgatcaatgtgcaataaaaacactggagagaagtatttcatttcaactccttccttctgaagagcacaaaggctttggagtaaaatacccagaaataaatctgcctttttaaaatcaagaattctttgagaagttgtcacaaaatatcagaaattaactgaaatgaatttaactgaaatgcatttttatttttacttttatacttttctagtaaaatgtaaagagttatacaaatttagaagaatatatctctttctatttatctatatctatttttatatccatccttttcaaatgataaattgcattatgacctattactaaatattccctgaataattagcttttcttggcaaagtttattgctgttcggtttggtttaacgtgtatatttcactttatactttgaatgataatttagaatcatagccataagtcacaaagtttaaagaaaagtgaaaaataaactgaataagagttaacagtaattctggttgttacagatcttctcaggtttaacaacgtaaaatatgacttaggttaggaaaggtttggaaaaaatgtttttaatttgacaagggcctctaaatataactcactttatatagcaatgtcccatttccataaccttaattgctttctctttcttccttttctttcactccctctcatctccgcattattctctttatgtattttgcattcaaagccacctactttcgaaacttactgcctagaagcagatagtgaatgtttcagaatttgtgtttcttgaaacagcatttttttcatagctgaattataataactggagaaatctgaggatctgaaggttgcagtaatttagtaaaagagatctggaatcattttcccagtgaaaataccagctgtactatgagggctgatttttcttctttgatgaattctacactgtgaaagatacataaggtgagtgggataccaggaaaggacaaggaagaaggaacgtggcttctagcccagcactttggtctcatttccatttatgaggacagagatttgtcagcacatcagcctatcttgggaagactgctcattggacgaatgtttagatacagtaagaacattagatccaacattatatgtgaagatattgatttgatttaaaaaggagaaagagaaagagagagagagagagatggagagacagagagacaggaccaagctgattgaagcaaagccaactggctgttagtttgcagggactctcagtaagctctttgcaaaaggtagcatagtgcagtggtttagactaacgcacagatatacctctgtcgatggacaactttggttcaaatcccagtttctctctttactagtattataaccctgggcaagttatttgctcaagagatacatctgcctcagcctcctgaggagctgggactacaggcacacatgcaccaccatgcccagataattttttttttttttggagagacatggtctcgctttgttgccgagactggtctcgagctcctggcttcaagcaatcctcccacctcagctttccaaagtgttaggattaccgagacgagccactgcacccagcctaaaccactactttaggcagtaatctacctcacttaatcacccaatgctatggcataaaccttgggcatatggctctagtcacattcctttaggaatattctcagttgcacttagtaccagaacacaataattactaaacatttagaacttcattggagagtaggtacatgtcttttccagagaatgtctcgagtagctaacatatcactaagacggtattttttacaaagcacacgctcactgggaaggtgttcactttattctcgaatgcttaaagaatgcattgaaattcagctttataaatgtgcctcaactatgggcttcctggtaaccaacatggaaaccaaacttgccaaatgaggagtgttttctttgggaagacagtcgaatgaggagtcaaaactgtggatgtgttaaagcatgttacatcatacatgtagccatgcccaaaagctaagcactacatagccagacagaaaacattttttccttcactttcagatataaattatcacctgtaacatttctgtagaaaaagagaactcacatacataagacagatttaggagcaagttgaaatagtcaaaggaagcttctgttcatagcagtaaaaataatgaacaattatacaagttaaacttttgtttatctttccactggaatggctaatagtttcttagtttaaaggaaatctttagattggtttccagtcaggaaaaggttgaccaaaggtaagcccctgatgtgaaatgttagacaaattaatgtgagcacttcagaattctttctttggtggacatgtatgtcaaagttgaaggtagttctttcattctccctcacccaataattaaagtcaaaaatagatatgaaagcaaacctaatcatacaattccctaagtattctactcttcttcagaatttaccagcattagggtggttaaattagaataccaacactgtcggccgggcgcggtggctcacgcctgtaatcccagcactttgggaggccaaggtgagtggatcacgaggttaggtgatcaagaccatcttggctaacacggtgaaaccccgtctctactaaaaatacaaaaaattagctgggagtcttggcgggcccctgtagtcccagctactcgggaggctgaggcaggagaatggcgtgaacccaggaggcggagcttgcagtgagccgaaattgtgccactgcactccagcctgggcgacagagcaagactccgtctcaaaaaaaaaaaaaaaaaaaaaaaaaacaaaaacactgtcacacctagcagtcatacacatggtagatcaataaattcttattgaatcaaatctgaataatccaacattaacaataataatgtttaacaaattcagtcattttcttccaattttcactgatagtcttgattgtaatgttttcattttgatattaaaaatatcctagttttattatgatttatatttctattctcagtagaggatgacaataggcttaaatttcatatagttgcccctgtattccatgcatgttcttccttacctcccttgtagagtagtagactgatttcatcttgacagtccagggcaatcaccccacccaacactgcaactcccttcttagcctgttgatttaaaggtaggaggagcccaaagtgtccaggtggcaatcttaacttccagtttaatggcatcattgttgtgtctcctggtggcagcattccttcctctggaactaagatctctaggccagcagaaggtaatgttgcaggaacaggaagcaaaacgtttgctaatggatcactaggggtgacggtgagtggtgccacttctacttccactccttgattcctcgaccctgaattctggctatgggagaaacaggaccatatataggatgctgattcagagcatacatggccttctggagaactttgtcccagctctgcagagtattgtcacatagttggcattgtaattgtgacttcaaaaggccattccaaaattctatcagtccagctccttcaggatgatgggaaacatggtaagatcagtgaattccatgagcatgagcccactgctacacttctttagccataaagtgagtgccttggtcagaggcaatgctgtatggaataccatgacagtgggtaaggcattccttgagttcacaaatggtagtcttggcagaagcactgggtgcaggataatcaaacccatagccgtagtaagtgtgtattccagtgaggacaaacctctgccctttccatgatgaaagatgtccaatataatcaacttaacaccaggtagctggctgatcaccctgaggaatggtgctatatcgcgggctcagtgttggtctctgctgctggcaaactgggcactcagcagtggccatagccaggtcagccttggtgagtggaagtctatgttgctgagcccatgtgtaacctccatccctactaccatggccactttgttcatagacccattgggcgatgacaagggtggctggggaaagaggctgagtgttgtccacagaacgggtcatcctatccacttgattattaaaatcctcctctgctaaggttgcccgttggtgagcactcatgtgggatacaaatatcttcatggtttttgaccactcagagaagtccatccacaaacctcttccccaaatttctttgtcaccaattttccaatcatgtttcttccaagtccctgactatccagccaagccattggctacagcccacaaatcactatataatcacacatctggccatttcttcttccatgcaaagtgcacaaccaggtgcactgctcaaagttctgcccattgggaagatttaccttcaccactttccttcaggaatgtcctagaaaggggctgtagtgctgcagctgtccacttttgggtggtgcctgtgtgtcgtgcagaaccatctgtgaaccaggccctagtcttctctttctctgtcaactgatcatggggaactccccatgaggccattggtacaggctggggatgagaaggtagggtggcaggagtggaaaccatgggcatttaagccacttccttatgtaccttacttgtgtcttcaggaactgctcgaacccgattatgtatatactacatccatttgtgatggaatgctgctgtgcatgacccactttatggctagatgggtcagaaagcacccagttcatgacaggcagttcaggttgcatggtgacttggtgacccatagtcaaacgttcagtttccaccaaagtccagtaacaggccaagagctgtctcttaaacagagagtagttatctgcagaagatggaaggtccttgcttcaaaatcctagaggcctcctctgtgattcacctatagggtcctgccaaaggctccaaacagaattcctactaccactgacacctcaagcatcattggatctgctggttcctatggcccaagtggcagagcaggttgcacagcagcctgcacctgttgcaaagccttctcctgttctggaccccactcaaaactggcagcctttcaggtcacttgataaatggactggagtaacacaaatgctattccctgactacaggatggtagactgtgatagatattgggcttacactagagaacaaaaaatcaaaatgctgcctactctcacatttcttatagactagtcaggaagacaaggcttaaataattacatgaatgaacacataattagtgctaattgctggaaagaaaggtacatatgagaagggaaccaaacttttctgagggtcaaggaaatattcttgtttaagctgagacttcaaggacagttttgggggagaaaagatgcccataaagagggagcagacagaaggaatatgcctgtataaagacccagtggaagcaggaacaggtgaaagaagactagaacacaagtcttagaccatttcctgactgagttttcatcttaaaagcagtgagaagccattaaagagctttataccaatgatatgccaacagcatcttttttttttttactggtttgactaatcagagactcaagttttttagttatttattgcttacgtaattccaggcaatatacaatatttgcctcatctttatggtaatttaacccagtaatacaacaatttgtatactgcatttgtattttgaatttgtactttgaaaagtgcatgcccatagaaggaacaggacatgtctcattgggttttagttcaaatgatctagctttaaaatatgttgaaaataatgtgactgatgaatcatatgtggtctgagcttcaaatacttttttagcaaattgcagaagggctattaggatctggggggtcagtgagacagcttgacaaaagcaaatgtcttgcaaatatatgtagaatgatacttcagagaaaatatagtctacagatactttttatttgattctgctaagcaaaaaagaaattccagaaatgaaatggtcacagaaacttatttctacttttacaaaatgaatgtagtgttctatgacacaaataacctaagtatatccaagagtgtcaaccttctaagcttttgggtttgttgaatttccctgaaggctttggatattatcagggtagataatccatatgcaatatttgaatgtgttctcaagctgtgtatgcatagtcctcatttatttcttgtcaatctgcaaagcagagagggaagagccagcctggtgtttagtgatgcctcttccatgggtttttgtacaatcctcttctctgttctgtctaataaaatgtagctaacattttacttattcttaaagacagctcagaaataaaagaaccatataagcctttttctgtttatagtgccaatcaattagagccttcaagcaattattgactaattaatagctgtcttagggaaaacagagaacttagaagggacttatatgtggaattaaagcaagttgactcgcacaattatattgctggtagagccaacatagataagttctgagatattgcacagtttgtataaattatttgagaaaggcttataaggaggaaagagagattcactgctgaattttttgttgatgatctattgatttgatttcaagtttacatttttgcatttcatggtaaaaatctatgcttttttttaaaaaaagatatactttccataataaaatagcatagtgctctgagaacattttaaagcccatgctttattaaagaaaagtgaaatgtggaattttgatctaggttctgtttatttttgtacataattatccactggtgtgccttggtataaatggtgtgtgtgtgtgtgtgtgtgtgtatgcaattattttaaatttggattaaaaactaaatttggtgcaatttttttcaagctgtatgttaacattatcatacagaatgagatctaaggacatccaatgcattagcctaaccaaagccaatgctatgcaatgtcgatgtctacaattctttttaaaattagcaaattaccagatgtttttggctactgaatatacgctcagccaaaagatagacacattagggagtaaaaaaagtataaaaaacatttttctgcctcaagaagttgtcagtctacatgaataaataatattttttccatgctgatcgtaatttgacactttaggagcctctctggtgttggcacagatctgtttgtttcagaagcactggtttgtctctgtacacagggtgcaagcgctgagagtgcgaagatgaggtcttgcagttgtgattcttggcacatttaagaaatagtgcagtgtgggtactggtccgtcagaatggatgttgtcatcaaccatccatgtggtcataccagtggcccgattcccagtgcccccatggtaacactgatttctgtgcttagcacaaagtacttgataaatacttgtgcttaattaagttctacaaagtaagatacacagataagtctttaccatctctgggtgaccaaaaaggagtttataatctgtatgttgcttttctttttcctagttaaaagaccattaagctattagagtaatggattacacactgtcgattacaagtagatgaatgtcttcacatacatttttcctttaaaaatcaatactgaatgcaattcagccaacattaaaaatatcctgcagttatattatcaaaaacattgaagttttaaccacactgccaaataaaaattttatctttttatttatggaaaatgtctaccattgcttagaatttgatgcattaaaaagcattgattctatcaggaaggaaaacctgctatgacctgagagggctaatccaatataggaaaattcttctggactttgagattttcataattttttaaaattctttttagcattcttttaaaaagcatgctaattatggaaaataaaataagtaatctttactacaattaaaaataatttttattataacaaaaatttcctcaatttaaaacatacaattaaaattaaattaaacaatgtcattttgcaaactgcttttttttcacttaaaacattattaacattgttcccaaaacataattcttatgggttgcatgaaagtcaattataacatatatttctaaactttccacttttaagtgtgaggtcattgtttatgccctcctgcttgtatgaccagttattccttaatataagttcatgaaaatgcaatggcttggtcaaaattatatctttaaggtcttcagtgcacattgccaaattacactgttcaaattattattattacgttttgagacaggatgatcacagctcactgcaacctcgatctcctgggctccagcgatcctcttgcctcagccttctgagtagctggaactacaggcactcatcaccatgcctggctactttttttctttttttgtttttctttctttatttatttcttttttttttttttttcggtagtaacggaatctcactatcttatccagattggtctcaaacttctggcctcaagcagtaggcttccaaagctctaggattacatgccccaccatggccttccaaaggtccaggattaccggtgtaagcttccgtgcccagcctcctttcaaattcttaagcatctcataggcagttctgtagtcactggatgaattggtaatagtcttatattacttggagaaaaagaaatggaagtaccttttcatcttctagttgaatttaaaagtaaacatgctttagtcttttatttttctgtttttacttttgccattattttaaactacagcgacaaaagtaaagagtttgtgataagtcaagaattgagctcccaatattttcaactctctttccagttcacatctggaattgtaacaataatcactaaaaatagccagatcaacacttctctagggcactgcagaagaaactttttgcagaggaaagaaaggagcatttcagaagtctcagaatttgattaatataattattcagctatttccttttcttttcttcaagatccttggtcaaaactggctcaaagaggacagaaatatgtatcacccaggtgagccatgcagtaactagtgtgatagaagtcaaatgctgctagttaggttgttggcggaattcactttacaaaggctcactctaataactcctttctcccggcaaaactggagaaatattgactttgtcggtgacttgagcagaatagccaaaggaactaggtgatatgcagaattaaacctctttgggttttctggtagaaataaggaaatgaaataaggatatggaaataggaaagagggctttcttgctctgttgcccaggctggagtgcagtggcacgatctcaactcattgtaacgtccgcctcctggattcaagctattctcgtgcctcagactcccgaatagctgggattacaggcgtgtgcttccacgcccatctaattgtgcgtgtgtgtgtgtatttttagtagacatggggttttgctatgttggccaggctagtctcaaactcctggcttcaagtgatcctcccaacttggcctcccgaagtgctaggattacaggcatgagccaccacacccagccaagatattaaaggtcaattttacttccactatcaaggctcgatttactcatggtgcaggaaagtttttgtcatatctaggattggccctttaccatgctcctcaggtagtaggtaccaacaaacaggcttattcaatagattcatggctgggtctaagactaagttgtatgtatttacatcatcttctgggattttttttctctccctgcagtgtgttatccaaaacatttttgaagctgaaaagttggctaagcttcttctctgaaccattttccaacttacagggtttttcagaagccaatgtcctgccagttttctaaaggtctaagtcagaacgtggtaaactacacaaattgattattcacgtggtgtgatctgcatcctcccactacgtaaaactccctcagcagcaggatcccactagtatccaaaatacatatcattcatgtcaagactttgggttgaagtctttttgtcaagaaattctcttttaaaatggaaatgggaagaaacaattaacagttcatttatctattgtctgtgacctgctcatatttttattttttggtgctttctgctttcctttattttttaaaaccgtgattaaatattactttcatggtttttaaaatttaatatttacatgtataacctaacatcaatgcattaatcttaacacaaactttaatcacttatgataagtttcatcagcctcacgacaatcgatatttggtgctggacaatgctctgtcatgtgtgggaaaggggaaggagagggttctctgtgcgttgtagagctctatctgctagataagagcaacagcgctcctttcccattttgacagctgaacatgcatctagacattggcaattgtcccctgaggggcaaaatcacccctctcaggttgaaaccacttatctataggtagtaaggcactgattcattcctccaatctggattgagctcctgagggatataaacacacagaagttcctgcttccaggtaatgcaattccagtggatgtaaaaacctcagaaagtcagagacctacaaggccatgtgtttcaatataagagggcaaaatagggagtaggcagctggctggaaggagaacccaaaggggcattctttcttctattcttttactcgggatttgcctcttcagagaaaaggctataataagtcatagctctaggaaaaaatctaaggaaaagggcacccccctggatggatatttggtagaaacttgtgccttctgggtgctttagattaagaactgatccacatatagctggctctttaaaattcttagaatgttctagatttattccatcattagtattattcagatcatcaccataagctgcaatttataattcttgtctcacattgtttaggctatttttccaagcccagtatccctgagtcctcctcttagttttggctattgatgcctctccccttcatgtctgggtgtatattagtgacctgctgactttggccttatactgcctattggagaggagacaggaactgaaacctcattgttccattttttgttactgccttcatcttaccttgacttgattcttcaacaacctatattacatgtgtttggtcattcttgtgttgctataataaataccagagactggataatttataagaaaagaggtttaattggctcacagctctacaggctgtacaggaagtatggtgctggcatctggttctggggaggcctcaggaagcttttactcatggcagaagatgaagtgggagcaggcacatcacatggcaaaaacaggagcaagagagcgtagcaagggagatgcaacacgcttcaccagatcttgtgagtactcactcactgttgcaaggacagcaccaagccatgagagatctgcccccatacccaaagcaccttccaccaggcccacctccaacattgaggattacatttcaacatgagatttgggcagtgacaaatattcaaactgtatcactacactaggtagtaatggaggtcttctatttgtttgacatttttcttttgttaagactacctgaaggatcaagggagagaagttttctactgtaaagactttagctatggaatgtatcacttccctctccaattctcatactggatcatcctgccaatgccttgtacatcacaaaaaagttatggtccttctcctggaaggatgagcaaattaaagcacaaaaacttacaggcatattactcagatgttatcgactaacaagtctttgctaaaaagatcaatcatatctttccaggcctttttttattccatccccaaagaaggctgacacctcccatcatttcctgacatttctgatgttctctggaaataaatagtccattagtctttgcgtgaaagaactttgccttgtctttaggtgggtaacactctgttcctcattataatagttttcctgggatctatattaacagcatcaaaccaaattattttctctattccagatattaaatttcctttttaaactgaacttgctcattatagacacatttattatgcctactgctctaagaaatacattcttccctcattcaaatccgcaccctcattttaaacatgccattctctccacttactacccctgtgtaacccttcacttggggatttagcttccctcaaatgaaagtcctcagtccattccgctatcatcgctcaatggggttttcttatagtgtttgcattttaaccagctacaatcacatttcattgattctatctcagctggtatattatttttgtcaatccacacatttgtgaagccatagatttctggggtagatctctgaaagcactgaactttacatacatgtaaatctgcaagcaagagcaagagaggacctaggacccaggtggcagatgccagaccaaaacttctgagttacagagctccaccatgagaaatctcagccaagacatggttttttcctttaattcttctttcagatgcttctcttaaggacaacatatttaatactagcatttgtatccatattcaggcactttaaaaaggttacaacctgtacagactacagcttttatggaatggtatgttttacaactattggctcctaatttagattactcagcacttacaatctttatggaatagatctggaaggtaccagtctcttgttcacttcatttatttatagtgttcacctaatagcgacctcctttcagggcagccttctacctataagaatttccaagtaatggaactaacattctgctactggattccagacacactcacacgggaaacacaattcaaatataatgtgttcaacttaaccaatctgtgtattgctacttcaagtggtgatctaaattagactaactcactggtgagttcaacagtggtctcagagcacagtgaatctacagaaatcttagagatcatttaacctgataattctcaaagcgtgatcactgaacctcgtgatcattgaatcagcatcactaggagctggctagaaatacaaattttagggccccaccccacatctactaaatcaagactttgggctgggtaatctgtattttagcaagcccaccagataattctgatacacatctgaaaccaatgatctaacttgttctgtttacagttgagaaactgaaacccagagtaataaaatgacctgctgaaagacagaatagaactatttggtgacaatatcagaatgagaacaagtcccaatcctctaccatttctcctacactgtcaatgaggttgctggctatacatatgcagggttaaaatcctgtaaatttcaacagctagagccaaatccttcctacatggcctctttcttcctacatggctcaggtcagcaatcttgcctggcttaagtttgaatgccttgggccattcaggagtctccgtgtttgttttttccctgagcttcgctttccttgcttggatattttgtgagcatctgaccagtacattcagccactttaaaagaatctcccaggccttcctttgcataggggctttgtgattttttttttcctgttttgtttcaccatatgttccccttttgaatctgagtctccacaagcatcaggaaagactcggtgaaattctttctatttttgccagaaaagtcaagctaaatgcaattccatctcctaaagtcaatttgcagaaggtgtctttgaaacggcctataaaattgtgagcaaatgaagtttcatcttgctgttaacgaggttgctttgccaaacctgtcagaactggatctgacccttttgtgttatagtgtctgctccagctggggctattggctgttaatcagaagtgtttacactttttcatgctcacttgatttccactagcctgcccaacttggtattcagagtgggttcattacaaagaatattgttgcagccctgtcctgacatttcactgtcaactggcagcgatgggtcaatattgcttttgctactcctcacaaagtagaaaatatgcgatcacaccaattaggtagtttaagcaatttttttctgttcaaccttccttttagctgccaaaactggtctagaatttaaggcgaaggcaaggaattattagagaccaaacccttggcatcgggtgccaaaaagattagcctagtgaaataccaacatctttagtagaacaaagatcaaagtcaggaaccagaggaaactgtgcagctctcctacaggcacgttggtgagaaatagaataattgatctagtagaaacaggtttcaggaagtcaaagaatattattaatgatcttcaagcaagacattcaacaaaatgctctagattcttctcaataagctcttctctgtttcatggttgcaagctcatttgcaaggtagagaacagtgaagatattctagagttggtttggtttctaagagcactgaatcatttaaatgtcctgtttattaactcagctcctctctattttgttttgatttattgtttttcctgaatttttacatctgcccctaaacagccttgttagttgcatgttaggcagtataacgttggaaaatgtgtacactttggagtcagtaaaaattggattcaaattctagcttgcttattttcatgaccttgtgtggcccttaagcaagatactatattgcacttagactatttatatctgtaaatttggaataaaaaggaaaattgataacgtttagtttttatacttttaaaaacaatttaccatttgcaaagcattatactaaataccgaggttaagagaataaataagagagacccttagtatgagagctaaggaagcaaagagaggggttacatatttttcattcaagacccctgatggggttttctgatgtaagtgagatattagctgagtctcaaaaaaggaatgaggtaggtgggtaagtatgttgagggaaagcatttctggcagaaaatagtctaagaattgcatggaggcccaagaatgcatggagtctcagatgaaaggagtgaacgcttttctatagacagcaaagctataactatggagcaccaggatgtatgatgggaggtaaacggtggccaggaataagcctagagagccagctgcaggcctcttgtgcatgtcaaggagctcaggctctattcttctgcggatcatagcccatgtagcaatttaaatatggaatttggtagtcaaatgaaaatttgcatttggatggtgtctcagtctgttttgtgctgctataacaaaatacctaagactaggtaatttatgaagaacagaaatttatttttttcatagttctgtaggctggaagtccaagatcaaggctctagtatgtttggatgtctgggagggctgttctctgcttccaagatggcgcctcaatgctgcattttccagaggggtggaatgccgtgtcctcctatggcagaagggcaagagaaacaaacttcctctatcaagctcttttataaggatagctaatttcattcatgagggagaggccctcatagcctcatcacctcttaaaggctacatctctcaacactgttgcattggggattaagttacaacataaattttgcagaggatgtgaacagtcaaaccacagatggatcaattaggtagcagggtgattagggcattagaggagagaaatactggagccagggagaccgttttacagtaatctatctgggagatagattttgatgccttccttaaataaagactgtcttagaactgatagtcattttaagaatgttgtgagtggtataaataatacagcagtgcagttccatctaaaaaccaggggtcgaaaaaccttttctgtgcagggccatatagtgtatattttgagctttgaggacatgtggtctttgtcataactattcaactctgccactgtggcgtgaaagcagtcatagacaatacaaaggcaagtaaatgtggctgcgttccaataatccaaatttaaatttcacagatttttcacatgtcaagtaatattattcctcttttgatttgtttataaatatattattttattttattttattttataaagcccaggctggagtgcaatggcgcaatctctgctcactgcaacctctgcctcctgggttcaagcgattctcctgcctcagcctcctgagtagctgggattacaggcgctgctaccacgcctgactaatttttgtatttttagtggagatggggtttcaccatgttggtcaggctagtctcaaactcctgacctcaggtgatccacctgcctagacctcccaaagtgctgggataacaggtttgagccaccgcgcccggcctgtctataaatattttaaaaagcaaaaaaaaatcttagcttgataaccatatgagaataggcaatgactgcctttgtgttgcgtgctgttatcgcccctgttctaaccattgttccttttttcctgttgtctctgggaaccatgccatcccctttctatggttcctaaaggccagtatttatgtaatggataacagtcatattctcaaccttttcaaatgagttttgctttatttctgccttgtttatgaaatccttttctttcaaatagtcattaaactattttactataatttattattttccttgaagtgttgaagttttgttcttcacattgaggctctcagtcgacctggaatagagttttgaatacagtgtgaactttgaatgatttgcttcccccacacctacattgataactagcgtccccagctctatttattgaaatgaccaggttttcctcacaattccaaaatcatgcttctgcatgtggaaaatctgcatgtacatgtgaacctgattttggatgcttttttcctattgcattggtcatttgcactcttttgctagtaccatgctgtctatattattgtagctttattataaatcttgatatttgggcaagaaaacacacctaacttattttttttcaaaaagttttttgcctttttaacattttgtttttgtggtatgcataccagaattagctcatcaagttgccactaaaagctcattggattttaatcgaattgctttgacttaatagatcgatttaagtacactaaacgtctttaccattgactctttttatagataatctttgcatttattacttcatttctttggatcttctttaatcactttcaataaagctttgtaattttctccttaaaaattttgcgcattgttgttgttggtgttgttttttaactaggccacttgtttttagtttttcctttccttgacatttagaaaattacaaaatataactgtgttcatgttaggcttctgccacttactaacaatagcttgaataacatttgtggcttgtaaaatattctttgagtttcaatgtgttaaaagtctcatccctagtgagtaaattgggatttactatataacccaaagttatatagtgccaagattatgaaacaaaagatctcatgtagatgaaaattaatgcagtaaaccttttcataaaaaggacttttacatgtgggtcataaactgcttctgagtcgaatttcaaaaaaataataaaaaagcccagaaatctcattatcaaaggcagaattatctaagttgctgttttctaaggaggtagacatctggctgtattaattcagtcatttttaatgaaacagtctcttactctctataaattcagagagttaatttatgtttacttaatgtttatttgcatgcctacctacaatctattatacatgtgtctttattatctagtttgtgatcatatcataaattcaaatttctattatttatctatctggaattttgactcaactttgtagtttacacttttttttcccctgttttgaagtggttatagattttcttgcttacctgcctttgtaaacatctaatctcctgttatcttactcccttggtcaggctgtcaataatataagcttattcagttttcctctatgtatcttgacttctacttccgaagcctctaattataaactgaaggagtttgccattttatcttttttcttcctcctaatgccacataaatatgaacttttcttttttgaactattaactccttctgaggttttcagttagcatggatagcttaccaaaattgcagccatccttagaaactgctctaaccctctctcctacatattaccaatcatcattttaaaacttgtagaattatcatgatgtaaatactagtgttcttagatctttttgcatgcctatattagcacaagtgtatatattgttctggtccaattttgcttccgtcttatgcaggagtaactctaaaacctttgtattccagggccaactaaatatttgagtcctgaatagtcactgggcacatttttctgtaattttcttactttttttgacttatcttcaaataaattgatgactttatcacttctctcatgcactaagctcttgctcttctgtgaatttccctgacttgggatcagtaatcatcactgcaatttttcaaagaaattaaaggtaagggagcatcacatattagatgaaataagtgtgtacatgtgaatctatccaacatatctttcattcttcaaatgaaaatagtcacatatttataatcctaaagagaggtctaatttctaatgagcacaaatgtgtttacttgaatatatgattatttcctgaaagtctctttggttaccagaatgcttttgtaggtattatgagtaaaatagaaagccttgatttgttcaggggaatgaggcattctcgtaaatatgtatttttatacaatgtagatagctgatcatatagggtcttctaccttatctcttatgattgctaattttctcaaatgtttgtgtctgcttccccttagtatcaaagtgtgtgtgtgtgtgtgtgtgtgattcaacttacaacatatttcttttaaatgctcatttttccctctcaacattatgccagcaggggatcagtgacacctggttcagtatacacattctacccgtcaaaaataactcataagtttaataaattttgtgcataatataaacagttaaactctttctttagtaatatgcctttattaaaatcacgtatattcaacaataagttgtctcatgcttacattaatactcaaaggaattacggtgcaaatacaaaagagacgactttttttttacaatgaaaaatactctagcaaacgagatttaacacaggttactttttatgccctattttgcaggatttagtttattttcaatgttaccacttgacaaaggaatacagtacctttttgccttatgccttaggtctattggtttaaaattgctttgcacaattaaaggtgcaggttattgtcacacttaacctggaatattacctagagttggaaatactgctgcctgacataatgcaaagtatagaggatagacgggcttttcctacctattgatcagtacaaaaagacacatttatgttgacaagaaaagagtatctaatggcctttccttggatgagtcaaaacacagtgcttttgaacatgtagctcacagatcactgcttcaaaatcacctgagaagcacctttatagtgtaatttcaaggactaattccagacctgcttgataaaaatctctagggatggagactgaaaagctgatatttacaataagatgactatagggaaaccaagacatactaaaatttgaggcaaccgtctaactgaaaagaacatgtgtgacagggtggttctagtcccaaatctagctgatgacagagaccttggcccattctattatttagctttgggcctctgctttctcatccattagaccgagaattaggagtaggtaatctctaattcccttctagctctaaaattttgtagatgtagcatttttaagacagtaaagaaaaggagaataggaaaactatcaagatgggaaaactaggtagaaagtaaatttcataaaacctataaagactaaagcaaaataaaagtttaacttaaaaagttgagattattttttaaaaaaataaacgtatttagaaaccctaaaatgtgaagttaatacacacacacacacacacacacacacacacacacagtttattctcttaaaacaaaaattgacaaagcaaggaatatgtcacagaaatctacagttaaataaagaaaaaaggaaaaacagaaaggaatgacactgcaaacattaggcctgaagagagaatttttttgattcaataaagagaaaacctaaaaagaagaagctaagctttctttagagcattttacattaaagagcatatgcttttccttcttgatttaatttacatagattgttctatttttcatttttcctctcattttatgtatgtttactaagaaatttatcactttgttttcttctgaattttgaaatttggccataatttatgtcagaacctatatttccttgtcaatatttgctaggtttgcagtagtgcttgggaatgtgtgaaaggttattttttttttaagtaaaggtggcatctaagatgataagtagaaaagttcttaattaattagcttgacaatccttctcacccaccactgctagattaattttattcgaatgtgttttctttatgtaactctgctgttcaaggactaagagcctcaacttggcatttgatgctctcggtattctggcttcatttcatcaatctgaccaaatgtctccttccttatcaacttcattaccccaattctgtcagtcccatctcaataatcagctagtcagaaagcttctcaaggaacagggaacatctgatagcttctatgtatatcagttatggtttcatttcagccacctaccagaaacagcaatggcttaaacaataggtggctatttttcttccctcccagtaataagtctgaaggaatgcagttgctgtaattttatttaagcaatgaccttttcctcatgtttgaaaagtggcacttcccattatttctgagttcaaagtagaaagaacagagaagggaggaaggttgcaccatctgtgcctgtcccttctttgtggggaaggaaaagtctttaccagaagtcccctccccagatttccactgacatctcagaggccagaatcacacatagtatgtccatttctagctgcaagggaagcttggaagtgaagtggtagcttccctgcttttatagtgcaaggcaaaggagaagagtatgagggaatggacaggggtcatccatctcattgtcatttatttgcttgattacattttatgcagattatacttgtgatatgatctacacagtcatcatataaattatctcctcaatgagtttgtatacttttcaagagcagaggatagtattcccagttggtatgcttcaaagtgattagctcaaagggggctcttaataaatatttattggcatatatttaatgcacactcatctgtttggggcaatatggtttactataaggagctgaagttctggaatctaaaaaaatggaatttgagtcattaatctcctatttaatagctatatcatggtcactgacttgtcaggtaacatctcttagactcatttatttttctgtgaaatggataaagataattaaatgtactttattaggtctgtttgagacataaatgtgaagatgcgggtggaagcctattataaacaattaagcactagattggaaaagttaagcactgttcttaatataatatttttaaaattctggaagaaaaattggctaagtgacaaatttgcaagaggcagtggaagttattctcttactgttatatgacattccttttaaagtggtacagctaaaccaggaaagagactgcaattacaactaagaagctactgcattcgatttgttaggctttcacaactgcttctacaatcgctaagattaacttgccatttgttctgatattattgcagctgcaagcagcatacaaagatgtggtactttagaagaaatttagaactccagaaaatattgtctaatcagcagtcctgctcagtagcggatagagaacagagtgtaaaacatttacaattatatgtggacaatagcattcagccatatattggtattctgatttagatactcattagaaaatgtaccccaccttgtctgattacagttggatgatattgctatccttactctttcactgagctacacttaatgactagactttatttgggatatcagagagtggatattacctgagtaagggcattacttatgaaggataatggaaataattatatgtgaattcagcacccaatccacagttgcttcctctgacaccagtcagtaatctcatgcagcttaatatggttctgtggttgaggttaggtgagtaattgtcgtatcaattaagtaaattaaactaatttttttagcttttattattcagatcacttatatttgcatactacaaagaatgcaatctttcaatctgggttaccctaagtttcactatccagtggaatgacagagaaaagagaaaacagtgtcatataggtggttttgatgagccaggcctggaagtgacccatagtaaattttctagaagtcagtgtgaaattgccacttctatcttcaaggaaggctggaaaatatagttagctctgttccccagaagaaacagaaatgcattttggtgaacacaaagcaattactactacacagtgctaccatttactatctatgtattgttggacaagttgcttaaactcccagacccaattttctagtctattaaaaaaaacaacaaaaaacaccataatacttgccctattggattttgtgatgtcaataagaatgacacatttaaagaccttatccagtgcctagtacaaagtaggtattctaaaacaatattatttctgtttagtactctatggaaagaaaacacataaacatacgtgatcattattctaattacttgacaatctagttgaagagcacattatatgatggcaggaaacatgaagggatatttgatgaatgccaaaatattctcagaagataaagatcgctatgaactaggattcaattcaggagatagttgtagtaaagattttaattagcccctgatggaggggtggaaagagaatttagatatttaatacttgatatcaatcattaaggagattttctagtttgtttctttatatcagaattgcttttgtaactggctcaggactttgcagatagattatgagagtaacatgtggggaagagcaaattaagtaagtatactggattaagtcattaagtcaatggaaatgtttgaaaaacaaagttatggccaatctatcagagctgtgatgacttcctgattaagctattatttatgacttccttctttttcaattccttttgaaacttctggaaattgggatagtgaagaagggaaaagaactttgtatgaatctatacattttcacgcatgttgaaatgctaaaggtcatttttttgctatatttgtcaggatggccaggaacaaacaccaaaatctcagtagctttacacaacaaagatagtatgtccaatatggaatagcaggaaatttgctccctatcgtcactaacagaggctctaggatcatttcatgctgccatgtccacatctcaactccatgaccactgtggcagggaaagagatgaccactctgagctacctcagactggatatggcatccatcacttttgctctggggccattaatcaggatttttcacttagcccctacttgcaaagggatgaacatgtctttccttgtgcccaggatattagaagatatccaggtacagtgagcacttgaagtccctacaacatcggggtaccacttaaagatgggattttcaagatctaattgggcaaagtctaaaggtaatgagcaaattcaaagtgaccatagagcgtactttttggcaataaaaatgctatctatttgactgtctgcctatagctcaaatctgaaccagtgaaatccgtggggcaaggaactgtcctcaccagagtcttctttagaggaagtttctcacatcttctcactttacaaagtttttgatttatttgattttagtgaaatcacttacataatcccttcattttgcgtggtatcataaagaatacaaagagtacaaaaatatccatctcttaagaagtttaaaatattgcaggtagagtttatattctatgacaatttgatatcaatgcaatgtaaaatgctgtgtaaaaatgatgcaaaaagcattaaaaacaaacaaaagatgattagagatctgggcttcagagaaacagggaggttttctgagagagataacacttgagtagggccttgaaattggatgagcagtgggaaagataaatgatattttggaaagaggcaagcaatgtgtgttgggcataaatgtaggaatgatagtgacttgcaacatggaggaacctccgggccctattttcaaggatttttttttcctatattttgagagcaacttctttataaagaaatggcttttctgatgctctatctcccttcttttctttctccctgtctctgccaccctaacctctcaacttctgtgtctgtgtatcacttaccattccctttataaaatcaggagtcagcatttctaatactctgttttaagtagtaggagttccgtcccacaaatattaatgagcatcatgtatgtgcaaagcaatggaatttggggataaatacacaacagaccttgttttgaacaccttatattcagcttgaaatctttacatataaacaatagatgctaatagtgaaagagaagcagagagaggagagtttggtttttgagaccactgaggacctggccttcccaaaggggacagagaagtgttctggagaagacgctctctgaaccaattcctaaagaaagaaggagatttatccacttggaaacgagaggaggggacctctaggcagagagtatggtgtgagtaaagatatagtagtgtgaaagagattactggaagttaatttcccagagatttgatattacttgtgggtacataagaaccacataggagaagtagtcaagaacctgctgttagaaggcactgagtgccaacttaaggaacaataattttataggtaagaaagatgccatttctgtcatgtctagaaagcaggcacttttatccttaaaccttgcactatgaactggcctaggtaaacatacattctcaaatttgcctgagggagtgataatttctaaaactaggagagtgggatgtaaaaaccaaacttggcttcgtgttgccatctgccctgagatatgtgcacaactcacataatttccttacatcaaattctaccatcagacaattgtccgtattttctcaggaaaatgaattcctgtgggtccagcaaatcccataaactccagtgagtatttgaagcaagcatccaactcagactgagagtcaatgcaacatgtttcagtaaaatgtgaatccaggctcacacagattgagacatattacttgtaaatgtaaataaatataaaggtgtgcttttctattttttgacaggaaggaatatttgattcatatgtttaatatgctttgcctcttttgccgaggtacaacataaggaaatgctattcatcatacagagaaatttcagaaacaaatttcttagaaataggaacaaccgatcagagagtgaaaggcgaaaaaaagtgaatacgatttatctaagggggaaatttagttgtgttgacaattctgtgtgttcagtagtttggaggtgttaggactgagacagacgaacagaggttttgatcttattacaatatagcagctagtatgccgggtggcttaagcaacattcactccatttgtaattaacatgtattaagcatcctaaggcttggctgtaatgttggattgggtctggggcaggcagcttcttcgttggatggagctgggtgttaacatggccaagattatttgcttggcacctataaggaccaacttttactgatgatatattctagaatttctggggcatcttgattttaaacattcctctctgttattacctccagcacaactttgctgtagaattttcaatctattatatgctgtggaattctgattacttcttatatctggacggggacctgaaaaaaaaaaatctttgtcaaattatgtgttctgaattttggtttggaaattataggataaaaaatgctagaagatatagatgactcaaatatcttgaactgaactatcttacaagaaaagcccataaaacaggagctaagttcatggtatgttgatgatatcactgtataaggtaggagtgacagccttattgtctggattttaaaggatttttatcttcaaaagggtaaaataggttaaatgtactggtttctaaaagaaatattaacaaatgtttattttctttgcttttaaaataccatctaagactgggcgcggtggcttacacctgtaatcccaacattttgggatgctgaggcgggtggatcgcctgagattaggagttctagaccaacctggccaacatggcaaaaccccatctctcataaaaaaaaaaaaaaaaaaaaaaaaaaaatatatatatatatatatatatatatatatatatatatatatatatataaaattagccagatgtggtggcaggcgcctgtaatcccagctacttgggaggctaaggcaggaaaattgcttgaacctgggaggcagagtttgcagtgagccgagatgacaccattgcactccagaatgggtgagagagcgagactctgtctcaacaaaaaaaaaaaaaaaaaaaaaaaaagaaaaagaaaaagaaaaaaaaaaacacctaaaatacctttggaaatactattttctgtgggggagagttggtgtatactgggtaagactgaccataaaactaaaggttagttttattcaaggataattcaaggatagacaaactcctttccatagaaaaatatacagcagaacaatcgttgaaattgacatggacccctctacacagggaattggcagcctttctcctaaaggatcagaagtaaatattttcggctttgtgagtcatgccgctttggtgacagccctgctattactgtctgaaagcatctagacaatatgtaaatgaatgggtgtggctatgtttcaataaaatcttatttatgggcccttacatttagatttcatataattttttaagttacaaaatcttcttttgattttttttctacccatttacaaatgtaaaaaaacattatcagtgcatagctatatgaaaacaggtggtgggctagattttccccaaaggctacagtttgctgacttttaagtagtgtaaattttggctttctttctcatgttccttctgttcagttttagaattttccccttttgacagagatttaggaatgtttgttgccaaagtggttagaataaatagtggtaaaatgttgtaggtatgtttaatcagttatgttttgtttttaattctcacttttattttctccacctataaaccttcagtgacccccccctcctgacaaccacatcttgtatcagtcactgtaaacttctgctgatttcagctcacagggtgtctttcccaggtgtgtgcctataccccgcacctggaagaaaactccctccctgccatctttcctctgaatagttcttaggagttcatcaaggtcccattcagttctcacatctagtagaaatctttatagccattccctaacatactgataggtacaaatatatagttttgtacctaattttttatacactctcacacatgtttttcagtactccgagaggcagatgaattctttcattaatacattgattaatttttcagttgccccttgatacaaagcatgtgtctgagcaggtgctggtgggtaaaatgtcctgactggctgatgtatgcagagatagtcctcttccaaaaactgtaagtaaactgtcttttagatcttcatgttgggtgtctcctattagctttattgaagaattacaaacagcaacagacaataaatagttcagtaattcaaatctactttagaattcccattctgacactaactgcttgattttagaaaagttaagtaaactgtttcagcctcaattttctcatctgtataataggatcactgatttctaccttgcaaatggacagaataaattacatgatatactacatggtttataatgggtactcagaaatggtagccattattagcttacttcagtgtgctgtggggtagtatgggaatatgaagaatataaatgattacatatgtgatttagaaacacaaaaactttggcatgaagtagacaataaactagaggagaaaacagagataggttttggcattggatttttttaaataagtatatgcttttccctacaagattttattgggagttgaggcattcatccacacttctgtgggttgatgactctcctgttgatatgcttacccagaatttcactccaaactgacataccccaatacttactcaatttctcttcagatctctcgaaattaatctggtataatttgctcttatctttgcaacaagccccttcctgctctagtgtctttggctcagtcaggtgatgccaccctgcactcagttattcaatccagaaacgtggggttcttgcctcctccatcttcctcatctctccccccatcccctgccaacatgcccaattaatcacaaggttcccatcagttctcctcttaactatattcttatcattttgtggtcatcactcatacctactcttgccttctacaaaattcattgctcccactatagtcagagtggctttgattttttttttttcatttttagtacaaaactggccatatcaatctctgcttaaaacccttcactaaagtttcatggctcttaggatggagtgtaaattcttcagtttgactgagcaggcattaacatgactgaacccctgccctctcatcagcctcttcttatctcacactctgtcttgctctctggactctagacatacttgtcttattttattacttctgtttctagagccttgatggttgttcctcttgtattgtatgctctgcatttacttaaatggatttgattgtggaaattgtttttcctttagaaaatatatctcataagtatatgttggtactttaaacattttgccatttttgccttatgtaatctcttgcacagcacctgtctgaatggttgaccagctgatgactgaccacttctgtcgaagagaaactaagaatccttctgcatgtaacatattatgttattttggggtgtttcacatcaaattactcaaagttcgtcttttgctttgttgctactacaaataagtctatatctgtcaggcattttgagtgataagaagctgttcttccttctctactttggatgttatagacaggatggacatcatgctggctgccatatctctaggcaagcctcctctggaaaatgttagtgatagggatgcttcatttgcatgatttttattattttcccctaatgtatctcatgggatgatcacaacagatctgtgatatacatgaaggaggttttcttttgtcttgtttttgtttgtttgtttgtttttgtttttttcttgttttgtttttgtttttgagacagagtctctctctgtagcccaggctggagtgcattggtgctagctcagctcaccgcaagctccgcctcccgggttcacaccatcctcctgcctcagcctcccgagtagctgggactacaggcacccgccaccacgcccggctaattttttgtatttttagtagagacagggtttcaccgtgttagccaggatggtcttgatctcctgaccttgtgatccgcccgcctctgcctcccaaagtgctgggattacaggggtgagccaccacacccatcctgtcttgttttattttatgcttaggaatctatttaatttaaaaacatgtgatgtaacctgtaaggtatcttcatagagttggtatctagtagacatcaatctatggatcaaataccctgagagctggtctaacacttaaatagctgtacccctcattctttcttctctcttccgcataggaaccatgagtttcctttgttatagtggtgaacttttttgtcacatccaggtggaggaaattctgggtattcgctgagagcaaacaaacggacacacgttgggtcctatactggtggtgttatatccaacactgggaaggctatttcctcatcatgctgctttcagggcacatggaaacactagaaaagaattattagaatagagttagaattccagttaggatagaaatgttgggaagtgtgttggtgtttgtgccgggatgttaagctcagggcaaagggattccagactgttctggaatagattatttggtaccaacgctttccaaatttttttttcttgcttctctgccagccttttggaatcaaactggaagttctagtaacacttgcttctgtcgctgccaaagtccctgctggtgaaattaattccctatgtgtttaatgcatataatttaatgttaaaaataaaatggtgagtcttaattgcttaggtggacgaagtgtactaaactgtaagttactgatattataggtctctttgaaggtgaccttatcaatgtgtggccttcagtaggaactctggctacttcttccaaaagaattgagtgttattctccagagatctgaaaggaagattgcatcgtgttcattagcatcttggttttctgacagtaaagaaatactttgtagcccaatctttttagttgcacctaaaaatattaggttggtacaaaagtaatagtggtttttgcccattactttcaaagttgcttgtgacagtgttgacggctacaccaacgatttgtctaagatacgcattttatcatgcaccttgaggataataccccagccttacattccttatagaacttgaagttgtgtctcactctttctataaatgtgtcagggaaaaaatagataaaaaaggaaaattggcaagcattttccctgtcaataataaaaacaagaccagaaagatagtcccttggtgaataaaatcttgaatataaagcatgttacatctgaaaaaaaaatctcaaatttcaacagcatgatggcatatgtgtctctataatgtatcctcagctgatggtatcaggggaacatgagacatttgagaaaatagtaacataaaaacgaacattggggcatgtcatccagagtggctactgagagaatactacttgtgagcaagaagctccctctcccccttttcactccgtttttaactcagcattgaattaaaatgaaagaaagggaaatatatatattttttccttttagcagaaaatgtcatggaaatgtcagagttctaggtgattacatctctcttaaaagtcgatagctgcaaatcatggaatcccttactacattggaaaatattaattttgagtaaaagcatcattttcctgagatgtgggcaggctctgaagctttggaaaggtgcttcagaatggagtgtaacccagagccactgaattctctgaatgactgtcaggttctgatcaatttatgtcagttgcagacagatttatgtaactctttctgtcctgccctcagatcacatcctttgagtgctctgctcattcctaagtgcttctgccgtttagatttacttgtattaataattctgttttcaagattcaaagcggtgggaacagcccctttagaaaatgacattcagagatgttacatggaaagaatggggcaccttcagaagcttctaagtctttttcctggctttaggcagaactgatcttgtgtcatgcagatcagtatctagtcaggctttaaagatccttgtcagtgtcttgatctttttgtacaagccagggtcacattccattccatttgttatcagagagtttctcttcactgctgttcctcagctgcaaattcactttctatatgtagcaggatggggaatagggctcttctaatcatcaaggaagtttggttaagtacccaaaattgagaacaattaaagacaagttcttctgatgatgaataagacccctcctaggagcctgtaaagattactgaaagggcaaaagtggtcagagctgcaagtgggagtagggtagggagaagcttagaaaaagatgtaatatactgggtttttcttagtttacagaaatttatgcttatcaatgtgtatacatttatatgcagatatataaacatatatgcttataatacagaataaaatgcataaaggtgagattttatatatatatgaatgaatgaataatttcaaatttataaaacatttgcaaaggtagaacagagggtttctgtatacccctcactgaattcccatattactagcaccttacattgtcatatgtctgtcagaatcaagaaactgaaattgacactggtatattagtaataactaaactctcagcattatttggatttcactagttgttcctctttctgtttcagaattcgaactaggataacacttggcatttagttgtcatggtgttcagtctctgctggtctgtgacagtttcttttggttaattttttttttctgactttgaggaatattggctaagtatgagatctccgttttggttagacgggactatcatattttaatacctgaaagtgaatcatagttgtttatataaataagattgttcttacaattcaaagtgactagaaattcatctatgccagagatgtcttcaaggagagattgagggaaatatggtagagtatgttagcaggcaatgtttgaagaaaaatagagtatttttctttctgtaacctcactgcgcttggcccatttgacaagccaattacatttgcatttgagaggggaaaaaagactgataactattccaagtatcaatgaacaagtatttagtgtctattaaaactatatactaagaggcattcagaaacagctcatccctgaaggagtttataatctagtagaggatataaaacatgttcccatgcaattcaaaatacaaacagataaatgctaaagcaattgagaaaaaggtgttatttgccctagaatcatgaaaatagtttgagaagttaacaatagtgaaaaaggactctagacagaagttggaggtgtgggagggaagtagaatgtgattctaaacatgggagcaacagaatactgggcttatttttggaggtaaggacaatactgcagaatgagatgcataaaggtaatttgcaagagaggagacaagaaaggtaaattgagcagaggttgaattaagggctgtaaataatacgctgggctaattactttttcaatttgcaaaaactggccttaacagaattagactaggtgaatatcatggtcaaagtattatccgacgaaggtgtactgtctggcagagggatgtggtaaggcttggtgaaacagattagaggctggagagaagacattaagagggacctacacaatgtatacatgtatggaagtatcacactgtaccccataaatatgtgtgattattaagtgtctattaaaaacaaaataaaacttaaaaggcagggggatgggcaaagagatagagaatagtggagttgagggcactcactcttgagagtccttatttattgaggagatgacattatctatagaaagagggaatggggaatattgaatgcttaatgttaatggctgtgaggaatgggataggggcttcgtcatccagaacttcaatgcacacactactgaatcgcattgagaatccatttgagatgaggacacaggacattttaagagatctaagcaatgcagttctttgcctctcactctttttcaagtttttgattcccaaggtgaaccttggttcacattcccctatgaccatatcttggagacaactttttatatgtttctcttctcctaacccagatttggaagggaagaagtggatcatttgtttttattgtcttatctttgctttcttaccgttctcttacttttttttaaatatcactactgaaaaatatgagtaaaatgttttttagaacattttagaaaagaaaaaaatacaaaagtaatgctatagtttatcagtgaagcatgaagagaagcttattttgcttactatttgaggcagttctggccataggatttaatggacttcattttgaaaagctgcctgccagatcaagtaacttctcattcatttgagccatgtctatatagcctaaggcctggctcaaaggtatgacagaaacctaatatgagaaatataattttattacagtgaatccatgcagggtattggacaaggaattatacagaaatcatttcaattgctatgttaaattagaaggttgtacaaatattttacattagagaccccttagtcattaaagccacaagcttgctattactatatatttgtgagcaaatatcatcacagacctgactcacattagaagggaaattctcatcacctctgtcatcctttagaatggaaaaaaaaacttattcataaactcataaaaatcccaacagaagaaagtttaaaaaccatggaatatgacctcctggcaaatcaacaaatttgtttttaaaaaaaacaaatcatggtgactgccttaataattatgcagaataaactatttgtttctatataatcccctccatggttgaagactgtcatctttagcagcctctttatcgtatttaaccaaaaaatgtctctctctaacttcgacccattggtccctagctgtctctgggatctgtacagataaatgtaataactatccctaaaactactcatcaaatattataaaagtgcttttattcacttactgggtcatttttgcaaaccaaacaccatttcctccaacattactcaaatgacatggctttgtttttctcactgtcctggtcatcttgtgtgaaacaatgtttaatctcttaggtttcatacaggaatttaatgctcaaaaatgacacaattcttcagctgtattctaatatattttgtactataggctgtattttatcaataccacctattgctttaccttcttttcagaagcgcccccagacttttaattcagacagagctttgggtcaacaaatttcttagatagcttctatatcaactgctgtcaagacaagattctcttgattatacttgtcctattgatttttttaactctaagtttttagacttatctctgctacatttcatctttttatttttttaattgacacagagtttgcatttgtcgcccaggctggagtgcaatggcacaatcccggctcactgcaacctccgcctcccaggctcaagcaattcttgtgcctcagcctcctgagtagctgggattacgggcatgcaccgctatgcccagctattttttgcatttttagtagagacaaggtttcaccatgttggccaggctggtctcaaactcctgacctcaagtgatccacctgcctctgctacctttcaacttcttgccattgttttaatctactaagagatactcctggccattctattttgtataaatatgtttgaaaattttgtttaggaaagatatctagctagtatccctgctagatatattagatatacatcccagactgtttttccccacccactgatttgatcatattccttttgaaaacattaaacttgaacatggccaatgtcagagctctgtgccactccagtaggcaactgcttctggattggttttttggtttgttgttgtttgtctcttatttttgcccagtggtaacatttagagttcatggtgtttgaaacattttcccttgagtatgggtgatcccaataaccaatgttctttggatgcagttgttcaagttataaatccaactaattgtacttatattttaccaatattaggctataaaatcagacattgtcaaagacctttcaagattcaagatttatgtccttattatgtgtaaaatgaatgagccatcattttctgtcatattcagagtttcctaatctaatattctataaaattttaaccttacctagaataaagaatccacgtcaagaaagcaagaaatggcacatggataaattttccctacgcaaaatccagccccagtcaccctctctctgataaattgagtccattggaaaaggcaaccacctctcagtgataagcaccagtcataaattaatatctaggacttgattattaaaattactacgtactgtgctggaaggaaagattctagaaacttgatggcttagattaaattgtcactacccactagacttgaagaagccattggaaaggccattgaggccccctcgtaatttatataaaggaactgacaacctcattggttttcagatttgccagttaattaaatggctcaggcatgtcattttggaaaagctttggatttggagactgaatttacttctagttcttatctaacttagttttatgactttggacaaaatttttcacctctcaaacaatttctctccttatctgtgaagggaggaggttggacagttatgaacaaagcttgtagctccaactttctattaattgcaggaggcaggaagggagctacactaactggagagattcactagttgaaattcttggttttgctgcagaccatagcctacaattagggctttgagactctggctccataactaccaaaggatgatgtctcgaacaggtttaaattaacccatcttcaaggagttcagtaatagactctgaaccgaataaatctcttcctaagcccatttaaagttgtatatagaagagaactggcacaattatttggtgacggtcattttcttctcaaaatttttgttcttgaagtgatttggtttttactctaagtttaattgtagcttttttcttcattgtaacattttaaattactttttagttatagcaaatgtaaattggagtcatattcagttgttcctggaccctctttgcagttttccctctgtcttaagtagacgatgtcggaggaaaaaaataggtaaccataatatgtggccttattatgtacaaaatgaataagccatcatttccagtactatcataaggagctacgtgagaaacattatagtcaaggagtatacacaagcatggaatttacactggcctctgtgtatatgctgaacgctagttactgattttaaatttcaaggtaacattttctaacaagggagactttccccagaggtattgcttctgtctcccaactcttcatatttgagtgctggtcaggagaagcctgggtgaggggatggagaaatagccactctggatgaaggctgcagagccaaccttcaggactgttgtgtctgtgagtgaaatttatagggcatggctgctagccgccaaatccattgtctcacagtgtcaacattaactaccactgctttttatgtttaacttggttaatatgtttagacgctgctggggtccaaatgctgaaaattcagcaaactgaattaatcgatttttctctgacaggaatgttctgtagaaatagatattgccacaccatactgtgagctgcttaacacacacagctgaaataactgcactggtgatgaacttgaatttgaaacagggattagaactctgtgtctgaaggttgggaaaggaggtaggctatggcaaagtttgggtctcaggagggctcattagatgaagattaagtgaagaagtcttgcctttctccactgccttattccacttactcattgcacctcattcctttctacccggagcttacaacctcactctgatgtgctttctgtgcttcagggtttggccactggcagagcagatgaacaactagcaaagggactgtacttttgcaaaaaggaaattatactgcccaactcatcagcttaaagggagaaaggacactcactgtagcacacaagcttagtaaacatgttgggtctctaggtcctccttggcaattgattcccatctggacacaactcaaagtgtgaactcgaatgtttacaagtctctttgcttttggccaaggttgtcttggaactgatacttatgatacccgaggcttcctcacaacttccttttgaagaggtactgatgcttcattttatgttacttgctttgccatgaaggggaaaagcagctcatccagaatagtacacaactccagacttgctaatttttgacttagagtgaaatatacctcatttagtataaatttactttccaagttctgtttttatttactaataataagaatttatttgcattccgtgaacacactcacagagaaaagagagcgattaaaagaggatcatcgaacataaaagaaagaggtcaaaaactaggcccacatgaattttaaaatttgtcctcaagtataaataatctatagtcaggaattcacattaataatttaatttctgccaccattctgagtttttcttcattttttcctactagggaccaaaagttctctataagaatgtccaaggttctggaaatggagttatcctatttgaacacaaatactcaacagctaagaggcatagaagtttctctagaagagtacattgttctacaatcagaatgggtattggggtcatgtggaaggcctattaaatcacagatttctggcccataccccaaatattttagttcggtagtccggactgggtcccaagaatttactttgtcagcaagatcccacgtgatactcatgctgctgctccaggttccaactatgaggacaactattctattaaaagacttatcgacatcgttggcaccagcccaggggttcattcaggaccttctctttctttccatcactgcccctattctaaacacttccttcaccccaaatatttcggttcattaggcctgggtgggtcccaagaatttactctgtcagcaagatcccaggttatgctcacgccacttatccaggtttcaactatgaagacaactattctattaatagatgtatccacatggctggcaccagcctggtggttcgttcagaaccttccctttctttccctcactgccccttattctaatttcttccttcactgccacacttttgattttaggtgaccaaaaaaaatgatcatagaaggaatttttgttcatgattactctcactttcgtgcatctagcaaccttagtgacagctccatgttttaaattcacaaaggacatgtaaagaagttcaaactaaaacataggggcttattttatctaagatgcctcaaacacttgtttccacttttcttatcctctaaccagggatctgcaaactgtagcccacaggccagctgtttgtttatgtaaataaagttttattggcacacagtcacattcatgcattacttgttgcctctggctgcagcggcagagttgagtagttgcaaccaaaaaagaaaataaaaactttgaagggtatattggagttggacatgaggaagaaatactacaggacagttaaatattttcctcacatgtcatcttaagtagtaagggaagaaactccggactaagaaggaataatcagcagaacttatctttccctttaaaatggcaccattctttcatcacaataaaacgagcattaggaactgaatcaggaaaacagatgcattctcttcaaagatgtgcagctggaagaggcaggagcttggcatttgcattatcaggagatctttcttccttttttgtttctaaagtgtggggggagagagaggcatggattataattgtctatttattgctttctttgttttgttcttccaacaaggagcagacaaccatgttttcttacgtggtttaatctcattacacagtttctctctgactaaagccttaagcgaacagttcataacgggattacatagattggtttattttccacaattttctaaacaaggttattcaaggataataccttgtgtagcattttcccccttatgttctattttctttttctatctctgcatctccccctttcaacttttgcctcaccttcctttccttttcctctaaccttcattttaagataccttctataagaaaaggcaaatctctgtccctccctttccctcaggattgctttaaagcttatcataatgtcagcaaggatttgggcattaatcagcaatgcacatgtgtgtattgaatacacagggaaagaggtttatgacaagaaagccaaacaaggtttcttttgaatccgcttctttccctagaaattgtaggttacaaaagagcattggtttcatctccccaacccatgcaatggattcaacttcaagggcacataacaattttttctgtaatgaaaggaacttaacatatatccagacagtaaatcacacagataagatccctcaataaagcattttttcaaagtcactccattaaccaagtgcatcctcataaattgaaacaaaattaaattaattacaggcttgcatcctataattaaaatttcatatataaattaattcaaatataaatatccaaatatcaattaatccttctcgtctgcttttgcacccaccttcaaagagattgtgagtaaaatagtacctttttgttacatagttttactcagaatggaaagactcattaccttctaagcttcaacagttttaagataaaggctgtggaaatttagttatgggaaaatgtcttagtatcagctgggagtttatttttcgcacttaaacttctgtggggtttgttctccagagtccttttttctgttggaacaagcttgtgagtagttttcaagaatcacaagctagtgatttcagtggtattacaatcacatttgttggtttagtgatcaaaatatatgtttactaatcagttgcctgagtatcacagaatattagagctagaagtaatattggtattattaatggtattgtaggacaggaccttggaaaactgactcaattaatcaaacatatatctgttgcacttctgctatgcaatgatgactgtgctgagaggcacaggggcataggcaggcttttccatctcattaaggaggcaagacactcgtggtttaaaagcgcaactaggcagacaaagagattcacgtgcagttgcatttggcttacgcagatcgtaagccattcatagagttgcctatgaatggggatacattatgagaaatgtggcattaggtgatttggttgttgtgtaaacatcatagagtgtcctttcacaaacctggatggtacagcctactacacacctaggctgtatggtgtagcctattgttcctaggctacaaacctgtacagcttgttactgtactgaatactgtaggcaattgtaacagtggtttttgcgtatctaaacatatctaaacatagaaaaggtactgtaaaaatacatgataataatcttatgcagactccatcatttatgcagtctgtcattgacgaaaatgtcattatgtagcatataactacattatgtaaatttagagaagagagaaatgtgagatagggaatctttttgaatggtgtaaaacttaagagattctctaaattgttaggctgtgggaaagaagcataatgtaaccgccgtattgattcattcatttattcatttattcactcaacaactatgaattatcctgtccttgtattctttgttttccttctgttacaaggagacatgtgctttgctactattggggtcaatctttcatttgggaactatagtcctagaccatcttcattgactttactcctgtagttctcactccctctttcctacttcattaatgtttctctctctacttcatcattacattaacatgctttggtgttgtccaccaaagaacagacaagcaggcaaacaacctctcggctctacctgccaccacagacatctccttaatacctgctcctattcacagcaaagcatcttgaaagagctgagctgtgttcacagtctctatttcttcatttcccattcactctgagcccctctgatcagattttcacctccatcacttcatcgccaatgacttctgcatgctaaatgccaatgtcagttctcaggtcctgcctcatgtccaaacatgttttaatgcaggggattacattcttgtgggaaatctttctttggtgcttccctcctgtctctcaactcatcagcggctcctgttctattttctttgctggttcttttccttacacctaactcactcttcaatgtttgctgtaaacagagctggctctgggtcctcttcttttctcaatgtacatactctctctaaatgatattcatgacattacatgtcatttagaagctctaatgacaaccagcatgtttctctccagtcctgccctcatcccacatgtttgaagttatccaactacctacttgatatctctgcatggatgcctagtaaacatctcaagctctatccagagcacaattctttatttctcctcacaattttttcttcctccaggtgccatatagatggaaaaccataaaaaacttttgcttcctccttgacttgtgtcttccacacattcaattcacaagcatatcctcccagccctacttccaaaatagatctccagtctaactttctctattttatgcctagcctgacccaagctcttaattgttctcctggaatattataatagccttgccaattagtctctctgcttttttttttctgccctactgtagtcattcctaatatacaaaaaccagagtgatctttctaaaacctcaattaggttgtccctttcttaaaacttttcagtctctctccactgcacatgatagctaaagtcctagccaaagtctccaagtccctataggatctggcactcaccttgtaccttcccagaaaaatacagttagccctccgtatcatgggtttcacatccgtagatttaaccaacagtaaatttgaaacaaaaaaattccaaaaaacaaatctgaatttctcacatgctgcgtactatgttgagtctgtgtgaatgaagtaatgtgtaggtcttgtattaggtattatataatctagagaggatttaaagtatatgggagaaagtatgtagttagatgcatatatgatactattttttgtaaggacaaaaaatgtgagcatctgtggattttggaatccatggagggttccttggtatcatggaatctccagggatactaagggacagttgtactagccatttatttctcagtccatccctctcacactaccctcttctctgttcctctgacatatcaggctgttctttatttcagggttatgatcttgttgggacctcttttcatatgcctccctataagtaagttcctattttacatcttacttctgcagagagatgtcctcaagtagagccccagttattctttattgcacaaccctatacatccttcatagcacttttcctcctttgcagttacttcatatttttatttgactattgatcatctcctcccttcagaattaaggtctacaaaggtaaagacttggtctgttttggtcactgctgtattctgagcccctataacagtgcctgggtgagttgggtggtcagttaatactagggatgagtaaggttcctgtgcactgttagggatgtggagattcacaagacatcaacactgccttcaagttgcagacaatcacaaagggctaaaccattctccttaggccttgtttcttaaatgcaaaatgagaatagtgtgattttatgatgcgttgtatataaagagaggaagcaactaaaattattttgttttataagattaggttgttcagttgagcttccccatgttatctctgcagagaacaacttctttctgtagagaaaacaaaacaaacaaacaacagcaacaacaaaacattccacttgttgcttcttgaaggacagggaggtaaagcaaatgagacaactctcgctttggagtgaacagaggtggtcttcacaggcaagtgtggtcttcaaacagatttctacttttcttgcttgtgagccagagtttggaagtgtacctggtcatttgcttggtgttaccattccacataatgctctttctctctctctctagtttcattttgactggagagtgtctgcaatgtcacttcctgcttttccccacattttggtggccttcctggtgtcctgtatgttcatgattctttctagccctctctttttctttcagaaaactctgaggttctgtaaaatttgatgactctgccttgtaaagtatttgatgtgcttttatgactttctgggaaaaagtattttcctttaccctttccaattctcattctctatttccacatttgagatggcatcaactgtgaaaatggttcacatcttcccttttgctgtgaatttttcctaaattagagcatttcatgaccttgaaagacttttttttcatcaaagagcagaatcttcaaaactgtttgcctttttctcatagaaaatttatcatacttggaaacattctgttatgattaaattttcaaacataattatgaccattgtcaagaaaagattctgcaaaccactcacatccaagagacttagcatccaatgtgtctttcactgtatgcaaagtgttattttaaacatgtcattgctttcctgggtatattctgatatatagtatttgtttttcaataaacttggcagctggctgcaaatatgtgcctgttacaaacttgccttcatctgtgtgtacagccattcatccagtcatttaattccacagatttctgttaataactctgggcttgtaggtcaattataggcagtgaatgtggctttcttccaagttataaccactccctacccacacccctacctccaattcataaatggaagctccagagccctgggagaacagaggcctgcaaggaaaggaagtgtcctggcagttttgcaggtagcagcatgagtagggaggcaaccctagtgtataatggactcctgctggtgttattctttggaagagctggcctgagctagaacttctgtctcagattcagagtcacttcaccacatcacgtccctgaagctgcaagtgttattaacattaacctaagttgggcatctgtgcaaacttgttgccaggtgcttgttgtgtaccaatgatgacacaccggcaatctttgaccacccaaatgctgggaaaggatttgttacactctctgaagccattttcttagcggtgcatggctgaaatagtagatttaaattggtgcagccgtgaggatattactatgagacagaggagatctaggggaatgtctactcactttcaaaattattctgtcttttcaagaactggaagaaatttgaattaatcaggcttttcaagaatctcacggaagagcaataaataatctaccatttgcccatccgtatgttaggttcagtgtttttattttcttctggctcttttcttataatgatgaactttatatctgttgcataattctttattacaaaagacaaaaacttctacccacccacctccacctcttttggtttggccaaacaagtttctgacactgctgctggtattttttcattttttaagctgagaaaacaatgactagatccctatggaaatgtgggcattactaagtcttagttagttagaaccttactcagatactggagggtggattagggggagcaactagcaagtgttgtgagaggagaccacatgtaaaatatttctaatttaacaagtaagagagggccgagcatggtggctcatgcttataagcctagaactttgggaggctgaagcgggtagatcacctgaggtcaggagtttgagaccagcctgcccaatatggtgaaaccctgtctctaataaaaatacaaaaattagtccgggcgcggtggctcacgcctgtaatcccagcactttgggaggccgaggcgggcagatcacgaggtcaggcgatcgagaccatcctgactaacacagtgaaaccccgtctctactaaaaacacaaaaaattagctgggcgtgctggcgggtacctgtagtcccagctgctcgggaggctgaggcaggagaatggcgtgaaaccgggaggcggagcttgcagtgagcggagatggcgccactgcactccagcctgggcgacagagcaagactccgtctcaaaaaaaaaaaaaaaaaaaaaaaaaaattagccagacatggtggcaggcacctataatcccagctactcaggaggttgaggcaggagaacccaggaagtagaggttgagctgagatcatgccactgcactccagcctgggcaacagagcaagactccatctaaaagaaaaaaagtaagaaaggatactttaataaaacctttgcaagaataaaaacaacattcctatccaaatatacctttagaaatctgttagaaatgtgtcagtcgtgattgaaagaagatatatagtgagtgtttgggaactccaggggttcatcctataaaatgcttacacagtgagacagagaagggctatgaattctggggatcgaattccttacagcctgaatgatctaaatgtgaggtattatgaagaaaaagctcagtctttttaattagattctgagctatgctatcttaagcatctgacttcattttactgagtgtctgtttccttattcgtaagtaggaataacaatagtattgataggaattttagttaagataatgcttataaatttaagaagcatagtgcctggcacatagtaagatacatggtaaatgccagaaatccaagaaatgaagtcccatgcaaagctgcttagcccaaacaaaggtgatgtttactagcttctggacagacctttatgacggtgagatttttttttttttacaaatcttgcagaacacttgcactttcacctgcttagttaattcttatcatatctctagaaagaagcaatgagaagctaagacttggatcagaagatgatgatattgcaagaggttacacttaaacattactcctttgattcatgtgggcctactaccttgtacacagcaagtcatccacacatgactttaaaaagctgttgtttatgtagtgttccaggtgccctttgagaggaatcctcttaccaatattctagaaatacacacctcgagtactatgcccttagtatgccatggctagctgtccattttcaatcaatcccagtgctgcaccctggggaatagactctcacagcaaaacttttctcctggcacctctagcatcttaggtcatcagccatcagcacctattcggaggcctacttttctacacaagttttggccggaggggagcaagtgagcattatactttttctaataaaatcctttaaaaataaatccattcatgtttgggacacttttttctacctgtcatttatggttgctaatgtgtagttgttatttaattgcatgtttatgttaaacattccccatgccaacatgatagccgcaggcttgactaataaaaagagagagaaagaaaaaaaaataaaaaacagaaaaagcttagaggaaagatgcatgagtaaatggaaataaaatgggatatttcaataggaggtctccaaaattgatagtttctaggaaaacgcatcaccttgcactgccagtggttctttcttagcttccaactaatttatactctagtaaggtactgtccttttcttcacccagccttgctaatttaaagaatcttaactggggggaaaatgctaatcttattttgggcctacccattttcccaatctcagtttgatgtcttcctcggaatcggaaggcttccctggagcttggtgtgctgggcttgtctgtgctgtggctttcagtctcaggccaggttttacaaattttgtcgcattggtctggaaaagaggtagggtggttgacttgttttttaactcaatgcaaattaatttatgctttgaaatttgctgatcttctcacctcaattgggaaaatgtctgactatattgattggccaaatgaaggactcaaggactcaaggaggtcgagttcattttagaggcttcttaaattgtcctaaattatcccactttggaaagcgcagtcttgtgacagtggcattaaggtaaagaaaaacagcctctgctccagctctgattaggccctgtctccttccagagtctttctctccaatccaaagccttcgcatgtacaatttcccctggaaaaatctccttcacaacctcttccaagtgactcccattcatctttctgatgtcaacttcagcatcattccttcagagaacttccccaaattcctagtttctgctagcaattatcaatccttgttctagagctctgttcctttgagaataaattactcaattggtaagtaaatattcataaatattatgaatgaatgagttaggaatgaagtataataatgaataattcattcctatttcttcaactacagcgtaagttccaaggaaatagggactatgtcaatttttgctcattgttctatcctcagttgttaacacaatacttggcacatagtaagcaattaaaaaatctgttgaataaatgatcccaatgttcaacatgtacatagcccactggataatttagtgaaatttgacttgcatgcgtaataaagcaccagagagaatctggtccccactgggataccagcaaaatttctgttttgccatttgggaaacaccttgacatccaacaattcaaagtcaaaattcctgttccacgcaggtagctgagtaaatttaaggtcaactaaaactggactcactagtcatttcattcttggttgctcttttctcctgttatccttcttaatggatatatcctgccttctcatgacttcaaatttctgcattctgatcatgagcattcctgtggtttcacgctcctatttgttcttctgctaatgatccttataactgttttctgcttatttttatagattgcttgatcttctttactaggttgtttatatttctaaaagcatctgattgattgcacttctccttgcatccctgctaaacttaatgctttctattgcccttttcatttctaaagtttaactgagatgaatttcaatttcactttcaggaacggtttgcaaactgtggagttttctttatttctgaccaggctgttccccagggataattttaatttttcaaataattagaaattagtaacctttctgtcagtaaaaataaataaataaatcaatgaaaagcattctggacataaagacctaaaatttcatgtcatcctcagtttgttcattctttctctttcttcctttcctttcctgtcctgtcctgtcctgtcctgtcctgtcctgtcctgtccttcaattgaaggtctgtctatctaaacacattttgagagcttatcttatttggggctcatcagcaggatccattcattctgtttatcctcaaaatctagatgattttctcttctggtcctttgcaggaataaccagcaacaattggcaagagggctggttgtggcagtaggaggtacgctggcactgaagatgcccaagttcttctttttatttctttctggaggaaagccagtgccattgttggcagatcctgggctgaaaataaggagttgtcaccttacctctgccctaattagttgtgtagcctcagtcaaatcaattcccctttatgcactttaattctgcccatctatacaatgatggaggctaaattaaattaattcaaagaccccacaatgccaaagattccaagaaaattgatgaacttttgatttttaaaaaatcaaatgaacctcaatttgcaacaatattcagtggtttcactgtcaaattgtagtttctaaagaagaagtctaggtttagcccaacctagagtttggctgttttcccacatgactcctgagaatggaatagcctctgactctcctccaaacactgtaacagagacaggagtgccagatatgttagaaggtataagcataaaacaataagtcaatgacactgaaaacatataaggcactaggtaacaccaaactgagaacaggagagagataagagagtgctgtaacgctagcacagcccctgattctcaggaggaattgtctgtgaaaggacagactgagctatggagggacacacagcaaccctgctcatggcaggtggatggcgtagcactcctttgccagacatgacattcagggagatgcaataggagtatatggaggatatctttgttgggaggagtcactctcttcagcattaaacatctcattaagtgacttcctcaatttcagtgatgtccagaagctttcagagataatctgagcagtcagtgaactgatgtgtctgccaaggcatgaatagcatagattgttcagtgtttgccctgggtctatcagcagtaataaattttaatcggttaggcactttttaagcatgctactgtttgccaaacattatttttggcaggcatctgtaacaaaacctaatgcattatgcatattatttctatggtatttcattgtattagcacatgtagtatttgtatggaatttttgtaaattcattaccaaagtagtatcacattaattattctggtttaaaaagtattaggaaaaaaataatcctggggagcatacatcatatcatggggaagtgggaatgatctattgtcatttaaattgtggaaaaatattagcatgtatacgagaaaaataacttataaaagtacacagcaagtgtggaaaaagtgaattattaaatacattggtgtttccttaaatactgaatgcctaatttcagaattctaatgacaatcattattacagattttactgattggttttatttaacagtataacttagtggtagagacccataagacttatttcatttctctgtgtcgtatttctttggtatcttgatctgctaaatcatactttctcactctttttcccccttctgtttctgtccatctctgaggtgcagaggtcctgggcctttgaactttgtataactctttcttcttaaatccctagtatagggaaactataccatagtaaaattatctatcttggctggaaactactccaataattcagttctccactgaagtgtaagatttagctctattaagtgtctcttagtatcactcttctattcttataagatagggtcatgaaaattagtagtaaattattttctctaccctactggagattatattatttccagtggtttctagaaccttgatttgtcttgttcttccaaatttgacaaataatgtctagggcactcttccctttagaaactattttacaacacagtagtttatcattgtcaggaaatgttatagctattcttcttttcacaggttttgattcagataacacctctctccaagaaactcaaaaatctctgcaaatattgctttccatagcttcacaacagtcctttgatgcagggcaattctttctcactgctactaaaaaaatgaacaacctttgccctacgcaacactgtgctaggcaacaagtgactgaaataaatgctcaatttaccttttagaaatataaacccaaaggcatcatatttgaatagtcaggaaaataaaatacacctactgtattacatagtattaaaaaactgattatatattatttgaattacatgaaattatattatttaaattagaaggaaaaacgtatttttttaaagcagagacttaatacatttatcaggataatgacaatttataaggctaatggctattacacttataaattcagttatccatattccatagaacataagaatcgagtctttatttcattccattcagagctgcacagctagtgcaaacttttcttcaatatttctacataaatcctccttcctgactcacgttccattctgactatgaaaaatcaataagaccttgaccttgttgctttcatgtttcatgcactaattcataactagaattaaactccccccaaaaaagtcaatcaccgtgaacgggagccaggactagaatgcacctctagacagagcagccggcagcggctcgcattgtgaattttagctccagattgactacaagagcaaactaacaatcccaagaggacacacagaccctctgacggaagtggactgctcctgcaggacctgggagacaccgcaaatactgtgagcgccccaactgcggaagcgggaaaaggagaccctcctctcctgaacacacccccctaactggagaagctgaagttctgtttgcctgagaaatttctgactttacctggagctgagtcaattaggagagccaagggaaatacagaggtagaggaagcagcagcaaggccctgggagcccgctgggttctggagcaggccattcctgcttggcaccacagggatccaacgagagaggaccaggggctaaaactacacggggagaagcaaatctctagatgaactttgtaaaaatttgaacggggtgagaagcctcctggacagaacttgggggagggcacgaattggggatacagactccacaggcaggggaaaaccaagccctttactttagcagctgggaggcggatagcctggggcaggttttcaagcccatattgctctctgcctgggaaaggtctgggggctgttggggcagacacagtggaagtgagaccagccctttggtttgcgtccagagctgggtgaggcctatgactgccagctttcccccacttccctgacaacctgcatgactcagcaaaagcagctgcataatcctcctaggtatacaactccagtatacaactcccatctcccacagcagcaagacccaccccagagagtctgaactcagacacgcctagactcacccccacctgatgatccttccctatccaccctgatagcggaagacaaagggcatataatcttgggagttctagggccccgcccaaccactggtccctctccatgctacttacagctgattctttctggaaagcgccacctcctggcaggaggccaaccaacacaaaaatagagcattaaaccaccaaagctaagaactctcactgagtcctgcacccccgccacctccaccggaacaggcactggttccatggctgagagacccatagacggttcacatcacaggactctgtgcagacaacccccagtaccagcctggagccaggtagatttgttgggtggctagacccagaagagagagagcaatcactacattttggctcacaggaagccacatccataggaaaagggggaaagtaatacatcaaaggaacaccccatgggacaaaagaatctgaacaacagacttcagccctagaccttccctctgacagagcatacccaaatcaaaaggaaccagaaacccaaccctggtaatatgacaaaacaaggctcttctacaccaccaaaaaatcacactagttcaccagcaatggatccaaaccaagaagaaattcctgattgacagagaattcaagaggttagttattaagctaatcagggagggactagagaaagacaaagccaaatgcaaggaaatccaaaatatgataccagaagtgaagggagaaatattcaaggaaatagatagcctaaagaaaaaaaaataaagaatttaggaaactttggaggcgcttttggaaatgtgaaatgctctggaaagtctcagcaatagaattgtacaagtagaacaaagaaattcagagctcaaagacacgatcttcgaattagcccaatccaacaaaggcaaagaaaaaagagtaagaaaatatgaacaaagcctccaagacgtctgggattacgtgaaacaacccaaactaagaataatctgtgttcctgaggaagaagagaattctaaaagcttggaaaacatatttgggggaataatagaggaaaacttccccagccttgctagaaacctagacatttaaatacaagaagcacaaagaacacccgagaaattcatagcaaaaagatctttgcctaggcacattgtcattgggttatccaaagttaagatgaaggaaagaatcttaagagctgtgagacagaagcaccaggtaacctataaaggaaaacctatcatattaacagcagatttctcagcagaaaccctacaagctggaagggattggggccctatcttcagcctcctcaaacaaaacaattatcaggcaaacattttgtatacaatgaaactaagcatcatatatgaaggaaagatacagtctttttcagacaaacaaatgctgggagaatttgccattaccaagccaccactacaagaactgctaaaaggagctctaaatcttgaaacaaatcctggaaacacatccaaacagaacctctttaaagcataaatcacacaggacctataaaacaaaaataccagttaaaaagcaaaaacaaaaaacaaaaaaaaacaaagcacacaggcaacaaagagcatgatgaatgcaatggtacctcacatttcaatagtaacattgaatgtaaatggcttaaatgctccacttaaaagatacagaaccacagaatggataagaactcacaaactaaccatttgctgccttcaggaaactcacctagcacataaggactcacataaacttaaagggatggaaaaggcattttgtgcaaatgaacaccaaaagcgagctatttttatatcagacaaaacaaactttaaagcaacagcagttaaaagagacaacgagggacattatataatggtaaaaggccttgtccaacaggaaaatttcacaattctaaacatatatgcacctaacacactggagctcccacatttataaaacaattactaattgttttagtaatgagatagacagaaatgagatagaaatgagatagacagcaacacagtaatagtcagggacttcaatactccaccaactgcactagacaggtcatcaagacaaaaagtgaacaaagaaacaatggatttaaactataccttggaacaaatgaacttaacagatgtatacagaacattcatccaagaaccacagaatacacgttctatttaacaatgcatggaactttctccaagatagaccatatgacaggccattctctctcagaccacagtggaataaaactgaaaatcaactccaaaaggaaccttcaaaaccatgcatatacatggaaattaaataatctgctcctgaatgagcattgggtcaaaaacaaaatcaagatggaaatttaaaaattctttgaactgaatgacagtaatgacacaacctaccaaaatctctgtgatacagcaaaggcgatgctaagaggaaattccatagccctaaatacctacatcagaaagactgaaagagcacaaacagacaatctaaggtcacacctcaaggagctagaagaacaagaacaaatccaacccaaatcaagcagaagagaggaaataaccaagatcagagcagatttaaatgaaattgaaacaaacaaacaaacaaaaaataaatgaaacaaaaagctggttccttgaaaagtaagtaaaactgatagaccgttggcaagactaaccaagaaaaaaagagacaaaatccaaataacctcactgagaaataaaacaggagatattacaactgacagcactgaaatacaagagatcattcaaggctactatgaacacctttatgcacataaactagaaaacctaaaagagatggataaattcctggaaaaatataaccctcctagcttaaaccaggaagaattagataccctgaacagagcaataacaagcagtgagactgaacagaccaataacaacagcaagactgaacagatcaataacgagcagcaagactgaaattataatttaaaaattaccatgaaaaaaaagttcaggaccagatggattcacaccagaatcctacgagacgttcaaagaagaattggtacctattcttgtgacactattccacaagatagagaaagaagaaaccctccctaattcattctatgaagccagcatcaccctaataccaaaaccaggaaagggcgtaaccaaaaaagaaaactacagactgatatccttgatgcacatagatgctaaaatccttgacaaaatacttgctaactgaatccaacaacatatcaagaagatattccaccatgataaagtgggtttcataccagggatgcagggatggtttaacatacacaagtccatgtgatacacctcataaacagaattaaaaacaaaaatcacatgatcatttcaatagatgcagaaaaagcatttgacaaaatccagcattgccttatgattaaactctcagcaaaattggcatacaagggacatatcttaatgtaataaaagccatcaatgacaaactcccagccaacataatactgaattgggaaaagttgaaagcattccctctgagaactggaacaagacaaggatacccactctcatgacccctcttcaacatagtattggaattcctagccagaacaatcagacaagagaaagaaatgaagggcatccaaattggtaaagaggaagttgaactgtcactgtttgctgatgatacgattgtttaaattgaaaaccctaagacctcctccagaaagctcttagaactgataaaagaattcagcaaagtttccagatgtaagattaatgtacacaaattagtagctcttctatataccaacagcaaccaagtggagaatcaaatcaagaactcaaccctttttacaatagctgcaaaaaaaagaaaaaaaaaacttaggaatatacctaaccaaggagttgaaagacctctacaaggaaaactacaaaatactgctgaaataaatcatagatcacacaaacaaatggaaacacatcaaatgttcatggatgggtagaatcaatattatgaaaaatgaccatactgccaaaaggaatctacaaattcaatataatccccatcaaaataccaccatcattcttcatagaattagaaaaaacaattctaaaattcatatggaaccaaaaaagagcccacatagccaaagcaacactaaacaaaaagaacaaaactggagacatcacactacctgatttcaaactatacaataaggccatagtcaccaaaacagcatggtactggcataaaaataggcacatagaccaatggaacagaatagaaaagccagaaattgaaccaaatacttacagccaactgatctttgacaaagcaaacaaaaacatgaagtggggaagggacgcccttttcaacaaatggtgctgggataattggctagccacatgtaggagaataaaactggatcctcatctctcaccttacataaaaatcaactcaagatggattaagaacttaaacctaagacctgaaactaaaaattctataagacaacattggaaaaccccttctagacattagcttaggcaaggatttcataaccaagaacccaaaagcaattcaataaaaacaaagataaatagctgggacctaattaaactaaagagtttttgcacggcaaaaggaacaatcagcagagtaaacagacaatccacagagtgggagaaaatcttcactatctatacatctgacaaaggactaacatccagaatctacaatgaactcaaacaaatctgtaagaaaaaaacaaacaatctcatcaaaaagtgggttaaagacatgaatagataattctcaaaagaagatatataaatggctaacaaacatatgaaaaaaaggctcactgtcactaatgatcagggaaatgcaaatcaaaaccacaatgcaataccaccttattcctgcaagaatggccataatcaaaaaataaaaaaaacagtagatggtggtgtggatgtggtgaacgggaatacttctacactgctggtgggaatgtaaactagcacagccgccatggaaaacagtgtggaggttccttaaagaactaaaagtagaactaccatttgatccagcaatcccactactgggtatctacctagaggaaaagaagtcatgattcgaaaaagatacttaaacatgcatgtttatagcagcatacttcacaattgcaaaatcatggaaccaacccaaatgcccatccatcaacaagtggataaagaaactgtggtgtgtgtgtgtatatatatatatatatatatatatatatatactgtggtgtgtgtgtgtatatatatatatatatacacacacacacacacactcacacacacatacacacatatacgatggaatactatgcagccataaaaaggaatgaattaacagcgtttgcggtgacctggatgagattggagactattattttaagtgaagtaactcagaaatggaaaaccaaacatcatacgttctcactcatatgtgcgagctaggctgtgaggatgcaaaggcataagaatgatgcaatgggctttggggaattcgggggaagagtgggaggggggcaagggatagaagactaaaaatatggtgcagtgtatactgctcgggtgatgggtgtaccaaaatctcacaaatcaccagtaaagaacttactcatgtaaccaaacaccacctgttccccaataacctatggaaataaaaatgttgtttttaaaaattaaacttgctctgggcaaagacaattgctgtcttaagattttttccccaaaactaaaaacaatatgctgtgtacaaatatggcactcaggaaatattttttgctcatgatgttcttaatatttttttttacttgaaaatgaaaaaaaaatcttcaattttaatttaatttttttatttttatttttagagataaagtctcactctgttgctcaggctggagtgcaatggcacaatcatagctcactgcaaccttaatctcctgggttgaggcaatcatcccacctcagcctcccacctagttgcgactatgggtttgggccatcacacccagctagtttttcaatattttgtagagatgaggtcttgctatgttacccagtctggtcttgaactcctggtctcaagccttggtctcccaaagtgctgggattacaggcatgagacgttgcacctagccctaataagatttttgaggaagagctttccttaaactattttcctttgaggaaagttagattgttcagtcagaaattgaaaatggccacctatccaaacctctcaaattagtgtgttttataaatatctgaaggaaactttaatgccaagagaaaagaagaatgttctatagttaaaaagcttcaaaaaagggagaaaaatcaatgtctccagaccatttgacatagtctcagtgtttggttgtaatttaagaaagattgaatgcttaagttcagaaggttcagacaagaagattttctacctgccacattttcaagctgttgacctagtttccacaggtgtactgggatgcttcatcactgaccatcagaaggaaattttcatggttaagtcagaaaataccatgcttacattctccctggttctttgagaaaagatgggttgaagaaattagggaatatttgggaaatatgaagttgatggtaattggccatccttcgcaatgctcattaaaaccagcccacatgatttttgctcttctaaaatttttcctttcctcctgaaactatattttctaaaatcctactcatcagctaattatggtcccaagctcccaatccccctacagaaagaatgtccactgcttaggaactgattggttatttggagatagaagaaaataggattgaaaggaccagtctgtgccatggcccacattccacactattttctccttgtgaagttgaaactggatctaaccatttggaaattatttacctaccctctctcccatcaagagggaggcagaaaaacaaatggggtcatgagtgccaagaacttgtaggcaaagaggagaagaagaagccctccttgccaggataaaatgaccaacatttccatcttgtttgtcctgacaagtatagagtaccttacaacttttggcccttgctgtgccaaaacagagaaaataatgcagaagaaattaatagtcaagaacagtattttggttttttttttcttcctcttcaaaagtctatgcttttttgatcatatcagaggaaaggagtgaagatggaaggagtccatatgaaatccatataaggaattaagtcataatgacatagtgtattgtgtgtttcccaggaagccatttgctcaaggatttattaggatttactgtgtctgtttgggctgtggtatggggaaaatgtgttatacagccaaaacagatgagcatcaccagacccccttgggctgcatcaatatcaattcctggaacttgaatgtacagttagaggcagtgaactagttaagtggtcaagcccattaaaagttagtgtgtagaggctgggtgtgatggctcacgcctgtaatcccagcattctgggaggccaaggcgggtggatcatgaggtcaggagatcgagaccatcctggctaacacggtgaaaccccgtctctactaaaaaatacaaaacattagctgggcctggtggcaggagcctgtagtcccagctactagggaggctgaggcaggagaatggcatgaacctgggaggcggagcttgcggtgaaccgagattgcgccaccgtactccagcctgggcgacagagtcagactccgtctcaaaaaaaaaaaaaaaaaattagtgtgtagagtcagatgtggtggctccagcctataattccagttagttgggagactgaggtgggaggatcacttgagcccaagagtttgaggctgcagtgagctatcattgtaccactgtgtgacagagtgagatcccatttaagaaagaaagagagaaagagagaaggaagaaaggaaagaaggaaagaaggaaagaaggaaggaaggaagggagggagggagggagggagggagggaaggagggagggaaggaaggagaaaaaatagaaaaacaatttgcttgaggaagttgcttgatagactactctaaaaagtatattcattagcattgaccccatatatagcagatttgagtaggaggcagctttttctttgaatactggtttatctcttctatttagggaagaaaagggggaagtgtgtttttgttgctgttgtttgttcatttgtttttgtaagaagcggatttccccattgattttgcatttacattgagttttcttgagacattgtatttgagttttgctttccattgtatgtagatgagatctgccttgatcagcttttgagtaagattcaagtgggcactggtgtgatgaaaaacagagtattataaccttgagtagttcatcgcagctagtaagactggaaaatgcaaatggcttagattacaccgagaaaattcacaatagctctcagccttaaagagaaatggaaggttctaaggcagttaaattttatactttcattgacataaaccacctaactagctgttctgctttcatgccaaattttggctctctaatatttgtattatgtagaagggtactgtaaaatcttttagttatctctcaaaaatggcatgagataactggatattattactagatctgaaaattttaaaaaacagcaaagatacaaacaaaagaaatagaaagtcttggagtaaaagcttgtcctcaagagataacatttttacctggcatcatttcaaaggaagtgaaaggaatatcccaggtgcattgtggacatcataaagaataaaaacaaaagctcgttggtgtgaatttaaaaataaaaaaaaattattgacttctatcttaagtatacatctaccatgcagcccgttcagatgtagcagagagtttggtgagttctagacatggaatgagctctaacaaggaaaacttacctaaatttattaatcttagctgaaatagcaacacttttaaaatatgaaagacttggctgtatcagacttttctgtatcttaattagtttaagagcttcagctttcacaggggtgttattctcaaagcatttgcatttggaggttaggtgcttacaattttggaattactttcagatttttgcaagctacaaaggaaaaaaggaaagcattactttagagccatgattttgctttagtttgcatgatgacatactggagaggaggaaggggttagattcagacagctgttgggttgatctgccagggactaacttgtctggcctttggtgagttgctgatctctctgagtctcagtttcctgactgggcacggagtaaccctgcatgcattgttttatcccaagactgcaataataaatgcgctttctaatcatcctgaagtcccctttgaagttttcaagaaattataagcttaatttctacattttacatgtatgcattttgtaaaaacatgcttacaagagaacatgcttctctactcccaacacaatgtgtggtgtttttttccccacaccaagtaattctccaattctctgtggacaccagttgggcatcccacaattcaattcaattctgacactaatacctggatttagcacagatcccacagggtaagggtttggtcccacaagactgcctgttacttcagatgctaagtccaggccccctgtacttctgatcacccagctatcgattgggggttcccacaacccctatcctaggttcaataatttgccagcactgctcacaaaacttagggaaagatttacttatgtttgctggtgtatgataaagaacattataaaagataaagatgaatattcagataaagaggtacataggacagggtctggaaggatcccaagcacaggaacttctgtttctgtggagaaggggtgcaccagcctccagtacatggagacattcactaaccaggatgctcatcaaacctagttattcaaaagtaactaaagagcttaatctcgagctccctctcttttcctggaatcactgggtggagctgaaagttctaaccttgtaatcacttggtctttttgacgaccatcctaagtctatttaggaggcccactccaagacacttcgatagcatgaaatcaggtgtgatggaaaggggcttataatgaataacaaaagacagtcctttcactcaggaaattccatgggttttatgagttctgtgccaagaaccagggacaaagcccaaatacatgttctttaacaccacagtgttattctacatgtagtcaatagtagaaactctcagtattgaccttctcatctgaacatgccagacagtaaaggggttgtcatccacggtaaggccagacactgttttcttctttacatttctgtctcttgggaatgttgactttggtcctcactcctttaggcttatagctctcagctgcacctttccagccctttgcactggactaacacttctgtgtattgggttttccttcctcctacccaacttgaagcctgattacttctattcaaaaactacagtatggaggacaggtagtcctgtcttgccatctggtgataatggaggctcactggtgttactgatctgacctactgcagcaagttcaggttttgcaggcaggctcaatggaggagaggtagactgcactgaaatcctttgagtaagtctggaatcccatgctaggtgggccccttccactcccattccatcatcaacacttgcaacagccacttggaaacaccgtaggtctggttcaattcgcttagtactaaactttcttctgacccatacaaaaatgctaaaaatataaacatcaattaaagactctcctgtttttcaggtgttgtcagttcagggggaaaggtacttcttgatgataagactttgtaatgttttctaaagtagttttagtcactaacttattcagtgaagactgatcaaactactgctacgttcaagggatcttgctatgtattagcagggaatctggggagtagagtgtgtgctgggaaaagggggaacacggcaaacatggcttgtaagagctaataaatacaagaaaaactggaataaatgttagaaatctgataaagagagaattgattttgatgcaaaagattctaaaaaaatgtttatggatgtgctggcccttagggctgaatcttgaattatgagtaggaacgagatgttcaaagggaagagaaaagcattccagcttaagtgaaatatgtgagaagtttaaaagcaagaacatctggggtgttacttagatattgaggaagctagtggtgtactggaaccagctcctatcagttcacaagacttaacagtgcacctctcttctggcttggcattcagtgacagcactttggtagcttgaaaacagacttggtggagtatttacaccacagaaattgccaaatactgcaaatcagggcttcccctcaacgtgagaaccagttgttaaacacaagcacaggcttggctagagtgcccttttcctcaaagaatctcttagataagactgttctttctgccatttatgaaatgggcacactttggtttggttagtatagatgatttgcaaagtatcgcgtaactatgtgtggaagcagaccgaaagcacatgtaaatatcattctgtaggacttcaatgccaaagagctttgtgattctgtgtatgtagcacaattacaggagccagagaaaaaggacatcagtcctaagactgttagtggctgtgccaaaatcttttcatcacaagcgtcttttcacacacatgcacttgagactagattgtgtgcccaatccgaggtctattattacttttactagagttgagggaaaggggatgagaaataagaaaaaataaacttgaaaattacagccttaagggcaaaaataaggaaattttaagagaaaaaaatgtgtgaagattaacttcaagaccacaataaaagaaacaccttgggctctgagggccctttatcatgcaattttgccagcgtttctaggttcaatattctgaaaagggtggacgtttcagtggttgctctggaagcattattttctgattctgtatctttgctaagggtttcatatgcaatcccccttcccccatgcagaaaaatgcacatttctatttctacaacaaatatccatgtacttctagtgcattagaaatctccttaaaatacgcagaagaactgtaactaaagattaactttatggccgggcgcggtggctcacgcctgtaatcccagcattttgggaggctgaggcgggtggatcatgaggtcaggagatcgagaccatactggctaacacggtaaaaccccgtctctactaaaaatacaaaaaattagccaggcgtggtggcaggcacctgcagtttcagctacttgggaggctgaggcaggagaatggcgtgaacccgggaggcggagcttgcagtgagccgagattgtgccactgcactccagcttgggtgacagagtgagattccgtatcaaaaaaaaaaaaaaaaagattaactttattccaggtactagattaatgagattatatctttttttttatatgtgtaaatttaaggggtataaatgcagttttgttacatggctatcttgtatagtggtggcttttagtgtatccatcacccaaataatgtacattgtacccattaggtaatttcttatacccaccccctctcaccctcctgagtctctgatgtctattattactcacattatccatgtgtacacattatttagcttccacctctaaatgagaaaatgtagtattgactttctgagttgtttcaattacaataatgtcctccaattctatccatgttgccacaaaaagacatgatttcatttttttatgaccaaattgtattccagtgagtgacttgaggaagaaaatgtggtacacatatattaatttatgcagtcattcactgatgggcacttaggtttattccatgtctttgctactgtgaagagtactgctttaaacatatgagtgcagggatcttctttatataattctttcttttcctttaggtagacacccagcagtgggatttctgaatcagatgatagttctattttttttttttttttttttttgagatggagtatcgctcttgttgcccaggctggagtgcaatggcacgatctcggctcaccgcaacctctgcctcctgggttcaagcaattctcctgcctcagtctccgaagtagctagaattacaggaatgtaccaccacgcctcgctaatttttgtgttttgagtagagatggggtttctccatgttggtcaggcaggtctcgaactcccgacctcaggtgatctgcctgcctcagcctcctacggtactgggattacaggtgtgagccaccacacccggcctctatttttatttctttaagaatttctgtatacatagagtatggaataggcactggagactcagaaagatgagaggatgagatgagagtaaggtatgagaaattacttaatgggtacaatgtacattatttgggtgatggttacactaaaagcccagactttccatatatggaaaacagtatggagattccatttccaccaacagtgtattagcatgccgttttttctgcatccttgccaacctctgttttttttgtctgtttgtttgttttggttttgtttgtttgtttgtttgttttgtctttttagtaatagccattctgagtggtataagatgatatctcattgaaggttgataaataaacaggttgtctggtatatagtttttatttattcaacaaaaatatatttgagagcctagtgtgtggcagatgttgatttaaaaactgaaaatacaatagcaaacagagtttttcatgtagctgacattcctagcagagacaaacaataaacacatgtgacagtgccagggagaaagtaccattgaacagcaaagtgacaaaatacttgttgtctgtttcatgtttatgaaatagaagatatctcttattcattcaaacaagaaatctacttttttattttgactttaaaaatacaagaagtacaaagaacaatgtaacagataccaaaagtcttcctaccctaaattattaaaagcatattgctttcattctttttttatgaaaagaaaaagctaaaatccccatggaagatcatcacctcctacctttccctccctgacttcaggcaaccactgtcaataattttctatacttttacatgtatgtatttattagaaagctgtgcatttttaaaaatttgtatttatatatttattttttgagagtaggtgtcgctctgttggccaagctggagtgcagtggtacaaacatggctcactgcagccttgagctcttgggcttaagtgatgctcctccctcagtctcctgagtagaccacagacctcagtcttctggtgccacagatgtgggccaccacacttggatttctaaaaaacaatttttgtagagatagggtctcaccatgttgcccaggctagtctcaaacccctgggctcaagcgatcctcctgccttgtcctcccaaagtgctggaattatagatctgagccaccacacttagcctatgcatttttaaaatctttttttttttttttgcagatgagtaaatattgcattattttattctacttcttaaatgtatgtgtttgaagtctactcctttttatctattgtgtaatattgcatcatattatatagtatgttattaatctacatcctaaataataaagcaagtttaaacaaagtgagtatatttttaaaatatttaagatgaatatattcatttcaacagcattccacaagtgcttatgggaatatcttgtcacagccccagcccttaggtggcatgaactacagagaggagttagcctcagtaatggactttaaggagcaatatatataaacaccagctaccatgttacacagggcagaaggactgataagaggggaagaaattaactggtttagaatttgcagaacataagtgggaggatatgtaaagcctttcaaagaaaggagtataaaaaacagtgcagtaggaaattggaagagaaagccacagtatcagcaaaccaggttggaaagtgcaacgcaacttgaggaaagagaaagttcccattgactcaaggaaagagacttaggctacttacaatttgaaactgcagatgagacaagaactaggcggtcttgacacaccaggcttaggcttctacctaatccatcagtcaatggagagtttttatccctgtagtaatatgctcgttgcccaaggaagaaaagccatcaaagtaagggaggagggagctgacagcatccacactgaggcacagtggaacatgcccatgggcacttggagactaggttgctgtgtgctgagtgagaacagatttctgacctcgtcaaagatatacctctcgtctccctccaagtgcaaagaacaaaaatttcagccactccctgatccttttcttgcaagaacccagcaagagtattttatttctatggattttttttcaatacagtcattggaattccttcaataacttcaaggaatcaaacgagtcatgctctttttaagacaaggtcacagaaagttgagcatgactctaataacatgggacagtagaacaaagaggtttccgtggctctgcctggatttcacacgggcccattggaatgttcagtctcagtgtgctttggcctcctggctatggctatcttgttcctcttttatgtgctcccattagtgagcgacagggaatcagagtacattacaacaggactgcaataaagtgtgtgtgtgtgtgtgtgtgtgtgtgtgggtggaggaggagtggtttgattagaggatggagtaaatatttgtggtgggaaaatcctcatcagtttctttcttgccttcatcaggggactggttatggggacataggcagaggagctttcgtgggtctggaatacacaagtatccagagctttcccccaccaggagcttgcttaggttctgaggacacagagaataacaaaacaggaaaagaatgatgcaggggaaagggtatatcaattactgtatttccttacttctaaagcacacttttttccccatattttactgtctttgaacatggtagtcactgttgggctgacagaagttgtgacataattatcattgcctgcacaaaagcacaaaaccttgctgatggatttcagagattaggaagaaaatcccagatacaataggaagtattcttttaaaggcatattgtatcacagacatttttgatggcatgaaaggtaaaattatatgggaaaaccacagatatttgtaactctgactcaaaaagtgactaaaaggagtaagagtctgagttttaaagattagaaataattcactcatatttttgcttatattatcctttttatgtatgaccaggtgatatgtgataggagatttatgttttaaaaagtctaagaggcttctttccatagcataaactaaaaattctatgtggcaagaaataattgcaccatgtttgaattattgatcttagtaatccatcttaaatcaatgctttaaatataattacatcgatgaataattgctacacaatctgataaatgctataattgaggtatgcacaaaggactgtggaagtgttgagcttctgagagttcaaactttgccagaggagaggacataaaatctaaggagttttagcatgagtaggagttttctaggtaggaaagaacattccaaacaaaggttgaaattttgactttctgatcatttagtttttaacttctttcccctccgccagttgttccaggtccttcacctcaactcttattagacaaagggtgctgattattaatttatgcctctcagcctaacactaaagattctaagtagctttgcttcacttttgttgcccagtggaccatatgcagtagtgagttttaatcttcttgcatcttaattcatctcctttaaggtttagagctccaagcctttgtatttattctttcttggtgatcaaatctaaactgcatttttaaagagatgcatttatgttaccatttttcctagcttatttatacaggactcctcctgctagatgaattattccttcattttatcaaaagctaagggaacacccttatttggaaaccttaaaagtagtaccaggttgcaccattaaggtaccaaattcctcacatattgccaatagaaaagcacttattaattcttgctaatgaagcccttgataggtattgtggcctggagaaacatacagtttggttatggagaaaatatctaattgcaagagcagtaatgaaacactacaggtgggagggtggggggctaatacaagtgcttagcttagtgatcgctggaaccactataagaccattaccattgaacaagataattgcagcacagaaatggggaggaaagcattcccttatacctgtattcattttctagggctgctataacaataccacagattgggtggcttaaacaacagacatttattgtcttacagttctggaggctgacatccaactcaaggtatcagcaggtttagtttcttctgaggcctctctttggcttatggatggctaccttcctcacagggcctttttgtgtgttcatatctgtgtgtccaaattttctcttcttctaaagacactggaaagattggattaaggctcacccaaaaaagttaagggctttgctttaacttaatcacaactttaaagaccttatatcctaggtactgggggttaggacttcagtatatggattttggtggggggatatacaactaaagctttaacataccccctcttccctgtagggttaaatttggaaactgagttgcaggagaccccaagcttgaaatccaggcatgatagttccttcaataacttgaaaatgctccatgtttcttcaaaattaaggacctctctcttctacctgcttcactcaactgcttttattgtttatctactgttgctataagcataaaccacccagctttaaatcctctgtgcattactacaaaaataaatttgcccatgctgaattgtggaactgaagtgtttccaaaggtgaatgtaccaaagtggatggttgaaactgcacctttttacattaacccattaatcaccttcacctttaaacagtcattctgcctttatttatgtatttttttttaagagagaagaggggaacaacatagacccagcacagtaaattaaagttcattcaagcacagttgttgttgatgaacaacgcagttctgcttggttgaaacaagacacaaggggcttgttaagcctactaagtcacaggtgaacattgagggtcaggcagtcttaagagaaggtgaaacctttcttatttaatactttgacaaattaataatcgagccatagagtttcttactttcattgaaaatggcggtctctaagtgtaatctttgaaacaaaaagagattaagtctttttgtgcctggcacttgtgaccttggacaaatggacaaatagcttctgcagctaattaattcaagaatttaattcagtgtcttctctgagccatggaaggaatgatatggatattgttttactttgcctattactgaaaaccttcaagatagaaaaatgcccatttttatttaatgtggtgttgaaaatggcctataaaatccactttttatatgcagattaaataagtaatgatattttaaaggacataggcagttgtattacaaataaaagccataaaatttttctccaatagaagcataataaaattatctagattctaccttggaggaaaatttaaaaaatagttaatccattaaaaacaaacaaacaagacacaaatttcttcaagaggttaccataatgtgcttttacttggttagttagatgccaatacagttagactgtattcctgagatcccttggatagctaatgaattgccaatgctcagcagacatccccccgcctgccctctccattaaatatatatgtgtgtgtgtgtgtgtgtgtgtgtgtgtgtatatatatatgtgcgtatatatatatgtgtgtatatatatgtatatatgtgtgtatatatatgtatatatgtgtatatatatgtgtatatatatgtgtgtgtgtgtatatatatatacatatatataacatatatatgtatatatatagtgtgtattgatgctatggtctaaatgtttgtgttccaccaaaattcatatgtcgaaatcctaacccccaaagtgatggtgttaggagatgggacctttgagatatgattagttcactgtgggcacagtcttcatgaatatgattcgtgcccttatagcagagacctcagagacctccctcacttctccagccatgtgacatcacaatgaatacatgactatctatgaactggaaaatgggccctcaccagacattcaatccgccaccaccttgaacttggacttcccagcttccaaactgtaggaaataaatttttgttgtttataagccactcagtctatggtatcttgttataacccaaatggactaagacaattgataaatatatgtgaatagattgcattctacttacatgttgcccatcacatattatgtgacatgtgaagaaaaagagaagtgggaagtggtatcccatgctacgctctaacttggccaacagtgagacttgccacagtgctaggctcaagggacatgcttggtgaaatcttttgggtaagatcatagtgtagagcactccagggccttgactttaatggtctgttgttttctttttttgtttgtttgtttttaattcttgttttcaattataagcactaccattaactccatgggtttcccaggaagactgtatctgagagtggcattctaaatacaaatatatccttactgctagaaaaaaaagtcaaaacatatgtccccacccagatgggtcagaaatgtcgccttcagatctcttggacagcatgctgtcctattgtgactcttttctggggagcttcattgagaaactctttattctatgtccatcatgtttagagaaggggaaatgtgataacattagagtttattattttcccttatgtagtgatagagacactgcaatatacaagattaaagtgagtgacccagtattgtgcggcaagattgagtctgtgctgagacaaaaaccaagctgttctctaagctccgcacttgattcactgagccacactatctctgtgatgttccccatagtgtgtgtgaagcaagtgccaaatgcagtttctcagtctgcacgaatgctccaattggctgcatctcttcccctcctggctgcttttggtagaggattgctgatggaaattgtgctgctgagcttcgccacatggctgtggctacatttcgccagtgttagctggaagaatttcccgggattctaaactagaaagaatttgctgaggggccccttaggagagggtcaaggtttcctaagtgcaggtgatcactgtattatattaatagtcgagattttattttaaccagcagggctccagccattcttgtggatccctgcaatgtggttgaagtgatgttaagttttctctcactgcagtctgcctgtctgcttcaaacagatctgattcacttagggccaagtttcagggtgttaaagacagctgggttggtgtacatggcactgagaagccaagagatgcacgtcctaatcccatgttgtctggagagagactgcaccataattatatgtctatacacctatttctgcatgggactgtgaaaacctcatggatggggagagtattttctccctctttttccttagtgctagcattttactaggctcataaatattatgtttgataaattagattatattggctataatcctctacatatcacttaacctctctggatctcaactttcatggtaaaagtgatacagatgaaccgcgttaatcaccacacttccagtgttatcatctcataattctacacttttgattctctttgcctggaggagtttctggttttgttcttagctaattaagagccagacctagatattcctcccacttagttgttttataaggaggagtgcaaactcgctcaccattgacttcctatgtttatgacacgattagtttgattttggattatctatcacaaatgaagggaaagctgagtaatttttaatgtcacaaaacatatttatgggtgaggtggggagtgttaatccagttgagacaccagttatatgttcagccaactgcaagacctctctgataggtagaaaacatgacaaatttcattcctagcattttgatttgatttctgattaattctcaaaacatccaaatcataaaagtcattggtttattttttaaaataaatgatcaaatagccaaatttttatatacaggtcttttttatttttacataaaacttttaatctaaataaccctgggcacattatgggccccatttaccttctttgattcagagacagaaatgatcacacttagaggcaaaatattttcaatttgggtcagtgacccaaaacttggcaataatcttttactattcttctagttctacactattccaatatgttatttctaatgaatctgagaaatatgatgagattaaaaggtcatccctcatcactttattctatacatctccaagtaagcacccttcattccaagacaaaaaactgtagcagagattttgtgtgtgtacaaatgttacagctttttctgtatagtagttgggaatggaaaatatttaaaaaaaaatagtcacctggatcattcattctagggaagacaaataactgcatcagattatatttctgttgatatttaaattttcatgtgaagtttacagtcttggaaatgactttcctacaaaatgtttttacctttgatcccaatggaagttaaatcagaatttgtcattcaatataattcattacttgcccttcaatagtagctgagtagctgctggtaaattgaaaagttaccttgataataatttaaaaactaaaagaaagttatctataatgttgttctagcctgtggcaaccatccacttttgataaatgttccatcattttaccttttgcccagaccagatttatctacctttctctaccactagaacaagaaggtaaagcagaaacagatggaactcagtacaatgttcagacaacagtcagatactagatttatccatgatgtaattataaattaatgaattgatagtcaaggctcagaaataaacctctcatttggggagtaaatgataatccaaaataccatgacactatcctccaggatcctacacaaagcaaagaaaggggaccaagtaacctaaatatattattgcctggagggagttgctgattaccttccctaaaccaggccttccatccagggactttaagctgaatctcttaacccaacgataatgaagatcacttggattctctaatgccctgctttttatttgtgtttaggcaatgcttcactgacttaagctatttaaatgtttaatctaaaaagtcatcctgataagaactcatatagtcaggaaccaaatgaaccaggccaaaacaagagcaactgttgaacatgtgcagatgccctgagctttggaatgaattaaataatttagcttcccaattatgtttcacttatgcttttactacaactcaacaaatgctttcgaaccactgaacccaatacattttttgttgttttagagtaaatttttaaatcttaagttgtagttaaaaaattaaagtgggatgggaggtgatggcccaagccttgcaacaatgcacgttcattgcaaccaccgtgaccatggataacaggagcagacgagggaatgctgatgtgaggattataacattcatatagaaaattaattgggtattttgtggcttatttttcccatcttattgattagaccactgaaacccaatgattaagtgatttacctgaatctaaccatttcagattttatgagagcttgaaaatgatgcagaattttttgccttcgaattcctcgcccgccaattaatggtagagaaaaataagaaatcggttctctagattctcacttcaatgttctttctactacatcatgccacccctttatttggtgtgtaaacatattagcaggtttgtgattaaaaggagaggtgaaggaaagtctcaccaattattttgctccatctcttcccactgttgctaagttaataattatttgcctgacagcaaaaggacattccacaggaagactgcttttgtgtgcaaagttcctccatactccctcttttcctttttctgcaactagatgttgtgaaagggagaatccatgaagggaccaagcaatagtcaatttaaatccaaaccaccacacaagaacatcaagcagaaacaccttttaattgcctggactggtattgactatcaagtcacttgtatgactgccttgctctggttcaagtttactgtgccttgaaaagtcaatctaaaagagaagaatgaatctgagggagtagagtcccctggggtcaaggtgacaaaactgagactgcagtcacaaactaaaggagaaaaatttcattgtcgcctataagtctttcttaactttcgaattacagatttgtgtttctgtagcttgtcattcaattcatagcttgtcacttaagttgaagggtaaaagttctctccttttaccatgagacaaatacaattttacagacttgttggcatatgtaagaatcaaattgttctgggcttccctttcttatcaaaataaacgtggttccaactgaaagctgaggtccttcttccccagcctattcctatcatgccagcacttctagaatagcaattcatctcaaccgtatgttcaggatcatgcaccactgatgttccccagtatggccagggcttctggggaatgtcatgacctcaatatataagtttacttctataccctcgatgccaacaagacaggaggaaatatggataggttaacccccaaggacagcaagaaggagagtgataaggatggcaggtagcaaaaagcaaaattttggaattctgaaaggtggatggataaatagtaactgaattaataccctggtggggaacaaataactacaactcgctgctgaacaagtaagtgtgggctgtagtactccaggacaacacaagaattgaggcaatgggtcactttgatggtagcagtgcagaataagacagaaaacaggtgaaaagggcaaagggacattagacattagacctacagactctccctggtcccacagagctgagcaattggatatccttacttcagcagaagagggaatgctctttctagagagattaaatcagagaggaagatttggggagtccagaaacagttgagagtggggcgaaaaattgtactgaaaatagggactaagtgaaaggcaggcaaactggttggtgagatcccacagccgtcgctatcctctgggctcttctcatgctggaaagtagtctgtttccctgatgcctccacaggagatgggagaattcctctctggaaaactggcccaataggtgctgacctttgggaagtgcccagtaaacagctagagggaaacccagccccacttgtgcacacagactttttagtagttttatttttcttcactttcaaatagatatggatgtttaaatattgccaaatatttataagatcttctaaaatagagaaagtaaaaccagcaaataggaatccaagagaaatggagaagtctgctgaaagcagaaaacaatctcaaataaaacataactttaatattttgacagagataagaaaatattaagcaatcatatagtaagaacaggtagctataaaataagggagaaactttcaaataataagaaaaagtgttcagaaattaaaaattgggtttcctgatagaaggaataaaaaacacagtagaatgattggaagataacattgaggaaatatctcacaatagataagaagacaaatatagaatgtaggagaaaagaaaaattagaaggtcagtctaggacagtgattctctaaatttccttgcatcagaatcagctggcgggcttgttaacattcagattgcaaggccccacacctagagtttctaattcagaaggtctagaattcaacctaggaatatacatttctaacaagttaccggatagatccgatgctactggtctgtgaacaggactttgaaaactactgttctaggagattcaacatgtgcatcacagcatttcttgatagacaaaaccagaaagcagagaggaggaaatgataatagaaacaatccaataaggatatgaatttctggaatgaaaggacccaggtcatctagttcccagcacaataaatgcgaaaagattcatcctaagggacatgatgacatttcagaactttagggaaaaatacatcagggacacacatgccaaggaaggaagggaggaagggagggagggtgggagggaggaagggagaaaggaaggaaagggagggagggagggagggaaggaaggaaggaaggaaagaaagggagggaaagagagagagaaagaaagaaagagaaagaagcgaaaagaagaaaacaagggatggaaggaaggagggagggagggaagtaaggagaaagaaaagaaagaaagaaaattaacacattcacatttgctgtcttagtccattttggctgctataacaaaatagcataaactgagtggcttacaccaaaatttgtttctagaggctgggaagttcaagattaaggtgcctgctttctggttcatagacagcaccttcttgtgtcctcatgtggtggaagtgacaatgcaactcactgggtttattttataagagcactggtcccattcatgagggctccacaatgatgacccaatcgctccctaaacaccctggggactaggatttcaaaatatgaatgttaggggaaaacaaacattcagaccataccattcccatacaaaaaataaaagaatcagagtagactcacacttcttaatagcaacactgataaaacaaagacagttaaagaatgtatttcatgtcttaggagaaacaattttcaaagttagaattctgtgtgcagccaagtttcaaacaaatgtaaggtctttttcccaacattaagttttcaataattttgcatcctaagtaacgtttctcaggaagccacttaagaatgagcttctattaaaatgggaaagaaccaataaagaggaagactcagaacccaagaaaagcagatcctcttcaggaaagaggcaaagggaagttctcaggtggtgctagaagggatgcttccagatgacagctgagtggcagtttgctgagtttcgagtggactagtagtggctccaggaggagtgttgtactgctaagtggacctagatgtgttcaccttcactgggcaaaaggttgtagttctgtagggacagttggggtaataattattgataaataattaggcacataaaaatattcaccctagctaaaacaaaaatttttataagaaaggatatgtcatccttctatgctgtgactctacaatgcagaaaactcatagtaatgaatatatattatatataaatgctacatctatattgacagaaagtaaaagaagaagtatgttttgaatagagacagaaaactacattctcgctttccatagtagaaagtcatttaacaatgttaaagtggaaacatcacaaaataagaacactatttagaaataagagaagaattgatatgagttgagagtggtcactcctaaaagcaataattttatctaagtagagctgtgtcaggagatacttgctttatcattatggactggagacagaaaactacattctcactttccatagtagaaagtcatttaacaatgttaaagtggaaacatcacaaaataagaacattatttagaaataagagaagaattcatatgagttgagagtggtcacttctaaaagcaataattttatctaagtagagctgtgtcagcagatagttgctttatcattatggcctggaggtttaatttgacatttactatggacatgtaatactttgctgctaacaaaacttcttaaagaaaagaaagagaacttaatcttaggcatgaacaaatcagagaaaactgaattattttgagaggaaggaatgggtggaagataaatctggattccttccagaggtgttgtgggcctgagaagattaagtttagggagctagtccagatagctgtacctatgttccctcatctaaggaaggaaacttttgctacatttttttaaaactcaagcaaatctgggaaacggcatattttaaattatgtccagaaatgctccataaatcagttcagtggccccaaatatcttttttcttttctttttctttttcttttttttttttttttgagaccgaggctctgtcacccaggctagagtgcagtggcgcgatctcggctcactgcaaactccgcctcctgggttcacgccattctcctgcctcagcctcccgagtagctgggactacaggcgcccgccaccatgcccggctgattttttgtattttttagtagagacggggtttcaccgtgttagccaggatggtctcgatctcctgacctcgtgatccgcccgcctcggcctcccaaagtgctgggattacaggtgtgagccaccgcgcccggcccagtggccccaaaaatcttaatgcaaaaatcctactgataccatcttcctgttatatgatgcggccattaatttaattgaaccaaggtcatgaaatgagtctatgcagatgcagcccccatttgggtgctgtataaatgccctccctccaacactgaatgcaggacagcctctcagatgctgccctctgcaatctcctcaccaaatttctgattcaaacaagcaaggcaggtcaatagacagttttattggcccttttgggacatgactgcagaatattagaacttctctttataggtcccttggtaattgactgtgtttacaaaattatgagaaaagccatctagtagttagaccttcttatcccttttccaattttcagtaggctgaaggtgaagccaggacattgagtttgatgtgtggttttggcatggcaggatctcttgtttctaacacaatcaaagagctgagggctgatgggttagaatatttgggtttgctccaccattaatttactctaacagggacacttctgggtatgacttgctactataggaagagctgtgctatgctttggaaatgctatttgttgatgaaacactaattgtaaaatagttacctcggagaactcaaatgtaattacattaagtttaattacatatcattaattatataaaatatttaaattgttatgttgaattgtgctgcactagttgccttacattttgctggtgtgtggagcagatgtgcttgaagagtttggatgtcatccagaagttagtgaattgtaactgtttagataatcggagcctgatttataccatctattgaaaaacaatagctacatattttcagtgatgcgacattattgagtatagggaggaagtagcttatgcctacctgatgttttggtaattatagtttactaccgactttaagtttaatcaaccacatataaggaagtcaatgcctaatttctcatgtgcatcaatagctgtgaacagtaatttttatttatattggggagaacaatttttttctctgcctatgaaactgacaatttttttaggatgcctgaattatcaaaggaatctagagttcaatcatttgccttgtttctcagaggttcacttgctcaaattaattcaccatcaattttaaaatgtctctagacttcacttatatcaaattctctaatatgattgaaagcatggtgaagtatccatataaggaaagtaagaaattcggccgggtgccgtgactcatgcctgtactttgagagacctaggcaggcagatcaccaggtcaggagttcaagaccagcctggccaacacggtgaaaccctgtctctaataaaagaaaaaaatacaaaattagccgggtgtggtggtgtgcacctgtaatcgcagctactcggtggagctgagacaggcgagttgcttgaacccaggaggcggaggttgcggtgagccaagatgttgccactacactccagcttgggcgacagagtgagactccgttacaaaaaaagaaaaaaaagaaagtaagaaattcatacagactaacaatagatttttcttttccaatatgtgaatataaaacctactatgtacttaagggatctgacactagaaaatgtaatgattgatcttaagttttggtaaacaaatagcagtactagaatttcctctcttaaataatttgctttcatatttatatccatttggagtggagcaaagcagagaaacagtcatttaaatataaatgctacagagagaaaaatatttatgattcgtgtttctgccaatcaaataaatggtaccatttaaaattttagtttatttttgtctgtgcagatattatctactattaacagtactttggctcaattcagattattgtgactaaatttctcaaaaattggaaagcacagaatcaatttgtctaaagaaaataacttgttagtatgtcaccagccataaatcatgacatgtcacttctactacctttgaagaggatctattctacagaagttcatttttagaattacctctgcttataatttgaagaaaatacttttttccccagaaaatacttttttttcctcagaaatactcccaggtattttgatgaaaaataattaaaattatctcatataattgtatatacatctgtatatgtgtttgttggtatcagggatcatctaataagaacgaaattgaattctgtaaaagttatgttgactatgccagaaggtacaatctgtgagtcaaaatttgaggggcaaagggagggattacagttacaagggaggatatggaatagagccagtatctgttgagactgaagataggcccaaatgaggagagggactttgagcaggcttgtgtgcaggaagatttgagaaagctcagtttgtcgcttcagcctagcagccttcccagggctgaaggtaactttggtggaattaggagttggtttgccccaacccccaaatggtagtagatgatatatgccagtgacaatgtcatccaagcatcctaagcataaatactgcaggtgattcatgaaacaagtattattattgatatatgtcttatctattttgatttgaaacttgccttccaaccatgacacgagttctattttatttcctaaatcttcattttgactttggcctgttgtaagcctgttccaggctcagaccttgcaggagacattagggcttctttgtcttcaaggagcaacaggggtgtcaaagctatcttagaatcccactcctttcctatgacagtttcaggaaataagaacaatttatccatgacagctttagaaacacgatctactaatttatgcactgcttcttcttgaataattgggatccagtcacgctctgcataacagcccctggctttgggagggtccaggcttaccaactgcttcccctggagggggaagagctggagggtgagcagattgtgccttccctaagcaaagaaagaaagaaagaaagtaaaagaaattaggggtggtaaggaggttagaagacaaaggaggaagcatttgataggtcatctgtcagtaggccttgataaaggctggtaagagaacaatggaaaaccacttcaaagtgaacaatgccacactgagtatgtgccagtttaaacaaaaaagaaagaagacatgtcagctattaaacacattcattgaggggcgtctttttaaccccttacttttcccactatttttctttccttaacgagtagagaaggaaaaaaaaacaacaacaaaaaaaaacagtgagtctgtcaaagcaggagggaagcatgaggttgccagctttccggaaagtcaggcagagatatttgcattaattgaatattaatttcaggatggaggttgtgtagacaatggaaaagaggtgactttttgatggtttcaggtaatctcatgtgtttgagaatttcagagagtggggctccccgacttgttttttattttcaatatattcaaaataaagcaggattaaaaacttaatttgaagtttgggagaataagctaataagattttagattttaaagctctaattcatggacaggaggtacagaacaaaaagggcattttcacatctactcagactacatttttgtgataaccagaaaagagaaaaatcggcaaaagaaaaatttaattaagtgctgttagttcacaagatgatctctcatcttgaaagtgtctgatgtgctagtctatgctatgaatttagagatgaaagaataaatatcaaaatgtaataagaacataatactctgggaaattctatgtgggtttagaacagtgtgctacccagcccccaaagccatctttgatggaagagcagagtaatggctttttctttgtgaacttctcaaataatggaagccttggttaaaacaaatatttccaatatctgatcaatttgacagaggttcctactgaaagttgatgtttctgtaagtgaagaacagttcatctttctaccatggttggttggcttggttcaaatgaaatatagagcttcaacaaattattttggtgctcaactcttgtctcttcagttagacatgcatgccttgtggtcatggtgtaaccacccagtgggttcaccctgtccgctgcctagcagagctgatttatcaagacaggggaattgtaatagagaaagagtaattcacgcagagctggccgcactggagacctggagttttgttattactcaaatcagtctcccggagaatttggaggatcagagtttttaaggatgacttggtgggcaggggaaaaccagtgagccaggagtgttgattggttaggtaggaaatgaaatcatgagaagttgaagctgtcctcttgtgctgagtctgttcctgggtgggggccgcaagattagatgagccagtttatccatcttagtggtgccagcagatccatcaagtgcagagtctgcaaaatatctcaagcactgattttgggagcagtttagggagggtcagaatcttgtagcctccagctgcaggactcctaaaccataatttctaatcttgtggctaatttgttattcctacaaaggcagtctagtcctcaggcaagaaggagatttgttttgggaaaggactgttatcatctttgttttaaactataagttccttgcaaagttagttcagcctatgcccaagaaggaacaaggacagcttaaaggttagaaccaagatggaattggttagattagatctctttcactgtataagtcataattttgcaaaggcggtttcaatggtccatgtctcatctgtcttttgctgccctccacattggcaaatacacggtgcatatattggtttgtttattcatttattcaaagtatctagaaatagttattgagttcctactgtatcaggcatgcttcttgatgctgtacattcagcagaaaacatcataaaaccccacctccatgggggttactgttctagtccaggacaacagataagaaatagcaatgacattcagatattgtaggtaaggagaagcgtttgaaaaaacaaaacaaaacaaaacaaaacaaaaaacacaaagtgtggtagggaaagagaaagtaacaagtgtgttttttaggtctggtggtcacagactgtctctgtgaggaaataacaattagagaggcaactaaatgagatgtaggactgcctacccaaatgcctatgggaagagggtttcctcagaggaaagagccaacactaaggctctgagggaattgcacttgatgtgttcttcaaacatcaaagagtcagcattcttggacaaaatgaccaagatgacgcaacctctgttacccactgttgtcttttaaattttagaaacttgttcggggctgactttcagtaaggtgtattttcatataaaagattgcactcagcctttcattcttactttctagtatcaattttacctcttcaaagtcaaactattccagagctagagaatacaggaaggatgtggatggaagaccaggatgtgaccagtgttacccctggaaatgaagatggacttaagtgactcagtcctaaatgaaatcaggatatgtctaagtaaaatgctatcacttctattgtgttcaaattctttaactataaagtttgggtgaaatcatggttgagaaaattattaaatgtccattgttaggtctctttcctatatagattcataatatgcaaataggacaagtttatctgtacataattctgaaagctggccaggcgtggtggctcacgcctgtaatcccagcactttgggaggccaaggcaggtggatcacctgaggtcaggagttcaagaccagcctagccaacatggcgaaaccccatctctactaaaaatataaaaattagccaggcatggtgaagggtgcctgtaattccatctatttgggagactgaggcaggagaatcatttgaaccctggaagcggaggttgcagtgagccgagattgcgccactgcactccagcctgggcaaaaggagcaaaactccatctcaaaaagaaaaaaaaaaatcctaaaagctaacaggctgtagactatttttctctctgtaaacattatgctaaagggcaactattctattttgactctctatgtaaaatactgtccttatcattgagaaataattttgtgttttcttccaaagcttccccagcagggtctttgacatcggagttttttcccctcatgttgtcattggaagcagctgttacaagtcataaccgagcttatatttatcattaacttagtgacccctgctggggaggcttaacataatcatccttaaattcaaagttggggtttcaacaaaataggtgcttggacctcaaacatgagttcttcataatccaagacaatggattttgcaagttactcaaccagtcccaccactggaggcttcaaggaactcacggtcaccaattgagagagaataacccttgtcacatgactgagtgtgtgactgattctaaaagtgacacatttggcattagcacacttctcctggttgtctgcctctgctccctcaccttgctggctctttttaatgttatctgccaagtgacactttttgatctctttccaatatgcctttaaaaaaatcaaaaggctcagatgatgtagttttctatcagaatcttttcttttttccccgtcacaatagcattgctcagtatcatatgccaacctttttttttttttttttttttgagatacagtctcattctgtcacccaccccggctggagcacagtggtgtgatcttggctgactgcagcctccgcctcccaggttcaaaccattctcgtgcctcagcctcccgagtagctgggaacacaggtgtgtgtcactacgcctggctaatttttgtatttttagtagagagagggtctctgttggccaggctggtctcgaactcctgacctcaagtgatctgcctatctcagtcacccaaatttccaggattacaggcatgagtcaccacacccggcctcatatgctgaactttttcccatcacatttgcagaacgaaactcttgaaaaggaagtaaataccccataaagcagaggacttatatttttattttcatgaataattaaaaagccagatacacttctgttgaagtgtaagcttttatcgtgtcgacccttgcaaattgttagattctccctatctccatcccagaccactttggcataaccaatcagtttaggtaaaccaatattagtgtccaccgcctaatattaacctctatgtacaaaaacaaaaaacaaaaacaaaacaacaatacttcagttttgtttatgcctcagaataacaaatgttagtatacaacgtgggtattaaaaggtctgtgatttgttagaattgacctaagcatatttaacaataaaatttttaaacgaatatttgttttaaatagttctattaaaagcaatatgtgtgtatacgcttcataattagtttacaagctattcactataagatgtcaatagataaacctaaattacctaaaatccaactatctgaatctttccactagttctacagtaagagattttctaagtgtatccaatttttatggaaatgggtagagagagagagagagagattgaacaagatgatataagcacaaaacagttcattttctcccgtttctttccttacttcctcattccttctcccttcctttctttcttccttctaaccctctcttccttccaaatatccctccctccctttcttcttcctaattcgtcctcccttcctcccttccttccctccttccctctttcctctttttccccttcccccttgcccccttccccccttccctccttccttcttcccttgcaaagaaaggagcttccttctttcctttccctctttaccttttttgtccacctttgatgaagacctcacattgaatagaattctacttggctgggtaccaaggcttgtgcctataatcccaacactttgggaggcaaaggcaagaggatcactttggcaaagagtttaagaccagcctgggcaacatagcaagatcccatctctaaaaaaaattaaattagctgaatatggtgatggtcaccttagtcccagctacttgggaggttaaagtgggaagattgcttgagcccaggagtttgaggctgcagtgagccatgattgctccactgcactctagcctgggctacagagcgagaccctgtctcttaaaaaatataataataatttgacttaatttagtgtattttgtatctagagacataataaactcttgctgtttaggaaagaaattcagtgggttagaagaaggtagagacactcgttatatgataaaagtccctcccatttttaaattaaactccagactttatatttagatttcaccagtcttttcatttatgtccactttctgcttcaaattgaatctagaatgtcacatttcatttagttgtcatgtttccttagtctcatttggttagtaatactttctccctcttttcttgttttcctgaccttttgaggaatactggtcagggactttggagaatgtcccataatttaagattgtctgatgtttgtctcatgtttagactgaggttgtgttttttgagaaagaataccatagaaaagtgtctttcttgtaacctcataacaggaaatacatgatagtcgcatggtttgtcactagtttactcggataagacagtgtttgccaagtttcttcactataaattttttccctccttttttcttggaaatgagccactaggtatagctcaccctcaaagaggggagtaaataaggccttttttgaaacatggaccttgatggtgtaaagaagaaaggatagataaaagccattgccaggtttagatcacatcgctaatgttctttcactgaagactcaagtcacagaagagagaatattgtcctcttgaaagtaaatagaccatgatggggtaaactcttctaccttagggttactcatttttaatattcatagttggtagtgcctccactaggtgcttagaagtagtgggttctggactacatggctaaggactgagcttggctacaatagcaatgggtaggccagctgagcatatctcacctatggtcttttatactcaaagaggctagactgggctttttcacatggctaccccagctgtccccagtgtgcaagccttgcttgtttcacacttggtgatatattataccattgaccaaaggaagtcatgaataagtccagattcaatgcaggagacattgtgttaatcaggttctccaaggaaagagaaacttatagtgaagatatttattataaggttattggcttgcacaattggcttgagaagttccacaattttccatttgcaagctggagaccaagcttgcaaatcttggtatagctgatggtatagattgcagtccaggtctgaaggtctgagaaccaggaatactaagggcaggagaacaatgatgttccagctcaagcaggcaggcagaaagaaaattgaaccttctccttccatttgcttctgttgaagcccacaacagattggatggtgtctacccatttttgggagggccatctgatttacttagtccaccaattccaatgttaatctcttccagaaacaccttcacagacacacacagaaataatgctcaactagatatctgaaaatcccatggcccaggcaagttgacacataaaatttcccatcacaagcacaacatatggagtgaataccaaaaaatgtgattctctaagaagccttcatgtaacaatctatacattggcacagcgaataactagttaagttgggagtagaacccaaataaatcctactttagtaccatctccactgtagcatgttgaagcaaagtgtaaaccaaaaataaaattctaaggctcccccgccatctgaacggactttctcctcagccagggctgttttaaaatttaacctgaaagactggttcaggccaggaaagtggaagtcagacatgcctcattttacctctctggcattaacatcaacacagacttttaagtctgataagaaacattttacagcctattctctacgaagcctactacctggaggctgcttctgcatgataaaactttggtctccacaagctcttatcacaacccagacattcctttctgttgatcccagatctttgtttgtttgtctgtctgtttgttttgagatggagtctccctgtgtctcccaggctggagtgcagtggtgcaatctctgctcactgcaacttccacctcccaggttcaagcgattctcctgcctcagcctccctagtagctgggattacaggtgagtgccaccacacctggctaatttttgtatttttagtagagactaaaatttcaccatgttggccaggcttgaactcctgacctcaagtgatccaactgcctcggcctcccaaaatgctgggattataaatgtgagccaccatgcccggcctaatcccaggtctttggataaactcaaccaattgtcaactagaaaattttaaaatctgctctttaagctggaagccccccacaccaacttcaagttgttccaccttcctggaccaaatcaacgtatttcctaaatatatttaattgaagtctcatgcctccctaaaatgtgtataaccaagctgcaccctgaccaccttgggtacataatctcaggaccttctgaggaccgtgtcatggtccatggtccctcatatttggctcaggataaatctcttcaaatatttgacagagtttgactcttcataaacaaaagaaagattgtttttgtactgtgtttactaaagcaggagatcctacttttggattatatactcacaacttgcatattttaggaagattttcggcaacaagcgttgacatagaaaaagatttctgtttagacttttacacaattagcaaattctgtgaaccatattctttcttgagcattttactttttaacatattgaataagtaaaagaggactagaataggattcattggcctgcctcccatttccagctctttgactatgtgggtagataaccttcagcaaatgattgatcttttcttggtgttagtttaattatctgtaaaatgagaatagtcaatagttttttgtgattattcaactctagaaagtcctgtgatatattctattcttcacatcttctccttcatcaactcttgctgtttagcaaaacaagctagatgtttaagtctagctagattcaacaatggaacaggaaacaggaagactccacagaggcggaaatggattcaaatcccagttctctcagctaagaactttggagtctcaggtttaaccattctgagtatatttatttgtttgtaagtggaaatagtggtagtacctcatagggttttgagagaattaacttgaattgaatgaagtactcgggaaggcatgcatcattatagtaagttcctaataatggtgtctaccactatttttaggataagtactattgacagtaatagcaaatcagacagattaattatttatatcataatctgttaaattgtatcctcacatgtaaatgatgtaaatgacttgtacccaaaatatctgacttatatctcagaaatttttacaaacaagtcctagctcctaagatatgaggttattttacttttcaagtgattaaattgaggccacgacttgggaaacatgatatataattatttccttaacttagaaatcagtcttcctatgagaggtcatagttcccagtgggtgcacaagaaaagggtcaagttggaaccagacatcaccctgtcccaagtgcaacgtgagatcagcaggagcttgattattgatttttgtttccttcttctcttgggtttgctttcttttaggagccagtggaccttaattcacacagcttaggaggtaaagccagctctgctttacttacccaatgatcttttcctggagatcatgttccttttgtccttttgtcttgaattgaaatcacttgggggttataaattttatctttttaaccagatagcaaatgccttaaggatagagcagcatttttgatatctttgttttttttcccccaaactacttcctgtagaaacttgaacataataaatcctctaatagttttttaatgtagctcaaagagctctgagaaatagtgaaattcaacagcaaatacattcagccaacattttgtaatagatgtggcataatgcatttaaattatgaaacgggccttaattcttgtctcttaatgccaaggttttaaatttctatctttgaatgaattctttaatcataaatattgtccattctttcatccaggtggtatcatcagagctaatacagagtgaattcattaatgttaaaactaactttactccctaattatgagaaagtaagtgtgcatacattacaaaaaaagagaagtggttaaatattaaaatgcttgttcttgaggctgttgtgaggcttaaaaaacttgaaaaaattttcagggatcacacagtagtaaaaattactatagcagattctatgtttcattgttctgccatccctggttctgtgatgcttctttttttatatatattttttattattattgtttctattgttattattttggttcaacccataaatacattcatcctgctcagttttcacaaactgaactcatctcttactggtaaagaaggaagaaatgcctttctttggggaagaaactactggcaacttctcctaagacttgagggcagaatgagatatctatgacagattttcctttttttcctgtttcttgcatttgctttctgacaaaatagagaagaaaaaaaatttctttctgaagaaactgccacactctgttgtttttgattttccacatgaacgcattccatttaagcacaggagtgtctcaaaaggctggcttctcgttgagcaagtatattaatactttttcttctacaacttgtagcctgatcaacagcaattatttcagtagccataatacgccaccattctgaaaacaaataaatcaaatgctttttaaagtcaagggtaaggctaaatacagaacaaacaaaaggaagtacttattgcgtgtattaccttccagtggaagtgggtataaactacaaagatgggcataaaagggtaacaataatggagacaccatgtcaagccttgaatggactgtattcttgactatactgatcagcctttgccctttagactgacatcaaaaactctgccctccctctcagagccctcaaactgccccaggctgctggaatctgtgtgacagcctggcaaggttaacgttaagaaacacacaaaaggcagaaaacaaatagtgctgctgccgtcttattggttggcatactcctgggatgatctataatcatttcttcagcttagaaatcagcctcatggtctttggggtagtattaaagctcctgagccctgtgggttttgtcccttctattgtttatatgcgttcattcattttgccattaatcttaataaggatataagatttactttctttgttgttgcctttaaattttgaagaaaataaagcagaacaatgaaaagagaactctagctcgtaagatttatttgcaggtcagctgtgttaaaattctttccgctcgacatgtaagaagcttaaaaaagtaaattactgtcctttttaaaaaatgctctaaagcattagtgtaaaaaggacgttaggagagaatcattatcatctctgtgtgtttacaaagaacacacatgaatatatgcacacacagtcagaaaagtagttctttaagaattccatgccacgaaagatttaattaaccttttcactaggaaaccggttctgggcactgccttcattatcccctttctgtttccaccctaagaatctcacactctgttcctttcctctgtttttctcgccccatcctttttgcccattctttcatcggtgactctattgttaaatttaccagctggtgatagattcacatactcctcttcatttccgatagtaacctcctcacttccacacttcaacttttgctgttacctgcttgattgcattctctttaccttcaaaaattttaattgaaaaaagctatattgacctaggagtgtaagtaaagtcagttgaaatggttggtagtctacgagctttgaaatattatttttccacagggtataacaatttctcttatataaatgttatttatggtaatagaagcaaaggaacttcactataaataataacatttagtaagtggtgatatgaaggaatgcattattataattaccatcataattttcctgttattatttttaaaattttagatattaaaaaagacttaggaacacaggaagtatgctccccaccaagcactaggaggccattgaaatcacatacagatcagctttacattttttgatagtgtgttcattctaaagctaacttttagaaattattttgttgttgatgatgatgatttatagctgttttccccgtttcattttatcctatctattgttaacagaaaataagggtgtatattcatatagcccccatctttgtaatgcctggacatgttggttgctaggtaacaggacactatgaggtaagcaggcccatactgtttatctctgattgagcagaaatgcagaaccctccgcaggagaaaagtcctctgaatttccttgcatttttgctgaaccaaacagaattattattgcatgacaaagtaccacttagccttatgaaacttcctggcagtttcagtttaatcattgctgtaaagaatctataagtctttcttggttattaccacaaaattgtgtagcaggtttacttccctaaatcaaaactttgttgtccaggattctgttcccttttaatctttctaggttattaaaatttatcacagcagttacctaaacagaggtgttagtgtctgatgtcctgtattctaatagactttttaaaaaatcatatattttgtataaacaatgctgtaactagaataaaaggtcaaataatcagataaaattgtacggaattccaccactggaaagaaaaaaaactactcttcaaatttcttgacttttaattaaaatacatgtattatgtggaagtattaggcatcacatcaggcttagagaggcgtagattcattcataaaacattttctgggtgcccattgggttcttgggactgagcagtgatgttacagaaagcaagacagcatcctggccttacctgtgaggaaaaagctataaacagacaattacattatggcaaacttttaagcagagcatagcgagagtgtttgggagcacagaggaggaagcaaccaactagacctgggggaatcaagaggctttgagatgctatatcttgaactccccaggagttcaactttccaggagaagaaggccagtgatgtttgctggctctgccagctaaccttccttgtccatcatgcaaagcactgttctgcagggaagccctcctggatgtcttatcccaaatggaattcctttgtcgtatgttctctcggttccttgctctcttccatcagaggtcttatctcagtgtttaattatatattaaacagtgttatttaataccttaattgagattaatatcttctccaccattatacccagctccatcaaggaagagaggtagcaggtgttactcacattatccccatggaacaacacagtgaattgcacatagtgcaaacccagtaaatgttgaatgaatgagtgagtagacttgcaaatcatgtcatttaggtggctgccttccctgccttcataataggatggccaagtttatattccctgtcttagatgttgttaaaggaaaaaatctcttcttacactgcccttccccatctaaatttaccatataaattatatagctgttgccttttgcctaacatagataacatgatacagaacacttttagatgaatgattttgttggttaaaacgcagaagaaaaatactggttagtttttacatgggtccaactataatgcctgaaaactatagtgcctgaaattccttctgaaactgttagtaaattactattggtggtggggtcggcatttattaagtgcttactctatatcagactttatgttatcccttcaatttatactatcacattttaattctaccacaacatgactttgatatgctgttagtcccattttacagagaagaatgcagaagtctagacaagtcaaatggtatttcctgagttctcagttagtgggcggcagaactggatgtctattccaggtcagtctctcctccaaagccatttttttctcactgtacccactcccttatcctccgtccattgctctgaatccttaggacacatttatctacatatcaactatttttggaatccaaatttgccagttaatttccatgctatcagggagatgatgtgtcagttgcaaacacacaccaaaaatttaagaatactcattaatttgattgacaagagtgaaatttcttattctaaatagggataacattaggcaaaattgttcaaaagtagtggaaatattgtttttattgattaattggttggtttggggagaaattatcctttgtttactctgaagtagggagcatttctgattagttccttttgtcaacgtatattaaatatcaaaggagctgctgctaattctgacttggttttggaactgccacagatggacccactggtaggagaggggcttactgctagttcactagtagagaatgtagtactggattgaattagaatcaagtcttcttttcagtctgcttgttcactaacacgagcgcagacaatgtgaggagaccctctgtgccattcgtaacagaaagcagggagaagtgccacttttgtgtagcttccaacatgaagattgacttttacagtttctaaatagagttcttcccttctaaaaaaaatgctgcaattataataacttaaatattacaagcccaattttatctcacctaaatctagagggttaataaatgttttcaatgtggtttattctagaagctttgagaatctggtcacataatttgcactaaaagcatttagctttgtgaaagccacaccaaacttgccattattaactacataaatagagagggcaatttgctaatggggttccatttatggcagtttatggattgcctaactttgcccaattaactcaggcacttccaaatatgaaccggtcaatgtaaaacactgaatggttttaattcaatagaaaaacacattacctatttggatgtaaagaaacaggaaccttacatcccagtgcctttactctacagaccaggtactactgatacaaagtgggcagagcaacaacgagaaaaatatcctgctgggataaaacatgcactctagtgggagaaacaagcaatacttagagaaggatttggaggaaaatgcattccaggcttaggaacaatgggaaggaaggaaacctgtcacattccaggaacgtgaagaagaatagtgggcctggagaaccaagagccaccaaatgcttgtgagatgaggctggagaggcgggcaggaactagatcatgcagagcattacagggaagtcatacattccttatttcactaaacgccaagcatctgctatgaggtgctattctgggataaagaagtgaacaaagccagtgatgtcctaggaaggcagataattaacacgaagcagacaaatataaaatatgtcaggtagtgataaatgtagtgaagaaaacaaaacagacagagtgaggtggataatgactgggggaagggttactagtttatagagagtagttggtaggataaggtggtgtgtacatcaaaatctaagggaagtgggcctcgtttaagggttttagcctttcttcctaagagcaagtgctaagtcattgaaggattttaagtgttgaggtgacattatcagaataccatctgactggatcattcaggctataggatacaaaagagactaagaaagagtagaaacaggaaaccattgagggtattactgcagttttctagagggagatgtggtggctcagaccacataggatacgtggctcagtgtgaatggatttcatcactgaaactggttcttatttccatgtggttctaagtgccatttttgaaaaaaattctgaactaggagtaatgaggaatgattgcaagtctttgtctgtttgacctcaagccacttttctgctttatgccttctctatgaaagtaggtagtggttccaggtttttctacttcttaaggcttttgaaaaaacagatatgtaggaaagacttgaaatatgtaaaactgctacatcatataaggagtgggcagttggtattctataataggtaggatgaacactactaatcctgtttaccaggctagagaacatggagctctttattcttctaaatttctagagcaaacacagggacaatacgaaggaacccacaattcagattatttatttttcactttagatagtatgtgaatgtgatttaatattaattgacatattgattgaactcaactgacaaaaagtctatattttaacaatatctaaaccatggcctattaccaaatgctaagtttaggtacagaactaagtgtccagatccattcccaggtctcaggttctgaatctcttcataacccctccaagagctcccttttgaactctcagagaagcttcactgatggaaaggggagaaaagtgaatctccaggctccttccaatttgcaatcccagtaccttcctttgcataacccatagtttggaacatctccctatgctcagtcaagaaagaaaaaaagtcttatgtcttatgtacatgtacagtgggtaaaaaccacgtatgtactgttggtaaaagcacacagctccaggtgaagaaacaaccaatggaatcctcgtatgcaaatcatatggatgcatttgaataaaattgaaccattatcttaggaacctctagtttccaagttgatatgaaacatatataatccttgtctgtaccatattattttgcttctaacaggagttataccatccatgtgtttatttccatgacgcttaaaaacgataagccaaaacagttcatttttctttgttttgtccataggtgttcttccaattacctctgcccatttattaaaatatacattttggacatgtgggtttattcactttgtggtgaggttatattctgtggatatctgacctttgttaatcattgtgtggccaaatgaaatcaaacacatgcattgaagcagtgaataagtcgtggggttagcgagtttgatggaatcacaaccagcaatttaaaaatgtgactgaatttttcccacaattaaaatctttcattatgctacttcaaagctaatttctttcttgtttttttttttctgaatagttgcttccattaatctcactctaggtaatgatggtaatgatacaattatatgtaatcattgcctgaattcaatatgcaacacatcagtccctttgtgtggtgatcgtacactctctgcagtcctgggatttggaaagtttccatcatgttatgccaagatcagattcaaaagtctctgacattttgcataacatcagtcagtcgtgtgttccaactgtcccttttagtgattgggcaaactcatccatctgactgctgctggtggaagctagggatgaaggcatgaagcaagataagctggactggccttttacatagtttccaaaacacttaaaatattcagaaaaaaaaattaggagcaagaatttgtaaaggatcttcaagtgtacaggtggctaatccgcttaaactactaatgacacaaatcatagtctaagtgaacttatgtttttatgcaaagttaatatttattttaaaagtttaaatctgtttttctaatatttatagctaatcttaccagtggttatcattcaggatgaatctgtttctcaaaatcctgataggtagatgtgtgcttccaattcctattttttttaccactatgcagatgccattttgattcttatgttccaaagacagattttgttccacacacttacttattcaaattagttcaattaaggaataatattgtctgtatgttccaacacaatagaattgaacatgttcatgtcttctaagaattaaataataaactatgcaggtagcattaagatagtagcttatcttatgcttaaatttttttctttgcctttcccattttgtttccttcttagaatacattggagggctttcttggtctctggtaaatatttacaattcataattttactctggcctgttaatttgatttattgatcatttctctttaaaggacaatgtcaacacaagagtgaggcatgggttgcagtgggtggaatgacagtcatattgagccctgctatgttttggatatggtttgtccccatcaaaactcatgttgaaattttgattcccagttatgacaatgttggaaggtggggcctagtgggaggtgtttgggggtggtacctcatggaatgagtaatgccctctctcaggagtgagtaacttctcgttgtggcaggaatggatgaggtcctgagacagcaggttgttaaaaagagtctgactttgtcagtttctctctcttgcttcctctctggccatgggaaatagcataatagtgtttgttttctccactctcccatctccctctcttcctttctctgttgtccacttcttaaatatatactgttcaagtactattatattttcaaatcacgatctgataaggtggaagggattcaaggtaaattagaaaagctccctgtattcacattcacagagccccttctactcctgggaagagataagatatgcacttggtcactactaaaaagtaggaagcactgtattatattagaaagattcttatatgggagtaaacaaaatccaagccttctcctcaagggctaactggatgttcctgtatcaacatcaatattgaagacaattctgcttcaatgtaaaggggtacaggacagtctactgtgacctacactcagagggtctttgatgtccacactgtcaatgttatacaaccgagctattcctcaaatcttaggaattctacttctgaggcttcctctggcactctctttcacttccttcagaatatgatggcagtgcatgctgatctcctcatttccatccttcttgatggtcagggcacacttaacacttactcctgttaggttattcagccaactggccacatatcattgtggctacacgtaatagggcattttcacatagctcaccagaatcccttttaggccagcctacctctgttccaacagaactctacatgactggctaagcccttatagcatatcaagtctgagcttcgaaaggattttcctagtttgggggcactgctcaatttccctttgtttaccaaagaaacacaacagtatctggcagtatttgattagtccacctgtggtttttggaattgaggtaatgttacccctactttgtcagcccacacttcccaaaacagtgtccaaaacccagaaacaccaaattaagatcccatcaccatccataagattcagaaccccattagatccacaaattattatggacaatttctatttcttgtgaactgtgcaaaagtttcttgaggagcacaaatcaattgagcatgatccatgagctcctttgcatatcaccctaagaatgccatgagcttacatggggtggatttaagagggttggagataaatcaactagtatccagggctgaggtcttaacaggaatcctcctcactgagagcttgccttgatcatatttctgccaatccctcagtccttctctacaatttccccttgacagcatgaaaacatgggctgatctgtgtattctgacttgatgtcattcttgtcacacccagaacacagatcatcttttcccactcccatattcttccaggatccttttccatggtagttctactccttaggttgatcatcatcttctttcactcttcccaactacagagtgtaattaatctagccacttactgggacccacatctcctgaccctcccccataacctttactctttaaatgaatatactgctcaaacctattccaaaaattgagtgtagcaaagacttcaatttagtctgatttgcccaaacaatatggatacatcttgaatcactcttttggaacattagctaaatattttttaaaggctaggctagtcgttagctaactttttctttttccttttttttttttttttttgagagtaagtcttgctcttgtcccccaggctggagtgtgatggtgtggtctcagctcactgcaacctccacttcccaggttcaagcaattctcctgcctcagcctcctgagtagctggtattacaggcacctgccaccatgcccagctaatttttgtatttttagtaaagacaaggtttcaccatgttggccaggccggtctcaatctcctgacctcaggtgatccgcccaccttggcctcccaaagtgctcccaaagtgtagctaactatttttaaagtgtgtagatacttttgcaaataaatgtagttaacgtatatacatacaatttaaaaatgtatactcagactatttctcaatattgtgggctgttagcaagcagaattattttaaaaagcaagttttaaaactcaaagccaaatattgttactaaaatgtttcatgggaattggcagtggtacctagagttttaatgcctttacaaaccaagagtgtataggtattgtggatggaacatgtgactgttcaagggaaacctgacaaaccatactaacaatggattattgcactcaaagaaagatgggaaacaaaagaatccagagaacagtgcttttgttttcacgacccttcagttgtctttgactgttctttcttttggcttttctgctttgtaagagtctttgattcaaggctgtttcatgatccactgaactataaggaaaccatgggtctaaattgcccactatttcctttagtgcactgttagatgtagtcagtcctgggaacttgtttaataaaggagttttgaaaatgttcagggatcttcttttttttttttttggtatattgtataattaacaatgacttttgccttgaggtcaacatacttccaatttttcctaaataaatatttactgaaaagtgtagatgtgctgtaggcacagctagtgtgaactaagctctgagctaaatgacttaggcacatcattgtaattttcccagtaactctgaaaagccaatagcaatattttaattttatagacaagaatatggaagcttggagtgattgcagtttgtcatatgtttatgttagaatttgacttacccaggtatgtgtgactctaaatccaaattatttttaagaccttaggctctttcaggtcttttatctaaaaatgctacaaaaagaaggaaatggggagatgtagataaagatttaaagtagcagatatgtaggataagcaagtctaggcatctgatgcacaacatgaggactataggtaataacagtgccctatatatgagattaatgctaaatgagtaggttttagctgcccttgtcactaaaataaacaaaaaaagggtaactgtatgaaatgatggagatcttcatttgcttcactatagtaatatttttactatttttatgtattttataccatcacatgttataccttaagtatatacaattaaaagttatttaaaatataaaaataaaacataaagaatgctgcaaataacagtagctcttttttgtagttataaaaagatatggatatttaacattcccattgctaagcttccacactaagcaacagtaacttattaatattacccagtaaatcctaagtacagaaaagattaaggcattgtgcatttatttttattaaaataatttatgtaagttttaattcaaattaggctcagctttaggcacctagaatattaattcagaaagtagccttattagattagcttcaaatgcacagaattttggtcaaggacattgaagtaaacattttatctttattagccatcaattggcaagcatttattgagtaccttctaagcactggggaggagcttggacctgaaagaaatttccatctgttggagccatatgactaaatcacacgaaacaacttgagaaagaagcaagaaagttcataattaagtgctaatttgctgtagaaattcagggaagcagtaggttattgaaagcatcaggattcaagaaaaatgtcatggaagacatttcattttaggtagccttcaaaagatatggggcagctttgggtaattggagaagcatgaaaaattcataagaaataatgagtagaaagacttgtgttgggaagtaatgaatgaggttggataaattgacgcatcaggttccagagaatacttataataagttgtctgttttcctgcatagactgtcagctgagtaaggctagggaccctatgcttcttcctcatctgtgtcttcaagcgcagtgcctagcatggtataggagcttaataaatacagggtagctcctcagtatataaaggcagatgaatctggatttgatgtagtaggaaatagaaaatgcaaattagaaaatatagaaataaatagctatctgatttcagtgagcatagttgttaatattactggtctcatgttgctgaaaagactcttaatttggggtaaaatttccttcaatcacttatgtatgcataataatggaggtgaggagataatgggccatgattggatagtagaaaagttactttctcttagctgcagactcacataaatgctagtgatttgtttgcatttgcactcctgagcacacttcaacagaagtgaagtcgaatctattttgactagaagaagaacaaaagccctgagtggaaagtgtattaaagataaatgtgacatattcattcagtcagtcagctgaagttgagaagaagatccacaagctcagtcaagccttcaaatgactgtagcccagactgacagcttgacagcagcctcaggagagaccatgagggagaagtactgggctaagctgtatttagatccctggccttcatagactgtgagctaacacacgtttgccgctttaagtcagtcaacacatctgactggaaggcactgagtgctcaacactgtggggatatagagaaaagccttggcttctgcccttaaggaactcagctgggtgcagaaaaagacacatatgtacaaacacatactgtaagaggcaaccggaagaggattgagggcagtagaggcttcacagcagaggtgacatttgagttaggttttgaaagatgagcatgctttgcacaggtaaagaggtttgggtatcctgcattaactgttctactttgttgaggatattgacaaaattacagaaatgaaatagttgaaaaataaggctaatagtaattacaacaacaataataaaatacatttacttcatggttttaacagtatttccatatacattaattcatttgatccacacaagaaccaaaggagattggctgagcagttattgttgtacccattttgtcagtagggaatctaaggttcagagagaccaagtggcgtgtccaaaataatgattctgctttatggaaacaaatacaaagtataaatcaatgtataaaatgaaatgaccttaataaaaaccatgctagaagaggtcagaaggaagtgaaatcaattctgtagaaattttgaataaaaactgcatatggtgtgagtgatgcatttgtcacaaaggctgggtgttttgtctcaaggggcttctcgggtaggtgaatttactggtgtcagaagtcaggtgctcagctttgtaagctctcaaacctgacttagtcagcatatacgaaggtctgcctctccagggaatagtcatattattaatagcaaagtgcatagacggatttattaatttgcaatgagaaatgtcactgccatgtaccccagaatattctgttggcacagctagtacactcattccctgtaggcagatatttgagggaagctctattgtagtgaaagagaaagctgttgttgcccatagactcatacctgagagttggctagatacatttaagaggtgtttcttggcttagaggtgggatggggagattcaagcactttttcctgtgtttagagatcaccctgcaggaacatcagtgccctggccaaggctcacttgtcccccaacataagtttgcttctatgaccctctgtattagtttcctagggtagcaaaataccaaaaactaggtgacttgaaacagcaggaatttattctctcacagttctggaaggtagaaatttgagatcaaggtgtcagtagggccacactccttctggaggctttagagaagaatcctgttttgtctcctccagattctggtgattttggcagtctttgtcattccttggcttgtagctacatcactccaatctctggcttaatctcaggggggcttcttccctctgtgtgtgtcctctcttctttcaaggacaccagtcattgggttcagtgcccactgtaatccaggatgacctagttttaacttaattacatttgcaaagactctgtctccaaataagtttatattcacaggtactgaagattagaatgtagaaacaccattgtacggggcacagtttaactcaccacatgctttcttcccatgcttccattattgatcaacctcactcccaccctatcctgggtagacccattctgcactcaaatgttaatttgacctgaaaacctctttgcttataactgacctggctttttatatcaatgacttcagggaaaaagagagtaacagaagttagaacagtattcccctaaataacttggtttttatttatttttgtttccaaatgccaaatctttcctctatttctaaacctacagatggaaaatctctgcaatcactactctattaagaatccactgttagtgatgtgagcttgtggggattgataatagtttgagaagcaacctcagggttgggaggagggaaacttaggaggtgggctttggccctccctcaacccacccaaactaaaaacagtaatgatattctttgacagggtaatgctgttttatttttcaatcttctgtcaaatggaaacaaaaggatctttgccaagtattttactttttatgtacaatacaaattgctacaaatcaaactttaagggaagcttcccagcactcccttctcaccagattagtacctcctaaacctctgccctatagacattctgccaccttctgttgtttaatcactgcattctgaactgatttgtagtctctctctgtattttattttattttattttgatacagtctcactctgttgctcaggttggagtgcagtgatgcagtctctgctcactgcaatctctgtctcctgggttcaagtgattcttagcttcccaagtagctgggattacaggtgtgcaccaccatgcccagttaattttttgtattttagtagagagagggtttcactatattgaccacgctggtcttgaactcctggcctcaagtgatcctcctgccttggtctcccaaagaattgggattagcagcgtgagccaccacacctggccagcttctcttttagaggctgtttttatttacaacatttctaaattcatggtgggagggtacctatagttataccatttattaaagtgagaaaatattcatgtgaggaaatcagatattaccaagtataaaacaatacaattataaaaaatgagaggcaagacataataagcatggctgaagaaaaagtacagtcattagaaagaaatgtaccctttaagaacagtcctctgatatagaagccaggagagtttgccactcctataggctgtgaccttgttcacgtgactttccctctctcctcaacctgcttttctctaaaaggaggtattgataagttaatggctggtgtgtggggagtcagatttcttaacgttagggaagttacagataactacaaggcaaatcaaaagaaccctggggtattggatttgagtcagagacattagtgtgagcttttatcagtttaatatatattcagaaataattgtgcatgtgtgtacacatgggcagttatacatatatagatttgtatgtgtatatatatttaatacatacacattatatattaagtgtatatattacaatatctaaatattatatgctataaaaatataaaaatataggtagaatatataactatatattgtatataaatatatatcatatataatatatattttatataatatttacatataaaatatatgggatatatatctttatatctatgtgtctgtatatataatataatataatataacataatacaatacaatataacatatatcccagcttttccattgagagagactagaagcagtgatgttccagtagcaacaagtatatccaatgcctcaattttggtttttaaataccattctctagtaaaagggatattggctccttggagaaataactgactctaaaactgggttagagaaagtatgagatgagccaagagcatcctgtagtcccagagagccagggactgctcaaaacaaaaaaatgccaaaggtaccctggagacaatatgaaagagctcccaattgtcagagctgaaacaaatctgagcaacaaaataggatgggattggattacaattcacaatataaaataaatatacatgagtacgtgctgatataaacaattgaataaatgaacaaatggggaagaagtcataaatctttcttatagatatattccaaataatataagtgtgggcaggacttagtgactcatatgcaaacaatagagcatggaaaggggataaaacagtaacagaacaccccagaagccactggcttgatcagtgatcaaggttaacatcactagtaacaagtcatgttaatagcatgtcccccagtatgatatgatgaggagaacacttcacttctatggagttcttcccaaaaacctgtatctcctgcctgatatgagaaaaaggtgaacaaatccacactaagggacattttgcaaaacgcctggccagtactccccaaactgtcaaggtggtgaaaaagcaagactgagaaaccatcacagtccagtggagactaaaaagatatgatgatgggatgcaatgtgtgattcctgattagatcctgaggaaacaataggacattagtgtaaaaaactggtgtaaaaaaatgttgaaatccaataaaaatctgaatttcagttagtagtaaaaaaataataataaaggaaggtgttggtccaaatggctcagtcccttccggtataggattccacactgttctataacccagcagggtctcaaaggaagtgttgtacgcaaggacccagtgttattctttctaatttattttatatttttaaaatgcttctttttacatatacttctttttacattcttaaaaatatagggagttgcagcaggctttgctgcagataaagggaccatggacaccctgccaccagttacagcaagaagaagagagggtagagctgagtaagagatgggactggactgtggctctcaggagaatcacattctagtcctgcctgcctaatggcatatgaccttgggcaagtcacatttctatgcccaaatttatctgtaaagtaaagaattaggttagtaattatctaagtttctaattgtaacactgtataattctactggttctctgtatgtacaagtggtagaagtcttaagaatagaagatacaatttctagagcagataaaggatgctcttttgtacaccacagtgacaccttctgggggaatcaagggttgcctccctgggttgggtagcctggaaaatcagattttatgtgggaggaaaccatttagactcaattttgacatcagctgtaaagttgggtaaagcaggttgaaaggaatgaatttcgtaggtctcttttcttgcctctcattctctcctgcattatctagcatcattctgacactgacaaaaattaactgtggcatcctaagcaacttacttaacctccatgggcctcaatttcttcagttataaaatggagattaaaaataattactttgtattactttatgagaataattgaacacatacaattccaagactgcaatctgttatgtaatcctttatttgagtgttaggacttttccagcctcctgaaactcttcaattattaatgacagtagtcccttcatgttggatgatagagagggttgaagagcagaatcttggctgctcatgtctttgaaaaaccctgaattgtgtcaacaggatagatttactttttcctaatatgagaacttaaaggaattttggacatagttatagttgtttgctgaacatgatttatgtttatgttcataaatcagcaacattcaagtcactgggagtttttttccagctgccactgggggtaccaaagtgggagcaggaaaacacagttgtggctatggctggcattcaatggtagccctagtggaagatggataactggggagtattttgaacgtgggtagatttgtgttaaatggattttcaagaaaggttcttctccagccagggcttctaccttagcacatggtcttagtttattgtaaactatattttcaattataaactgcccagcctttccctctgtacatctgccctcctttttgtggccatgagaaaggaggaatctgttgcaaggcaccactgggacccaggtgtctggcagaacaactggtcccaggaaggctgtggctcctttacacatttaaaatctataaggtacttttaaaccccatactcaaagtttttattctgagcattgaatgaatgtattgttagcagcttaaagttaattttggaagaaaacttcaaacaaacaagaaatgaaaaaagctatttcataagtgcatacactaaagcatattgacacatataacttaaaacaattttcagaatttaatgaatatggtctttaagatgtgaaacatccttaaagttatatacatatgtctaataaaggaccagaaagtggaatcatatgtgaccttgaagcctttctgttccctgttatctgaacaaagcaagtgcctggagagttccttaataaatatgaactttccctcttccttcatttctccatttcaaccaaaaactgtgctatcagagctcaagctcaacaggacatctggagaagagtgatagagccaaatggagtctatgatcaccccaaattcttagagaaaggagaaacagaaagaccgatcagtcttgtgccatcttcataaaaaacaactgcagtttttgtgttctgaagttgttcacatgattagattcagccttctacaaacacttactgagcaccaggtgcctggtatgccattaggaaatgagtctatatctctcttgagaggagatgcagataagcaactagggctaaactggagctcacaaatgttctaagagggtgaagtaggaagaattaattgcagtggaaataattagcccaaaattcatgaatgacgggatatttgacctggatcttgaaacaaaagtagtattttgggagataagatcaggtacaatgacaacatcaagttatgagagcctggaatcgaaggctacaatatagtcaggtgaatgtcttgggactggatggatccacagttgtcaacacatgggctccttgcatcagaaataaaagttaataaaagttagattccataatttttaattctgtaaatgtgggatgggaccaagtatctgctgcacagtcagatttgggaggtaccccacagggataggagatatttaccgaaagtaacattaaaaaggcactttgtacttttacaagctgagggatcttggtagtccaaggagtatggattgtatcctgtagataaaacagagatttttctttacttgattgcatagtattttttggtaaagttggaatatttccacttagaaatatttaaagtattcttttaagatcctcctcatcaagaacatttaaaaatgccagtttgtgaacttaaggatgaaaacttctgactaaaaggcaacaaatacaaagacacacacacatacacacacatgcaatgtggaagtttactgttatccacaatagttataagactcttccagtactaatggatttccatctgacgatgatgtgttcatggcagcgatatgggatgggttatctaccttaggattgaaggaccctagaggtctcttatctctgtcactgatatggagatcaattcttcctgtgcctcagttttctcctatgtgagaacatcataataatgcctagtgagtatcaaatgacccagaaaatagtcattaaaaagtataaaaagaacttaaaaatctaaaaatggaatatgtaaaacccaatagtacatacagaggcatatccagacaagtgtttcagggaatgctttctgactttatagttttaggaaaataatcacatttttaattcgtttgcaaatatgtatagacatagatataagtgcattgttaagtagagaaattgtaaatgccatacttctaaacataaaagtgaatatgtaatgtaatcattgatccaagagattccattgtagaacagctgtttaagccttctggaagacgtttttggaaatatgattgagaatctattttggatttaacagacatcttcttatatttttctatatttttcttcattatcattaaagggtatcatctgctcttggttttgtgttttaatttgaattcacactcttacaataaggtcacctatcttactcagctctgtgaaactgaatctaattttagaataaatgaagaaatcaaggtgtaggtaacactcataaagtttaagaaggcctgtgttgaattgggtatcttcttgggctacttggataaatgattccttttatttaatgaaatcttttaagaagtaataaaaaattcaaaattaatggctaggatcagctgagaggtaggaagtattcctccacaacatcaagccatggatgacttttgaataatctgaaatactctcagtgtttgaaaagacctgccatttttacttgaacttcttgaaaatgttgagcttcttagaaattgtttggtatgattctctttgcttctttaactttggaaagaatattaatttatttctgccttgttgaagaatgtatctgcttcagagctgacctgattacccagttgctttcagggaaggagaagagaggagatttctctctcttctattttccttttctcatttattgagatgattgtctacagagttggtcctttttctaccccactggcaattcttgctccccattgttctaccatgttccccactgttcctgaaaatacagaatatcaactctgttaaagatgagagtcttttttttttgagatggagtctcactctgtcactcaggctggagtgcaatggcacaatcacaacctctgctcactgcaacctccacctcccgggttcaagcaattctcctgcctcagcctcccgagtagctgggattacaggctcccgccaccacgcctggctattttttttttttttttttgtagttttagttgagatgcggtttcactatgttggccaggctagtctcaaactcctgacctcgtgatccacccaccttggcctcccaaagtgctgggattacaggtgtgggccaccatgcctggccaagatgagagtcttaaaaaggaaccttttcatggcataggaaaggtagtggcctaactatctatagcatgggaccaagtcatgtggtgtttgttatatgtgcttagataagtgaataaacaaatgtgcttgggtaaataagtgaataactgaatgaacatgtgtgctctttcccaaggtttggctttaaagggaaaataaattcacagaattacaacaaggtatgagcaaaatcttccacaaatatataggatcagaaagtaacagttccaaagcttggaagggatgacagggtgcaagatttacaggctaactttatgaccgggagcctcagagctgttagagcacaggtgggctgggaccatccccctgagaccctgctcctcaaccaacttgtgtggccctctggctaggggtggtctcatgctaggagctcatgtgggtttgtcctgtaattttctctgaaacagcagaggaatactatatctgaattatcccctatcccccccaaggtttgactgtgatggcagcaataaaagtcagatggtgtcatcataattacataaatgacattagcaggaagaatgttaaaatcattactcatcttcaagtatttttgaccattcatgaatatgttaatcagaatatgaccagttcaagggaaatgacaaatcaaagccttcttgttgataaattccccaaaccctttgatcagacccaatgtccatggcatggataattgcatttggtggtaagaaaggtaggctttctgaggtttaaggcagcagaaaagttcatacctttttaacttttgttactttgtatcatagttctattaaggcagttaggatattactttttttttctctgaattggatgtcagcagacatgaactctagtcccatatccccaattcttttgttttccttggcaacaattttattaaaatataattcacttactgtagaattcacccatttaacatgtacaatggtctttagtatattcacagagttgtgttcattctgaccattaaagtgtaggtatcgctgcagataaatctgtgaatgagtttcctcatgtgtaaattaagagtagagcaatgtattcttcactcttcctttcagtgatctgtttatgcaaaaaaaaaaaaacactcattaaatacagtgaatgtttataagttaccattttggaaaatctctgctctctcgtttgcgctctctcgctctcttgccccacacacacacacatgcacacgcacacacacatgcacacgcacacacacgcacatacacacatgcacatgtgcacacacatgcacactcacatgcacactcacacacgcacatccacactcttgtgcacacatgcacacacatgcacatccacacacacatgcacacatgcacactcacggaatgcacacccatgcacactcactcacatgcacacacacacatgcacacacatgcacactcatgcacatgcacacacacacgcacatgcacacacacacagaatattcttccctccatgatgtccaacttaatttttccctgtcatgctacatccaggtagtctcaccttcactttctacctaaaattgccccccacaggctccttttcatgaatgcctgctatattctttctatcatgaacaaagattatcttatgaatatgggctaatatagttttatagacatattttgtccctgagcaagaatataagcttgcttctttcaattgccacttgtactcaataggtatttgttgaatctcttacatgagattactgagaaatatatttgctgtcttaaaatgaagacaagttcttactttgccaactgacagagtcggcttataaatgatcaatattttcacaatgaaagcactttaggaatcaccaggacagagagtaattgttaagatagtagctgtgtaccttaaagtaaaggtattattgcccagtagcacgtgatattggttgactagcattgcaagtacaaaatttcctattgctctccaatgggagttaataattaaacctgtacaaagctctttataacaaacatattgtcatggtaaattccattggccatggtggattatatctgtgatagcctccgatcagtgactaacattgtttgggaaattttctggttaagcaacatatggtgacttctgataaggacttatctaatatcatagatggcagaaatccatttttcaatacaatcaggtacatgtatattgtattaaaaaatctttccaagtgtttttaccttgactttgctaatatagttagaaatttcttttttcttttttattgaacaaggaatagtgcttcttattgatatcctagctacagtagcctaacctgaacgatagcaataacttcttggaacatgtttgtgttatcattaactgatctaaaaggccatagcttggggcttcttttcctgtaagctcaatgggacaactatcagtacacagaaatacagacaagctgtgggagtttccttccttcctacccatagacagtataataaaaatgtaaatactgtagtaaactatgataagacgaaatgcaataacaaacatatttttcctcttcacaccaggtttcatgttttctctaagaaaggatgagatgaggctgatcctcataaatatttctgaggcttatgtctttttagacctatcgatttgtatacgtgaaacagtgcccatatgaatggttgctgttcatgcttctattccttatctaccatgaggcacagaattcttgtttaatctttattatgttggactttgtcacctcttcctatcctctaccttctcagcccaatgcatcgttcttctttgatgttctcactgtgctattgtacaccctctccaagactaaagcaattccatcttgaatgttaatccaccatgttggcttctgataaaccccagttacaggaaggcctctaagatttctagttattattgctccttgtgtaacagcacacacttagcataaatcctgtccttaggtaaaaaacaaccttgatgttaccatactttaattgtcctatgcatctcttgtgaatcacatacacccattctgtatggtatataagccctggggggtaatggcacagggatccaccatcttgtcttgctgcctttcaagacacagacatggcttgttttcatgatatacaactatgaaatgtttcatacaaatatgaaatgtttctttctgcgaaactggattcttcagcctcttttctttggcctccctgcttcctcagactttgaaggtaggtttgcataaacctatccacagcataacaccctccaaccctacttgttatagttgtccaccaacctccttgtccctctctcaaatccactgagcatttataatacagcccatgctcatcatatcactttgcctcttacctcctttgaaagccaccccaaaactagaatcatgaccaggttccttgaagtttacaagtccaataacatctttaatacacccctgagtatggttcttatacaacccagttttctcttggtcagtcctatttatgcctttttcttgacatgatcagtaacagcacgctttttcatttgcaaatgtgtaatgttatcatatttctgcttgttgaccttatcgctccaagaaagtactggactcccttcattatttcaaaacttaagtataattttctttccatctagtacagaactgttaggacccccttaggtctccgtcttactcccatcttaaaaattctagctcccttggccttgtggggaattcacattgcaaattgtcatccttcattcaaaccaattacctactttctaaggtctatatctggccttccagagatattcaaatgtttatctggatttttgctactgtaaatttattctcttcatcttccctgggcctccatattagaatatgcatttacaagaccttggtcattttcggctcctatttcccataacaactcttataagatttcgtttcaacttaactttctgcctattttgtagtgaaaatcaaggttctgagtgtaaatactttacctacctaactccaaacatagacacttctctacatcatcacctatctttacttcctttgcttcaggatcatagagtttttctttctctgattcaaggctaaccactcttactataatcttttctgaaatgttccatcaattattctaatttttaaaatcttctgaattttgaatatctctttccttcccagtggattttacatatgacactcccacttaaaaacaaaatgaaaacctctcttggacccaacttctattttgtctactgtatcctcttcaatctttcttctttccttcttggacggaaaaggctccttcttcatcccctatatttggatgccttcattgtccttctgagtctattctagcaaatatcattaatgaccttccagttgtcaaatctgatgttctcttctcagacctcatcttatgggctacctttacgacatttgacaccattgtttactaatatttatttccagtataaaaatggccctattatttttttagcctcttaattcttcttgagactctatacaaatcaaggcaaggccagatttgaacagcgaggaaaagtaaatgatacaggctggagggtggttgacggaaatgggtctgtaagcatgggttggatttcatgggtttgagcaccttaatttcacactgcttcctctattatctttttatattgtcaggtcaatatgttaccttaaaataattgcaaagaatttttttttttgaaaatgtgctcaggtaacatgactgttgacttaaaactaaaggaaacaaagttaaatggaaaaaaaaaaacctaacagataaaagaatgagcagagatatcactcactatttcctatgcttagattgtggatagagatggaacaacatagggtccagggatctgtgactgaatccaggggatctgattttgtctccatttcccacttcctaatgcaaacttgaaattgagacactgtatgggaaatagatttatattcttatgctgggtctcaggttaagtagttgtatatcattagctaactttcttattatttaagggccctgttatgctaactttctatgattctataaaagtagatctaaagtagtttgtaggtatgaaagagctttataaatgtaatatattattaatctctgtcaacatacacataaaacttccaacctttgtatgtgatgaaattcaaatgtaataattatttgtcatctaacactgaaggaaaatattttacttttacacggaacagcttattatctgctctgtgcccttacaacatggatagtccatttgttttttaaaaaaagagagagagatggtgacagctggtaattcatttatttacaaattggggtcctgacttaacaaataaatatttgaggctttcaaaagcaatcactgtaatttttgcacacatggtaattttttaaagaaaattatatacagactgttttcaattatattcaaaatttatgaaagatgtcctcctcctatcctgaaagtttatattttattaaagatggtgattgaaggcttccactgaagagcattagctttgtttgaagcactgtatttctgaagcccaaattgcaaatgaaataaatgatgtgccctcttgttatacaaacaaccaccagctatcagccatcaagtcaggattgcagttgtgttaaacaggctggcctctgtctctcctttgtcacgcacttaaggttccctcttattctctggattcagatggctccagtgggcgtgccttcttggtttaactgatgccttttcaacttttgtatctttgtatgggtggaggagacttttgaggatttgctttcaatccttttcatttagcctcccttatgtcatttctttgagctggaggctatgttgcagcctggccatttacgttctggccctaaggtatggctaatcatgcctctggtacccttcatgcatcttaatatgaagctttggggcacttggttcccagttggtgagatcatcctgggattgtgtctacagctgcgtctctggcattatctcttaggattcccttaaggaagtatgttatgcaaagcatgactataaagtaacaaatttggttttcatacaccatacataaatgcttgtctcgctgttttctaagcacattttatatatgcctttctattagggatagtggcgaacaattgttgtcgattgctcagatgaagatgagtctcctaatatgattcctaaaaattcctggttttcagatgggttaattaaaggtggcagcaaccccaaaatagatttatgggaaaatggagaaaggaggctggatggctacaggagtcttagaaatgtgggcactttcagaatatggtgttcggaagtctatgtttgaaaggaagccaacatgcgtaaaaggaaatgttgctgcttgtgcaaaacctctggctattagatttctctgtcagcagacacagcggaccatttgatacacatgctggtagtcttcacccagaaagagtggggtttctgtcaaatgtttgcaagtaagtaattggtctgaaaaagaaaaatggggcctggaggaagcacaggggttctttggactgtgtccagtagaaaaaacagtagactagagatctaaaaacacagatcttgatctagcttttatcattctgtgctgtgtgtttttaaccacatcattgagctgagtggtctgcataagccacggcctggcacaaatataggtaaagcgtcaaaaataggtacagtagctcatagaagatactttaaaagcgtttgttgaatgataagtgaatttataattcattcattgaatttataattcattcattatagatctgtcatacgatttgatgcctagattttgaagtttaatgttcatctccataccagacattttatgtctgtatgttcaaattcattatgttaacaaagaatgtaggtcacctgggcaatctgtggatagagaggatgccccattagctgactgctaaattttaggatgctgacagcattgtagaaacatgttgattaggccacaatggaaatcacgtctgatcccagcagcagatgagactctgtgttattcagaaatgtatagaggtcataaagtgaggttgatttctaaacaatgataataagaatacaaagtggataattctattaaaaaaaagaactcattgaacctttgaactctagaaacaaagattaggctcaagtagttaagcacagccagatatttctgggtcagtccctatagcacttagataacagctgtgggttgacaattgtcctctagcttttctcaaaagaggaatctcacagaccaaggcttgaaaatggtatttattatgaaaacctagggcatgatggaaatattttggaattttgtacctattttgcaagtgtaactaggtttctcttattgctttgtagctatttgtgaacattgtttcctttgacattttaagtttctgggaggctatttctgaatcctgttcatttatcttctcccatttccaagttccattctaatcttcacctcaaagcagagcatttgttaccaagaacaattcaggaggctaccagctcagttcaagcattgcccgaaaatgctttttacttttgtacacggattcgtttgtttactcatctattctgcacccaccacgaccaagcatggtaccaggtgctatgctatgtactggaaagggagagatgaaacatgataggcactgcctcgaaggtgctcacactctactacttcacccactgtaaacaaactctaaaacatggtgagagttgtgctatgataagagcaaggtgtcctgagcccaaggtgtctcctttctgagtatagggcaagggagatgatcagagagggtcccagggagaggcaatatctaagctgaaatataaaagagagggagagttaaccaggagagaaatgatgcagagggatggaggtagaagctggggttggagggattagggtcccatgaaccacatgtgcaaaggcacaaaacagagaaagtaatacccttcagtaaactggatatgggagaagtgggcatttattttactgtgattcaggaaaggaatgacaaaaataaggtgagaaatacagtaattactaacttcacccatttctactcctttgaatgttaaacttgtatgatttattattattattgcttatttgcttgactagggagacaagagccctgtattttggtgctagatttgaccatttcaaggtgagttatactaaataaatttgtaatatctgggcttctttttcattatacctttctaagttattttagaattggcaaaacatatgtcattttgtgtggaaagtttttgtagcttcaggatatttggaaaactatatacagccattatagaaaacatagggagattcccccagaattaaaaacagaactatcatatgatccaacaatctcactactgtgtatgtatcttatatatctaaaagaaatgaagtcaatatgttgaagaggtatctgcagttccatgttcattcaagggctattcacaatagtcaagatatggcatcaacctaagtgtccatcaaaggatgaatgtgataaaaaatgtatctatacacaatggaaaatgattcaacctttaaaaataaaaagaaatcttgaaattcgtgacatggatgaacctgaaggacattatactaagggagataagccagggacaacaagacaagtactacatgatctatcttttatgtggaatcaaaaaagacaaactcatagaaccagagaataaaatagtggctaccagaccctgggataggtgggtggatttgggagacattggttaaagtatacaaaatttcagttagataggagaagtaagttcaagacatttattgtacatatggtgtctatagttaaagtgtattatatagttgaaaatagctaagagggtagattttaagtgttttcaccacaaaaaatcagtatgtgaagtagtgcatatattagtttgatgtagccattccattatgtatacatatgtccaaaacatcatgttgtatgccataaacatatacaacttttatttgtcaatttaaaaagtaggaaaaaaaattttggctgggcacagtggctcacgcctgtaatcccagcactttgggaggccgagatggatggatcacgaggtcaggagattgagaccatcctggctaacacagtgaaaccccgtctctactaacaatacaaaaaagttagctgggcgtggtggcgggcgcctgtagtcccagctacttgggaggctgaggcaggagaatggcgtgaacccaggaggcagagcttgcagtgagcccagattgcaccactgcactccagcctgggcaatagagcgagactctgtctcaaaaaaaaaaaaaaaaaattataatgataattggaaaaccctaacccagaaccagaactctagtagataggaccacatccaataacagaggccaaaggcaaaagatggtgaagttcatttgcagtgaagtcctgcagggcaactggggaatctatcaacaaagagatgctgtagcagtggtgcacctgtccctgcgaaaggctctgagtctcagccatgaatagtctctcaccacaaggccatgctcaccaaatctgaggctttgtgtagctcagtccttagatgagctacctaaaaactaacaggaaagaaaaatacaagagaaaaaacaaatttggtaaaatgctatgttgcaacaaaattataccaaacctacaacatagttaagttcttgtttaagctaaagaaaaaggatcctgggttaagtaggccaagaaccctggcctgggagctctttctggtagaataaaaatctgcatagcttagtaccaaagatgatccccttgtccactggtatttatactgttaggaagtcaagtacagaacaataattaatatgcatttagggttcagtttatttctggcaatcttttctcttctttttcgctacctccatccctatctttcacaacaacccctgcaaggtactttgctgttgtgaaacacggaggggcacctggattgcaagatacctgtaattatctccattttattggagagaaaactcatcctcagagagtataaataatgagttcaaggtgatatatgctgggactattaaaatgtaggtagattgtataatccgtatttgatatctgttcaattccaagctcatgttctaacacatcatgctacttatagtctagaaagactgactgtctaattccaaaataaccatttggctttaaacattttgaaaacgttatattaaaaattagaacacattaggataatagagtagtatcaagaagaggtcaatggtagaaaacaagggcctatcacaggggcatggctctaaatctatagggtacagaagggccaagaggctcatgtcagtcagcagtgacatctcccagtgaccgctggaaggaacttgacctgtgtgtgctggcctgtgtgctcttcttcgatttaattccagtggtggggatctttcaatctcccaacaccagatgctttcacagaatgtatgctattttattttgaaatctcctatcagttctagtcaaatatatgttaaagattaatacaactactaagttactggaggaatcattatgcagcaaaattactataaaatgaatttaaaaatggacttcgaaaccattagaaaaatggggaaattatatgaatttgactattcacaggaaagaaactgtataaatggataatgtatagtaagaaatattttcaatgcagtgaataagcaaattaataagatttttaatagcagtgagatagatttttttaaactgttgggattacagaattaaaaagaaacaatgcatttgttgtcctgagaatgtggaggaataggcattctcagaccctggtggtgggattgcccatcagccagatttttggaaatcaatttggcaattttttaaaggtcttaaaagtgtttgctatcctccaccttgatccagtgtttctctaaggacatcattagagatatgtgtaaggatatatttacaaagatgcttattgcagctgcatttttaactgaaaaaatgggaaatatcctatattgccatccatatggaaatggctgattaaagtgcagtataatcgtaagacagaatatcatgcagctattaaattatcaccaaataattttattgtacatgaaaatatactcatgatgagctgcagtgagctatgctcatgtcactgctctccagcttgggtgacagagtgagatcttgtctctaaaaacaaattaaaataagataaaaatatatgaatgatgtaatgtgatagaaaatttaggataaaaaaacagaatgtgcagtgtgaacttgtatgtgtgcttgcaagcgtgtgcacacttgcatgtgcctgttgatgtgtgtgtgtatatatgtgcacatgtgcatgtgacatccaccaaaacatgaggggaagacaccaaaatgttcattatagtccttctggttgatgggattgtgattttaatttttaaacatttcttcatattttactgtatttttcaaactttctgtaataagcaagtatttatctcagcaaacaaaaaaagtggttaaaaggtatttaataacataaatcccaaagggaatttttgtaagagatttaaaattaggatggctcaggttaatagagtagtataaagaaccggccaaaagtagaaaactagggcccatcacaggggctgctttaagtgatcttagaaataactttattgtatttccagaagcactttccctattttgcctctgacatacacatcaatggtggaaggagaggagacaggatgctgactgggaattaaggcttacagaggagagagttggtctctaggagattttatgtgataggtttggagataatctttggtttccaaaacaataactttatccggctgatgagcacatgaaagccaaagagttgattgtatgactatctatatgccagtcattttacactgcgactttatattccttttccatgatggttactattatcctacagacctatttatttatttatttgtttattctgtctccttattggacgataaagatataaggatgagaccttgtttatttatttgtttttttattttgagatggaatttcactcttgttgcccaggctggagtgcaatggcgcaatcttggctcaccgcaacctctgcctcccgggttcaagtgattctcctgcctcagcctcccatgtagctggtattacaggcatccaccaccaaccccggctaatgaggccttgtctatttcactgctatatgctcaatgctgagcacatggcttgacacacagaaggacctcaataaactgtttttgcatgataaatgaattaataatgaattcattacaaatctatcatagagtctgacctctagtttttgaagtttgttcttgacttgccaaggctgttggtgtgctctcagactttaagttgccaacagacttagatgttggggaaggaaatgaacagctcttaaaaccatagcccctttgattttgctgccattatttaggagaggatggaagtgccactaccccactacattctcactttgttcttctgacccagtaaaaataggcatggggaaagatgtcatctttgtgttcccttgtggtaatagcatggcatgtgtcccacctgctgacttttttttgatacctgctttgctaacaatgcctgacttttctgtataatccctgacttttctgtatctccaactagaacaaaccactttctatgtgtacatttgactgctctgctcagtggactataaaagcatcaaggtaaaatagtttcccacttaatttttttttttttgagacggagtctcactctgtcaccaggctggagtgcagtggtgtgaccttggctcgctgcaacctctgcctcctggttcaagcaattttcctgcctcagcctcctgagtagctgggactacaggcacacaccaccacacccagctaattattgtatttttagtagagacggggtttcaccatgttggccaggatggccttgatctcttgaccttgtgatccacctgcctaggcctcccaaagttctaggattacaggtgtgaggcattgcgcccagcctccacttacttaatttttaaaatgagcctgttaggtaacaatattaagcacaccactatatgtgtgtaatataatatttttatattgtaatatattatttgacttttacttgtaatcgttagcaaccatttgtaaaatacctaatttgatgctagcactatagtaagcaatttacatgcattagctactcaatctttaccataaccctatgagatatatgttataccattttacagatgagaaaagtgagtctattgcaacccaggtgtgactgatctcaaagcaggtagaattctctccatattccatgcaagaatcttgaaatactaagtatcctgagtatttcacagtatttagagctgggactagcatcaacagtacatagcaaatagtcaagtcacattgagaagcttgattttctgaaacactcatgttggcattcttaattttcattatccaacattacatagttaccagtgttgcctttcattcatacaccaatcgatatcctaattggtctgcctcaaacctggaagcaaattgcctggcaaaggcagagggagagctgcagatggatatgtttaaaagggctgagtgtgtagagttgctgagcaaaggagagctctgcccctgtgtcccctccttgtgtctcacctgaagcttcatatttctgttgctgttcttcattcagcctctcattatttacagttgtcctctaagggaatcagagctcactctattccatcttttttacttttgaattaattttcctaattggtagagagaggccatttgggatacaaaaccactttagtgcctagccgggaaatttctgaaagctctgtcagtggaaggagtgtcgagggacttgtccaagttgatgttcaattctttcagcttctctaggtcagttcttttctctcgcatagcatgtctttcatttattatattctgatgccattataaactagccaagggaaaaaggacaatgtttaacctctgcttacatggactcacaatgcagactgtgcaaaacaagactgcagggctaatatcacagtcagagagttcaagaagctctgaaaaccatgggaaccagtgacctgttcaaaactgaactttaattctacaaggaagagagagcagaggagagagaacaagaaaacagaaagcagaaaaggacaaagcttcaagagaccaccctggccacctggtgccacttggggtctggggtgcttgatggcctcttaatgttttgaagcacagccggcagcatgaggaaggcgtgagatacagggcagcccccatgcacttggatcctttagtttcagcttccagcagggaagtgcttaattgcatccgtgattgagatgatcatttttattgtgttcagcccagagttaaggagagggggcccctccttaggcaagttttgaatttcaggttatttgtcatctcttagccattatcaatggtgctgttactgtcatcatcattatcatcagaagggaagtgttaagcctataattacatgtggcactgtgctaagtgtgatacagggaagcacttggttcttgccggccaggtgtgcataatcaaaacacactctgtgtcagggcagaccaaaagtacaagttttgcacagaaaggaagatgaaaacactgagtaaataagcaggtcttatgaagatataattgcctgggttctgttttaggactacaaactatcatctggggacttatagtctatttaaatactacctctaaactactgctatgctcctggcacagccctaagtactttatatgaatcttatttaatccttgcaacagccctatatgacaaatgctatgactatcgctaacctacttaccaggtggcaatgttaaggacacactactagtaagaagcagaacaaagatgctgagccagtctatctgaccacagggtccatggcaatgataattgcattaaaagcctctcagagccactgcaaactttcatagcaaatacattttcatagcaaatacactttggggccagactttgagtgcatttcattatttgaaaatttcgatgaacattgtgttaatgatcatataaaactcagccaaacagacaaagcaacaagagagcaagaaagaatgaagcaatttatttagggtagtagaacttttgaagttagctctgtaatactttttaaatgctgtaatgttataaaaagaaagaaacacagaacataggtagaagggcatactgaactgggaaggaactgctatattgggaaaaagaacaacattatctgaaggatgagtgagtgagttgagaggctgaaataatttggataagcatctcatccatttgaattctgattatttataggcacactcatccctaatcctaatgttggattactgactattaggttctgattattccattaaaaggattcaatgattgcatgttaattaaggattcttccaagttgatactaatataccgataattctatcctctctctctctctgacaatttactttgagattccatttatttaaaagagaaatgttacggatataaaagatgttgtctttgatagtcaaaatgaacttactaatttgtttgtttagttttctgttggtttgctgtagaagttggacagttccagcttctctccaaggagtatgtatcttatccacattgaattccttattccatctaagatatgatcgctacataggaggaaatgctggataatggaaggattattggactagcagttaggagtactggattctagcctctctttgctacatctacaaaagcaattacagaaagtccctcaatctccttaggtttattttgttatttctaaagaatctagttgggttataccaatgattctcaaaactcactgtggattagaattactcagaaaacgtttttatcatgtatatataaaatatatatatatatctgctatcagcaaacaatcctgcataaaaaataaaaaaaaacactacattttttcttttcttttttttttattgttgtttttgagaccaagtgtcactttattgcccaggctggagtgccgtggcatgatatcagctcactgcaacctccacctcctggggtcaagtgattcttgtgcctcagcctcttgagtagctgaaattacaggcacctgccaccacacccagctaattttttaaatatatttttagtagagacagggttttaccatgttggccaggctggtctcaagctccttacctcaagtcatctgcctgcctcagcctcccaatatgctgggattacaggaatgtgccaccacgcccggccagcactacattttttctgaggctgacttccgagggctgctgggaatccctgcagtcctttagccccaactaaaacggcactcctaaaagtgaattgggttaggccagtatgttggctgtgcttagggttcttggccattcatacagagccttaatgtgtcatcaatctaccatcctcttcccacccctgtcacccactgacattccatactgattccttcttgaaggagctgtcttttctggattagttcatacatgcaggagaaggagttctggcttagaattcaggctatctgagttctccttctatctgagttctgtgaactcaggttaggcctgagttcacaggccctaaccaggtctgtgatctcagcatacaacttacccttcagtgcctctgtttcctcatctgtaaaaagaaggaatcctttcttgctcttcaactctatgatccctgctcagaccttgggagccactgcagtgttcagctgctctcagtttactgttttctgactcattcctctgcaggggcccttgcaaggccctggcctgcctgccccatacccgcaggctatgtctgactgctgcagagcagcgagatcccagggggctcctcttttctttccttctttgcgtgtggaacaagtaatctggcacgttggcggttttctgggcaacagaaaatcgcaggattgttccctgatagcagggcttttctgggcaacacaattctgaaactgtcctcttgctcacttgtcaacccatgacggacagtaaagggaagaggagggcctttgacttcactggtgggcaggggaggaagctcttgaagacataaagggatgtgactgtggcagctgctctgcttgttgaaaccttggtattcttacatgtggcttgtgattgaggttctgactcttgtacttggcatggtcttttgtgtgatagatggtgaatataagtaagtctgatgcctaattaagaacaccatacaattacccatgtccatacagatgatgtggctgtcaagaaaaggcttcacctggaagagggatgaagataggattttatactggactgtcgtggaaaaatatcagcatcttccgtttaactccatgagcctcataaagactatgtcctagctccctgtagtcctccttatttatgcatatgatttgactttccttcagtttctctgagcattctactatttcagtgataggtaaccattttttcatcttgaaactgttctaaaatttgcactttttgattgttctttaaagatggccctgaggcattaaaaacagggaagaggatgggctcacagatgggaggctaaatggaattacaagtgaccaagatccaaaatattatactactcccctcgcccctcctgcctgccaagtatgttctgcctattcatctgtgtccagtaaagtgtagcaagtatcagaccacatgaatgaatcctctccctgctgagaactgaccgcaagagggctcctgggaacagaagtccactgagcttctgcagattgaccgagagttgtctagatttgtaaacaggatgaggaagagactattccacaacctttggtgcagaggggaatgtgatatttagtagaacaaggcccataaagctaaataaaagtgttttattttaggtcattaaactgtatgtcatataacctttaaaacagcatgcattataaatcagcagctcaggtttatagggtagcttatcattcatttaacaggcatagtgatagtacttgaggctcgggccactccttacctctttctaaattaagagaatttctaaatttcttttttttttttttttttccaaaaaaaggaagctcattctttatgggcttctgctacccccagcccagtgttcagccacaatgcttctcactgtggcagcagatactaacattcagatgctcagaaaacacaagcagtgaacagtcatccagagagtacaggtggtctctaagggagaactttgagagcctcaaaactacctttatatgtaatggacaaacatattacatgtctccagcggacttttaacccagaataccacccatcttagggtttcgctggtgctgttcttccacagataaaatacttaaaagacatatttatttaactgtctttgcagaaacatgagatgatgtaaatggttgccaaatcaaagaagcagtacccaaaagtacattctgcatgagtccacatacataaaattcaaaaacaggcagaacttttagtgccactgaaagatacatttaaaaatggttaaaattgtaaattttatagtatgtctattttacctcacacacaaaagaacaaaaaaccaaacgcctgaaaccaaaacctcagcacagttaatctaatgagtgacagctcaggagattagctgccattgggattatcaatgactgcaaggaggcatgagtgggacttctggatacacagaagtttctgtttgtcatctgaatgttggccgtacagctggctcactttggtaagatttattgagctgtatgctatggcaagcttacttttctaggtaagtgttttgcttcaggaagacatttatcagaaagtaagaaggtgctaaaaaaattagttgatttgatttaatttgactggggtattggtcacaagtatgaaaattcattctattcttcaggtgccacaggtatttgggcagagataattgaataaaattatgtcagtgaatagtatttctatttttttccttgcaaaaatcaaatttggtttaaggatgacagggcaaggttttgtctgcatttagaccacagcattgccaccctttgaagttgccttatttctttgaagctgccttatttctttgaagctctgaaagcacgtggtatctgcaacaatatagagagggctagtctaatggtctgctcttagttacatggcacgtaggttgttttccttaaaagccctgcctccgtgtggctctgtgggatagtgagcttcctgtcatctactggaggccagagaataatctagaagggatgctctgcagaggctgcttatatcgcagagacgttgaacaaaattatctacaatgtcccatgtaattccaagattctgtttctaccattctctaggcgtttatagacaatgtttattaaatatgggccctcatctctgtgtcagtttcttcttcggtaactttgtgaaggcaagtcctaaaggttaaagaaaaatagcaatccttttaggacacttgtattggtcttttaaggcatttcacaaattggatggcttaaaacaagagaaatgtattctctcacagctgtggagacctcaagtgtgaaatcaagatgtcagcaggtccattttccctctgaaaactcagggaagaatccctccttgtctcttacagctcctgatggccccagccacccttaggactccttggcttgtagctgcatcactccaacctctgcctctgtggccttcttccctgcatgtctgtgtgtctctgtgtcctttcttcctcctacaggtacactagtcattggatttagggcctaccctaaacacaggatgatttcatcctgagatccttaattatgtttgtgaagaccttatctctaaataacatcacagtctgaggttccaggaggatataatttgggggatgacagtgtattcaaactattgccaacaccttcttggaaagaaaaagaaaaaaaatcaacattaaaaacctgtaggatatccaataaatgcaaagtgagtgttgagagaataaagcgttgagtccactctcaggaagggtgagggctccgacggggaggttatccacacgtccattcgttcagtgaattattactgggccctgagctataccaggcactctgttaggtactgagtgtagagcagcaaaataaagaaacagagaccatcctcatggcacttatggtccagcgggggagatcaatattaatctaaggaacaaaaaaaaaaaagatcactgcaaattattgaaaaatacagtgcggcatatcattagagagaattatattgagaagaggcccagcttttgatgtggggtctgtcagaaaagttttctcagaggaaatcatatttaagctgaaaccagaggatgagtaggagttagccaggtaccgactggagaataacactccaggtaggcagagtggtgagttcaaggggcgggatggaggtcgctgtggctaggatacagtgagcaaggcccggcagggcatgggataaggagtgggtgcctggagcctcatgaacccctggcagttcacagtcaggatttgggggtcccttcaacaagaagacccagaaagttagaagaagaggaatggcaagctctgaattctattttaagatgactctcctgcttgatgtggagaaaggagggaccaaaaagtgaccccagcaggctaggtatgatacggtggcgcaggcagctggagcagagaccctggtgccaggaaccattagaaacatattcctgctactgcagccagtcagctgaccagtgtatttcctaggctgagaggcaagcatggctcaatagagatctgtagagctccatcatccatatggaattgactttcaaaatgatgaaatagaactaattttcaagtagctcttatctaaaactaacaaagggggttttacttgagttctatgagcgctctatgctcatttgttgttaaatttttgaaattattttctggtttggaatgtagatccagaatttgatatatgcagatgagcatgtgctaacatggccgtggtgttagctagttaagatccggaagtgctatcacacaggatgggaagggcctcctagagaagtgagagtctctcagacctagaaatactggcacatgatacctctgaacccacggagtacccagtatacaccaccaggaagctgtgtggcacactgtttttaaatctcaattgaagcagtcttggacaacaacctttgttttctatctagggaggatctagactttaggtgaatgaaggggagatgaaaggtgagaaatttaaggaaaggtgtgttctaattatgaaaataatttgtatgaccatttaacttgtgacacagagctcttcctgtgtggttaccaattctgtacttgcaggtacaagtctgtttgatgtactaggtgcacatgggaccccttcctcgggatttcttaacatgctgctgtttcctactccttgtgtcattggctgggagaatgttcacaacagactctggcaaatgagttcatcctccttgcagataatcaccttatagaagaatcacattgtcttcccagccgaagccctcttgtctgaaggatacctagtgttacgtgcgtgtgtaccattccaacctcagttcctccccatccccttaaaaagatgtgcagtgtatgatccctacagataatgtaggaaaaatctgggtttgagaggtgggctggggcagagaaggccttagcagagggcctcagtgcccatctgcttagtattatccacatgagtaagttgtttccattgaaatcaacaggaccgtatggcaatgttcgaatctgaaattatttccaatggattcctgtgtagttacaactctatacttgcaatctttgtgatttcaatttggaaagtcattcaagtgagtaatttaatgttgggctgttccttctgttttcccttcaagctcaaaaaattctcaaaataatgatattataaacaaactttgactgtgcctaacaggacagtgaggggttacagttctgtttgttccaaatataaactatcaggtcagatttgactttatcaactaggcactgggttttatgaagacaaatccgacttgtgtgaagccaacttttaactcctagataatatcttacctagaaagagataatctgatttatcttccaatgtacaatgggcctttttcctaaggcacagtgaggaggacttcactaaggcacatatcacaacatttctcctctttcatgccccttaagccccctaatttttctctaaagatgatggtctcttggttacagaggtaccccaaatcacttttttaaagtaagtaaatggccaggcacagtggctcatgcctgtaatctgaacactttgggatgccgaggcaggtggatcaccagaggttgggagttccagaccagcctggccaacatggtgaaaacctatctctatgaaaaatacaaagattagccgggcatggtggcaggcacctgaatcccagctacttgggaggctgaggcaggagcatcacttgaacctgggaggtggaggttgcagtgagccgagattgcatcactgcattccaggctgggccacagagtaagactctgcctcaaaaaaatttataaaataaataaataagtaaataaaataaagtaggtaaaatgcacattgcattcatgtctatgacaattgtgggtgcacatggattaaagagctctagaattctaaaaggcttgctacaaaacatcattcccttgctgttccacttccagtctactccccctcccaaaaggaaccactttgaatttcaatacaagtttattagggaattgtgctctatatctctaaggaacatgcttatattgttcctttttaaacttttttccagcttaggctttatctgctaacttccatctgtggcagagatagagatggcttcctttcctacctttcaccattcacctccaccctcaatattccttctcatcctcagactcccagtaaagttatatcttaatttgtttagatcaatattcagtgttctcactactgagttagaacatactatggttattatttatgtagtataatttccactctcccaacccccactccagaattcataattatcttgtgctttgttttcatagctttaacatacttaagtcttcatcatctgcctattcgactggtgcaaaagtaatggcggtttttgcaataataaatgtcctcccaattgttcagacgcatctgtccatttcttctttttgaggaactctcagagactcctgacctgccctcacctggatgggttggctgctacacactgagcagtgcagtcactaagggtctcctttcaccaccattttgaggatttcctgtacttccctttcttactgctttaccaacttcctgactctcctgtctgctgtattccctccttttggtgggttatatttttcagtagcttcttgagaaaggattcatgggagctaaaattaaaattttatgtgttagaaaatgttttggttccattttctcacctaatttgtagtttggttaggtatgcaactctaggtaaggaaatgttttcttccagaatttgagagcatagctctattgtcctctagcttccaaggctgcttttgacaaagtctgatgaattctggtagctaatcctattagattagctatcgctacccctccctccctttctctcactctccggaaattcataggatgttctcttttgtctgcagtgatctgaactctccttatattgtttgtttgtctttttgctctaattcttaggctgtgtctttatattcaagtgaaatatttctattggcagtaaataataataaaaatattccaaaatgcagccgtaataaattagacacagaattcaacacaaaaaccattcagacgctttactggtgatcctgccattaaggatgacacaaaccctgtctgttgttgcctactaggataattattgcagatcagtgaggagccagaacaccaaggcattgtagaacgccaacagtaggctagaatgtaaaggaggaaaacctagaaaagagcaggtttggcttcagccgtccctcagacctaattaccattcccaaagggacacgaacaccatatttaaagcattcatctaacttacagagggtgaggcttggctgtgggagggccctgcagccagcatacctgaggtcagatgaatcacttagcatggctttggaatgttctgtctgaggctggagtcaggctcataagggcttctttgcattttaggggcccagccaagtagactaatgcaaggaagtctttatatcccagagtaaggaattgtggcataaatcaagaaggcaatgctgaaaacccaaattacacagatgaaatgaaccagagaggtaagggcaaaggcgagcctaagctgaccctcaggcatcctaagtgcttgatcggagacgacatgattcatacctaaccccaccagctgtgagccactcataaacaaccagtctgtcaacactgtctcagaagtgggaagagttgattctgcaagctgaaactcttcaaaggtacagatgagtatcctgagaagaggcagaaaggggcaatagtgagtatttcagacctctagagaccatccatcactttcaccaccagatatcaactttattttacctttcatggatcctgttctcttgttttcatagatcttcctctcataccttttttaaaaaatacagtctcactctgttgcccaggctggagtgcagtggtgcaatcaggactcactgcaattttggcctcctgggcctaaacaatcctcctgcctcagcctccttagtagctgagactacagttatgtgccaccacatcctgttattttattattttttttaatagagataaggtcttactatgttgcccgggctggtctcaaattcctgggctcaagtgatcctcccaactcagattcccaaagtgctgagattacaggtgtgagtcattgtgcccagcctcataccttatttttaatcctttctcaatagccagttttatcttacctgtacctatatttccaaaaatttgcctaaatttcctgtggttgctcagaactctacagctctcctcaatttcaaattgtaacttgaaattgaacctgaaatcttcctaagatttaccaacagaccagcatgatcagtacatcctggttattttttgtcctttggcaaccatttgtatgcttattaaaacttgtctccctctttcatagcagcctaaaatttcttgaagcaaaggctgtctttcattcatcatgtcactcaaacaccctatacacacagcttcagcacaggtaaaccagcacagtgagtaaacctggctccatctgacccattctacacaattccttcccctagacggagtcttggtcttcactactaaggaagcctaaccttggaaatggacctgtgggcaaataaaactgttttctcttccagggatgtttccatttgaaacttcagcttgatggccacatgaaatgtctttctcaccaaataaagaaatagctaactatgagggttattttcttcaccagggaacctacccgatctctttcaaggcattccctgtaggcagcttcccactaggccacaaaaatcagagtctgtcatgattgattgatcaagaaatacctgcccacagagggccacacttcctctgaggctcaggcacctttttcaggagggaaggaatgctagactcagggaaagggctcctgaccatgaaatgctcagaaagttggtgtgtgccagggtcagagcactgctgagagcgccagtgatcagtacacattccatttccctctgtgcccagcactgccccttgaagtcactgttctgtcttttcagaatggaaaaaattagagaataacaagttgctcaaaagcttcaagttcttgcaagaatgtcaattaggttagacggtgacataatagaataatgttcatatggcaattccttacagcacaatgatcccaaataatatcacctattgctacagcctgtgccatgcgggctgccacacataaagaagctggcagtgtgtgataggcagtgggagaagctgaagttgttactacgtaatgagaaagatggtgtaaataccatgtcttggtttgtgggggaggtgttgcctgtggaggaggtatgcgactcatgggagagggtggttttatcttactaggagtaaagactcttaatgtgttcaacaaggtcgatgattttgactaagatggcatagccaatacatattacagaggaaaaaaagactggataaggcaattgagataggaaacataaactggaaatgaaatacatatcagtatagatcagttcacacttgagtcacgcatcaaatgttcatggtttagcctggcactagtgggtcttgatctaccaccacatctctatatgctcttatgaacactcttacacttttcaaaatcttcttacatacattatcttatttattaggggaaacagaatgaactgctaatatcattcccactttaaagataaataaatggaaggacagagagattaaactaactgctcaaggtcacactgatagcaagtgatcacattttgaccaatattgaccatgatgaatgaccaagtgttgaacactaactacaggtaatatgttaattcccaacagccctagcagatgactagtgacattgtttctgttttgtagaaaagaagtatacgtggcttgctaatgtcacacacagctggcaatggcagagatcaggttcaaatctagatatgcttgcctccggagtctgcaatcttaaccactatcctttctctctgtaatccagcaatttgcctcctcctggaagaatctagtgattcttgcgtagtaattgtgatttttctattaaacctcatctctttccaccatggtaccttcattttaattgatttcactatttgtagcatcatctcacactttttctgttagtcacttttaaaaagtattattccatacaccccacctgcctggtctcacaatgcacctgattctccagcattatttatatacttctcccttccttctctagttatttggaaatatttttaaggcagaaacaatgttttaattttatattacattttattgtttttgcattgaaacccaggtctcccaactccaaatgtaatactttgatcaaaagcacaggctctgaagtcaggaagactcaaccaagttcatgttctgactctgcctctgactggatgaatgactatggccaagctatgtggtctctctgacccaaaaattactcatctgtaaaatggagctagccaaatcatagatcagatgtgaggaatattctaggtcatgtataagctattctacatagtgagtagcagatttagaaatgactcaatagaaactgctattggtgttatcatcagtattaattatagttatgaaaagaaagctgccagctttggaaaactcctaatgcttaaaatttctctggcttaggaaatctctggatgttttctaagagtctaataagtagggatgtctcacatataactcagatggtttgataaaagccagttcttgaatatgatgctggagtcagtagatagattgtcacagcaataatagatatatcacagtcaatagaaagctataagaaatggaaatccaaagtgattggttatggaaatgaaaaattacttttccctaccttgaaaacaggtgatgtctttcagccatttactgtcatttgaaaatgaaaatagtactatttttgttaaaataactgtgactgaccaattcttttttgtaatatgttcaatgggaaatttcttagttttctgagaccattctgggctaataaattagaaagtttccaagagttaggataaggactttgaaatgtgatgacctgtttcaacatgaagctgacagtgtaatgaataacagagtttcaggatcctgaaactttgattgcttttccttttcttatttgctttgttcatctcagagaagaaaatgatccacatttgtaatatcaccttatcctgcagttggacattaaacatttattttaaacattaaaactgctgagcttgtgagtttataacccatagatacttctatttatttatttttaaattttaatttctttatgttgaaattgcaaaatccagtgaatcaaaggaaaatgatacctggaaattgtgacttttcatgaagtgtaaccaaatacagctggtcaggagagcatgaagcagggattttgttggtggtgccggctggaatggcagggctgaaatgtacacatttgttattggatgctttatggtttggttatgtttggattatggtttttaaaatatctttgggttttgaaaacccagaacaatgtattcataatccatggtccatcagctttattgtggctttcatttcatagagaaagagtggttttgcatttgcaatgaattagctgtttattttcccaactctcccatttcattatagtgatacaatttattcacctaacgataaacaaatttttttccaattcttggtcagtgattggattacactaaaggaattttgttttcagggtgttggtgtgtatccataaaacaatataaattttgtattgatgagggaattgcctttcctatttaattatgattgtgggccccgtctctctctctctctctctctcaatctctctcaatgaatgaaatacagaactattgtgaagagataataagctactaaaaagcattcagtagttgttactgttataaattattcattccctgtggctttagaaataaagttctttatcttttcagaggcagctcaagggtagaggcatttaggagatctctcaccgagtaggcagactgaagatttctccctgtactgttattgcttatgtgctccatctcttagggcaaagtagtttgcctttcttctcccaagattgttatacatgaaaatataaagatcattgtattttgatgcatcttccaggaatgctgagaggtaatgaaaagagacaagtacaacccatatgagagatcatttcctcaactctttgttaagatagatgcattgtaaatgggaacatactgtggtgtattggcaggcaggtcatctgagtctctggatgtagagaattacaatgtgcctctgttatgtcattttattttgtactcacatgagcaattgcaggaatgcacaagctaacatatcagttatgaaagagcccaaatgagggcctacggatgaatgagtctccatagccaatagttgacagtgcttagagtcctgaaggatgatttcattgacttgttgcatccttcatgcaaacaaggattcgacagctgtcaaaagggcagattggtctctacactctccagggatctatgtgaatagtgtctgtttggagaagtgattagaaatattaatgggctctgaaaacaaatcaaaaagcatgtacctctaagaccgggctccctacagggtcaaattcaggaaaatcggattttaacaattgaatttgttttggttcttttttaaaaatttaagcataatctctattttgaatgaaactgttataagagagaaaagtaagctttactgaaataggcagtaggtagggctgaatttagtattctgttttattgttgttgtttgttattcgcttgctttgtgattatgcctaaatctagaaagcccaaatgaagcatcattcccttaacatttgtcttctctttccttttatttttatttatttgagacagagagtcttgctctgtcacccaggctggagtgcagtggtgcaatctcggctcattgcaacctctgcctcctgggttcaagtgattctcctgcctcagcctcctgagtagctgggattacaggtgcccaccactgcacctgcctaatatttgtatttttggtagagatggggtttcaccatgttggccaggctggtctcgaactcctgacctcaaatgatctacctgccttggcctcccaaagtgctgggattacaggcctgagccaccatgcccagccatttgtcttctctttcaatgcacaaaaacaggaactatctctttgctgggttatatattcaaattttaacacaccaaattatttcttcttgtgggattaaagttttagataatgctaaagtcagtgaaagaaatatttactgttttcagagcaagagggattgaatggagagctgtggcccacagtagaatggatatttaagaagcatgtggatgttcctggttagaatgttaatccataagaggcaaatctaagggtagaaccacagaacactagacctggaaggatcttagaaatcaccttatccaagttatttactttcagaggaagacagagacatgaaaaagagagaattgcccaaggccacacaatcaggatgaaatcatcaggagtagaattcaggtttcctggctttcattgttttataaatgtcttgaagcactgacttaaaaactgagtaaaatccacttatttcaaagaatacttaatagcaaaacttctaaataacctggtaattacttgcagtttgtttcaatgatttttttaaaaaaatgaatattacctatgattatgtaagagtagagggcagtggttctcaactggggatgattttgcccctcccacaccagagaacactggcaatgtccagagacatttttggttgtcacaactggagagggagaagggaaaggtactgggatctagtgagtaaagaccagactgtgttagacatcctataatgcacaggtcagctccccacaacaaagaattatccagcccataatgtcaacagtgccaccattgagaaaccatggcctaggtgcatgaactttgaggaatgcaacagcttactttgttcttcccttttctttttttcttattgatctaccatggttctaagaagaaatacctatatatcaccatggttgatatttgcaaaaaactctttcaaagtatgtgaactattgcagatgtttgtaaatcctggattccaaacatggaacccttgtgtacttgttttctatagttaacgactggcactgttcagtgacactcaatcagagctgatgctggctatgagtacagcatgaccatgcaagctgacactggctgaattcaaaccttcttaagcagatgaacatttatatgtggggagagacctggaagacaaactggaatctggaagggttaggatatttggcctagtcctcacagaggggctatgtatgaggccttcgaagttcactggttctgataaacactacagtttcttgagggaaatcagataacgcaataatgcactgcaccccaagaattaggcattttcagacttcattggttttctagagaagtctgcttaatcattatatcctgttgcaaacaaaccgctagactgacaataccacccaataaaagaataaaatttgtccatctatcattaagataattgttattgattagtctccttataattttctgccttttgttttcagatattggctataaatcacagccacaacaggcactgagcctgtgtttgtgtctattatgtggtcctgataaggccaggcagcgtttttcaccttcctgatgcgagttattgagattgattgaagcgctttgcttgtcctatcctagacactgtgtaattaatgtttcattatgttaatacatgcaaatgtgagagtatgtgtttgattgggaggtgagagaacaaaaaggattaaagagttcactccaaagtacaaattaatttattgcattgctaactgtcctctgaggaatgagggagtaggcttcaaaatgaaaggaaaaaaatgcacaaagagaaaatgctgttgcaaggctgtctttcagaggtggtgtagttaatggttacaaaacagatattcagtcacatgacagagaccttgcctatgaagtggtttcagcatgtctccctctatagtgaaagggtttaggacagggaagccaaagagtattttctctttacatatacaagcatttctgcatagacatagtatattagaaccatactatattaatacagtagagtgatctttcatatgtaaacagcgattgacttcatgacattatttgaggtgcagcaggaaggaaattttaacccccaaaaaacccacccacagatctaccacaattatatgcatattactgcattttcttccttgtcttcacagtgataattttgattatttcctaatatattaatatataatgctctgtgatttacttatttccttaatgtcagacaatcaatatgtttctatttgtctggatttgctatgatagcaaatattttaatgagcactgtttttgtatatacagtaatttttgttctattgaattattttgctgagatagcttcttaggagtggaattactagagcctaaatctttttacggctttctatatgcattgctgttttagaaaaattcccactcccaatatctagcatagaaactcaataaatgggtgctgaatttaaggaagcctagacttctactagactatcctaactcttgaggttgccatattaagttgttttagctaatcattccttaatgtgggtaaaagctactgactcctcccatacatacccacgaagtgatggtattttgaatgggttttaaaaataagaagcagaagaaaaaggtggttagaatttaagactcagccaggaagggcaggcttggattggagagagagtactaatagcactctaaagtcactggataaccagggagaagggctttgaaaaagtaaagaattctaaaataatcatggattgtgtcttatccacgatttattcactggaggtattgtagagcaatcattataagatattcacaactattattacgttatgtgacttcatttattgtttatttactttcatttctgatgattaccttagagcagggggcagggtgggaatatgtggtcatgcctgtttcttttcccactgtctatggctgcttttctgctgcaataacgaagtggagtagttggtccataaagctaaaaatagttaaatggccctttgcagaagaaagtttgcagacctctgatatagagaaataaatctgtcagaaatggagattgaagtccaatacatttcaaattcatacttattctttgggcaaattataatttgtcacatcctcaggctcagttttctcctctctaaaaatcaacataacaataatcaggtagttggaaattaaatcatgtaataggttaaagtattggttcatttgttcttccctcttctgaaagaaaaagttcaaaaatgtaatcagtgtttatctagtagttacgttcatgctgtcctgatgtgttcatttgaagattcattagatgtaaatttttgagagtattttgtatgagttaataattaatgtaaccaaaaatgctaagtcaatcttctgtaaatgtcccctgtttgtagctacagccatgcttaactgtaggttgctgatgtcagcattggctgggaaggttgtctgaacacatttatccatgtcaaagcatcaaactcaccactattaagcaaaatggcatagagttgtgagttagttactgaatgtgatggagaagggttctctcctgtgatcctaactcccatgcctcattctgccattattcttcatggtcaagaccagtggagttagcagtgtctaagtgtctgcagtcctttctaacatgattcacgtatcatttttcatagtcacgttgcaaattgacaaggaagtcaatactttggtgatatttcttggttcacagtttccttcagttagacccatcacatttttgatcatttggtctcagttcgttttcagctgcatgttagtgtaactagtctgcagccatccctttcaagttagtgtcaggaggtacaccaataaacaccgcctttttttgttttttgtttgagacagggtctcactctgttgcccgagctggagtgcagtggcatgatcataacacattgcagcctcagactcctggaatccagtgatcctctcacctcagcctcccaagtagttaggactagagctgtgtaccaccacaactggctattttttaaatgtttttgtaaagacatgttctcgctatgttacctagggtggtctcaaactcctagcctcaagcagtcctcctgcctcagcctcccaaagtgctgggattacaggtaagagccactgaatctggcagacattggcattttatccacaccgaaagaagtttccattaatgggtaaacaacattaagatgagaatgaggcatgattctctgtaattcaaatttaactgaaaatccagaagcataagagtatattatacatttcagaaatagaaatgtatattctatatttcaatataattaattctgtttctagtgcttgacaatatttatcactaccagataaaaataaatatatttcaaactaaagtgtaattatgaacatctgtatcatctttaaaagagtaataagtaggtgaccatatatcttaggttgcctagaacaattccagtttatacactttaaaaatatatattatttttattttttaaacttccatgggtacatagtaggtgtatatatgtatggggtacatgagatgttttgcagtttatacctgttgtcctggcttaattataaatcaagtctcctttcagtatcagaagtgtctgaaatatatagtaaattatatgatgatcctagcgatcactctagtgattagcttgaaattagtcaaaagcaaaatgcacaatgtcataattagcctgtccccgtatcatacacgtttttttgttaaattatactttatttgacattgttggcaaaaaatgattggcatgctgatgttcaacagcaatctcatctaaaagctacttttaaaaccttggctgactatgttactgactctatatataggagatgttatcttgtatccaggtgggtatccatgaatgcctttaatctgcagagtctgagtttctctggccctgcatccccataagtaaggtttgaggcctgcagctagcaatccaagctttagacccagtggaaagtaattactcaaggaagtaaaaaatgttcactccttttcctttatcctctttagttcattaagtatgttaaagatggaaagatattctccttctctgagactaacaatgttcaatacttaaaaaaagttaccattatctattatgtattcagcactgctaaacccaaacaggcaaagggatttaagcagaattgtaggcatagttcttaactttgagagtagtaaataagatataaatatatgtggtagatcaataaatattttctgggtgacataaatgtttgaaagccctgatacttgtaaattcttataagaaaatgccttgtttcttcatagattccattatatgtaataaatccaggcttttgataattcagatatagccctgaggagaaaataaaggttttctaattttgtattactcttttaaagatgatacagatgttctaattttgtatccttctccaccatcagctccctccatgtcagacactcagggtcttctgatttgttgctggaagaacagagaaactgtcttcatggagaccttccccaggaattcccttgaccaccctgccaacactctgtgttaaccctaggctcatccctccagggctcactggttgccaacatcagtagtatgataagccattttacaccaagttatttgggatatcatagaatcacttactttgtccctcttcccagattatatatttacatgatgtattagggttctctaaagagacagaactaacgggatagatgaatatatgaaggggaatttacaaggagaattgactcacatgaccacgaggtgaagtcgcacaataggccatctgcagtctgagaagccaggaagccagtctgagtcccaaaacctccaaaagtagggaagctgagagtgcagccttcagtctatggctgaaggttcaagaggctgtggcaaatcactggtataagtccaaaagtccaaaagctgatgaacttggggtctgatgttcaggggcaggaagcatccagcatgggagaaggatggaggctggaagactccatctttttatgctggcagctgattagatggtgcccagccagattgagggtgggtctgcctctctcagtctactgactcaaatgttaatctccttgggcaacaaccttacagatgaaccaggaacaatactttgcatacttcaattcaatcaagttgacactcagtattaacaatcacacatgacaaagaggtttcaataccaaacactccatgaggattttccagaatcacagtagctaagaggcagtctatatcaaatatttcaattaatattgtgtgattctgtttattccatctctgagctggtttggccctacttctttgcttaaacagtgtgagaaaaagaaataacatatataagcagaaaggtgatctagaattaatcctacacaggaattcagacattgacattttgttactaggtcctcttctgagctgtgtcaccttggtcaggacagttaacctctctgggtctttgtccctacctgcaaaataaagttaacaacctttccctgaccaataggatcaaaagaggctgttatcaatcactcttaatttactgtaaacataaaaaaaaaaaaaaacagaaaaatcacccagtgtttgtaagctacaacacaaaccctcagcaaatctttgggtaaccctggcccatgatttaagatggtcagtaattcctatccctaccactagaccatctttgtgcaagagaatggatcttgctgtatataagtgactttgataattatcaggtttttttatgtctacattattcattcctctggctgtgcaagagcgagggcacatttttcatactgttttttgaactgcagagaaaaaaagttgaaagggaaaggaagaacatttcacttacttgattacattaaaagacagtaatagggttggctaatattatttaaaatgtacagtaattatagtttttaaaattacaatcctagtacatattatacaaataaaaatgttatatagcaaacagtgactttttttatgttctcatgataactaattagtccccagctcctatgacattgacgtaatatgaggttaaaagagctacaggtattaggagagaacccacaagtggggcagaacaagagtggaagcaggtggatatctggggtcacatgttgatgaaaagtctccagctgatgaattatgggggaacccacatttgagatagagactggtatattatactcaataaactcagcacactttctgaccttactttggctttctgtctcaaaattgtatataaatttagttctgagtatttcatgacaacacttgaacccctcaatggatttatagtctctatcattcaaggggacttgctgtttattatttagataaattttaggcttttactattcctaaatggtgctcaggagaccatgtctttgctttgagtcttactgattttttttatattagagacgacgtgaaaggaatttgttaaagatcaaataagataaattaatgaaaaacagctggatagaagcacaaccaggaatggtaaatagtggttaaacaactccaagaccccacaagacaccactggtgatactttgacagttccctagctctgcaggacttccagttacccagacatctttttaaagccaatgaaaaaaactctactgtgcaacagcagagtgggctagactgcactgcctttatttcaagaagaaaaccaaagaaatcttcatcttaaatatgtttttcatggaagattaaaacacacttagtaagaccattttctcatcctgtgggagctttttaggacaggatgatatgaaaatggcatgtgttttatgtttcataggtaattggaatacatttggtgaagcccctggaataggtacagcggggagtagtagccttggacacagtgggcatatccagaggtggtgaagacagggacaaggagggaggaatgaaataaaggatctgtggctctggactagaggactgttggagagaatgaggaagccagagagctaatagacatttagtaggtgtttgataataagtgtgaatgaatgaatacgatgaagaacttcacctggatgtacagccaacagaccaatcttttaaagcttataaatgctaaatctattaccaaaagaatggagtgttgaggagagcttaacataagatggcagctcggagctttgatgcccctcgctgtcaatcagcagtatcacctcagaacagggtcatcagactacagcccaaaggagggccaactttggccctctgcctgtttttgtaataacggtttatcatttttacattgttatcttttacatggcaacataagtatcgatataccatcctcggttttgcctcttggtccacagagcgcaaaaaaatttattatctggcccttgatggaaagtttgccttaccactgtctcagaatatgacagaaaatgttatcagtatagatactgataagcatggtttttattgacagtaacacaggcacatcttgcttaatgatgggaatcgttctgagaaatgtatagttaggtgattttgtcattgtgcaaacatcatagagtgtcctcacacaaactttacatggtagagctgactacacacctaagctgcatggtgtagcctattgctcataaactacaaacctgtacagcatgttattgtactaaatactataggcagttactgtaggtaacatgatggtatttgtgtatcaaaacatagaaaagccacgtaaatattttgtacaagagattaaaaatgatggacttatataaggcacttaccatgaatggagcttgcaggatgagaagtgagtcaatgagtgagtggtaatcgaatacaaagacttaggaagttaccgtacttactatagacttcataaacactgtacgcctaggctacaccaaatttattttaaaaattattttcttccataacaaattcaccttagcttactgtaacttttttttactttataaacctttaattttctttctttctttctttgttttttttttttgagactaagtctcaccctgtcacccaggctggagtgcagtggcacaaacatggctcaatgcagcctcaacctcctgggctcaagcagtcttcctgtcttaacctgctaggactacaggtgcacactaccacatctggctatttaaaaaaaaaaaaaaaaaagaatgtttttgtagagatggagtcttgccatgttgctcaggcttgtcttaaactcctgatctcaaatgatcctctcacctcggcctccctaattgtatgtgctagacttttatactactggcagcacagtagatttgtttatagtagcatcaccacagacacgtgagtaatatgttgcgctactacattacaatggctgtgatgtcactaggcaataggaatttttcagctccactacaagcttataagaccactgtcatacatgcagtccgtcattaaccaaaacattattatgcagctcatgactgtactgagtagtctcagtcattcaccaccaacctagcagaattaggtccattttttttaaacatatgttatgatttttctttcactgattgaagaaatttttccaaattattcgtttttgtctatctatgtttggttattcaacaggtatttgttaaatacctctgaaataggcaagggttcccaggggttgtatgaaataaacaatatgattcatgtttgctcccttggagtttgcaacataataaggtagaaattctcaaaaatatgatctgcaacaggaagatcagagccacaagagaggtacaataaagggctatcacttctgagagctgagtctgtcactgctattcagtgaagactttctgtctctgcacaggcctgtgtctaccgtttacattttgtaaaagaggaacctgatgagaatttatgtttactctttggcttaaaatgtatcactagctctaaggtactaccggaaatcacaccatgtcagaggccatgtgaatgccgtcggcactggcccctgcctgctagtatggtgggtccaaggtactaaccaagagctttcttttgcaattgagaataccttcttttttcatatacattataaaaactgctctattaatctacttggaatcatctggggctctttcttttttgaacaacccacatagagtccctcaaaaaccctattgatgctatctttaaaatgggtcctgaatatggattctaggaaaggctctaattagaatatttttagaatttggaacaaccaacgcctgcatgcagtaagcccttttaagtagaggcatgcatatttcttcatctttcagtttccttcaggtgaagacacatgaataggtccttcatccttgaggttcacattagaccatgaataagttgcacatatagacgccagaaattcccttacagttctgaccttctagagaggcttcattcttgctccccaagtcttcccccatggaacttaagtcaccatctataaaacaagttatttgagaagtcctttaataaatgctgacctcgtgagcagtttaaaactcattggtgcttagttccaaagctgatgtttctgttatcactgtgggttttccttcttgataccattcatggactaagcagaaaaatatcacctttctattgagacaagacacagtaaatatcatgacaaaatgaatgacagcattttaatgaaaatcgctatttggcctctatctttagaaaattggacttgttataatacaaatgttttatcactgatgagtccccacatcagacgttatgccacaatgtcaaccatgaggtttgctgaatttttaaggttttccctggacctgtcagacctttgtggaattaatccttcgtatttgtaataggagtttccacaagatgaatacttcatttctcatgaatcataataaagcagcccacgctttgtcagcaaagtgacctctgcagtcttttatcttcaagagaaaagattagactctctattttatggataatgaggtaggttcttggtctcttggcaccttcagtaactgtactctttgtggtcttgtttcagtctgtgataaactgatcagagggtgattatagcaaatctcttagtatgacaaatttcctcctaaatttgagggtaatttttttctgtaagtagcaaagttaataggtgtgaactcatagacttttataatattagagctgaagatgcctccttgttttattaatgagtgaattgattcccagtggtgtagcccacacttagaaggctaacgaggggcagatcagacaaagaactcaggtctcctgacccttgtgctgggagctttcttttgcaattgaaagtgccttcttttttcatataaactacataaattgctctgttaatctccttggagtcttctggggctcttttcttttttgagctacgctcatctcatccctcaaaaccctattgactctatctttaaaaatgggtcctgaatatgatcatttctcatgacctctactgcaataccttaggccaaatctcatcatttctcacctgaacaatggaaatagcctccaatctagtttctctgcttcttccaatgacctctgttctcaagacagcaaccagagtgatcctttaaaacaggggttctcatcctcatcactactgatgttttgggatgggtaattttttcttgtgagggtctgacctgtgcattgtaggatgtgctacgtccctctacatggtggatgccagtagcacccctctcagttgtgacaaccagaaatgcctccagacatcgccagaaatttcctaggggatgaaattgttcctccattgacaactactactttaaaacataaattggacctttttgctctccttattgaaactcttctgtaaatttgacagagttaaagcaaaattctttcacttgcctatgaggtcccattgaatctcactgtgagccctcagaccttgcttgctggaactctctcattcactccaacccagctattcctggggtgggctcgtcacacctgcctgggtgccttagcatcctctgcctgcggtgttcttcccctatatatctgctccacgtctgtgatgaactgagggtttgcatcccccagaattcatgtatcaaaatcctaacctccaatgttatagtattaagaggtgggactttggggagataattagggttagacaagatcataaaggtaagtcccccatgataggattacctttcctataagaagaagaagagacatctgagctctctgtctccccatgaacaaagaagaggtcatgtgagcacacagtgagatagtgggcacttactggccaagaaaagaggcctgagaatgggacctgccttgctaacaccttgatcctggacttcccagcttctaagtctgtgggaaacaaatctttttaagccacccaatctatggtattttgttatggcagctgaagcagactatgacaatatccttcttcacaatattcaggtctttgctcaagtcttgccctcctcaatgaaaccttctccaaatcccacaactccttcctttccctcttgattttcttctatagcacttagtctcttctgacattgtacatattttctcagttagttctttattgtctgttccttcctactagaatataaaacctagaaggatagggattattaggctgtttattattggattcttcaaggctgtttgttcccagccttgaataatgcctgatgcagtaggtgctcaataaatattaggtggatgaaggaatggcatgaagatgtttaaatatcttttacaccactgctaagcattacagtaaaaacaaaataatattacaaagtttatggtttcaattgcattttgtcaatgcaatatttttcctttggcctttaaagcaaaatttcaaacttactaggcttactgacaaagtgctaccataaatgtgccactaaaaagcaagcaattttccaagtagaagtgagaactatgacatgtagtatgaatgagttcccctttgagaaaacctaaccgaaaacaatccaattaagaatgggcgtagaaggatcctgaaaataacaagtatcaaatttgaatataaaatatgatcacaaccatgtggataataaagcaaatcattataaatgaagaaataattaatttcctggaaggaaatgcacagaaactttaacagtttctgttaaaatgatcattattggataagcaaggttatggacaattattatgatatatgattttatgtccatatttttgtattgtgtacactaaatatgggtaacttgataagagatttctaaaagttgattggtcacttcacaataaatggcatctccaaagcttgtctacttggctgccatcaaaatggagaaaatctcatgcactgggtactccttaaatcacactttttctaaatactcacaagagcacttcttagtgttttagttgacagttctgcatttataaaatgccatccctctctctacttagagaaagactgatgaaaaacacggaagctaaagctagcttatatttcatcaaactgagagggaagaaggctcaaacccagggcagattaagcaacacatcaaagtttctctttttagtgttaattttgtatgagacctggggcatgataacctacatgtccggaaatgttacttgttgggctggaaaaaaaatttcattacaattttcctggtatcacacagcaaaatcaaactgcagcttagagagttagctcttggggcaacaaaggaatgaggaagttactctcccgctccaacttagcccttattattgttctttaccattggatttagccagaggacactcaggcagttgcctggggcacacacttcttgccctttaaaaacctcagatctctgcaaagcttcttcagctttgtggaagatgccatgtgctcggaatgtcggatgtggagcctctgtgtgggctcactaagagatttcagctgggacagttgctttgtgaactccacatcttacctttatatttccaaatttagttccctgtaaagggaagagaaaaagaagaatcagggtatcaagagcaaatcggttcagcacccttttgctgagaatatttggtggtgttgcacttggtcagcaaatgtcctgacactaaaatcacttcctgattcagtcatgctagctttccaagaatttactcttctctagatatgtgacaactgaggagcacagtaggaatttatttgctagttgcttactttagctatggtcttaagaaggaatttcatggaggataggtttctcagataaaatacaggatgctctgttatatttgattttgagtaaataacaaataatattttagtataagtaggtcttatgcaatatttatttagtataagtatttaggacatgtttatactaaaatttatactaaatttgtttttcatatgaaattctaatataacttgtgtccttaatttttgttcactaaatctggcaactctaatgagggagaaactttgactgttccttttaaattttcacttaaattttcatccatagcttccctatattttaatgatccttaataaattcccatagtaaaatgtatatgttttctttcctgatcagcctttttttacattatttaagttcaggaattaattccacataacttaattcatttctgatttgcattttttagtaataaaaatttgtcttaaatggctttaaagtgttagtctctggcaactgtggaatgaatgtactcttttaaaaatatgaccatgtattctgacaatattttttaatgtcttatcaaagtgaataaaatggcaccagtgcttcacagaaaccccaatagtcataggtgctggtcctttggtgagtgcacactttctctctctggtctagcggaaattaaagtcttccattaatgggaaatacacaaagcacaccctcaggctacagcacagttaaatggctattgtggttttcccatctagagactaaactagactaaggggcagatcagcctggtaagtgtctacaattatattgtggaactaaaatggaataaaagaaaggcaatgtgataaagaatactggatgaacccaaacttcttttggaagaggcttgtagttattgtcactgtttagaagaaatcctctcatagccccttatgtgaagaatcaagaatattccaaggaatattctaaatgtccaaatgaccatggaagtttaattttgcttaatggggtaaggccatttggggcccaaacagtgtgctggttgtaacagaggaaagattaggtattgtaaacaatagtcctctttcttgatcctttctccacttcagcctttcaaagagaaatatataataaatattaataaaacgtgttgaaataagtgttcaattatttgcctttctagattatccttctaagttcacctacttacttagaaaaataatcaacccaaattacacaaattcctcaaatatgaaaagtcatggcaagatagtagaagggacacaagaacccccttgctccaatccaggccaccagatgttttggagcaaagttctagagttttagttaacgtgagaattacctggaagacttcttaaagtacagattgctgggctctactgccacagtttctgattgggtaggtatggggcagggcctagaattgtgcattttaatatgtatttttatttttaattggcacacaatagttgtacacatttataggatacaggctgatattttgttacatgtatacaatgtttggtgatcaaatcagactagttagcacatctatcacctcaaagagttatcatttgtttgggttgggaacattcaaaatcatttcttccagctatttgaaaatattcaccaaattattgttaactttagtcacagtacagtgctatagagcattagaacttactcctcctgtctaaggggtgtaattttgtattccttaagcaacctctgtctatcccctccctacccttcccagcctcttgtaaccattgttctacttaacattgtgcgttttcagcaggttcccaggaggtgttgctgttgctagtctagggactgtactttgagaaccactgtttcagaatttgtattctgatatactaaaccaagtgaagttaacatatgcttagggattctgttaattcatgtttgtttgtttttgttttttaaattcctgctccattgcatggcctcataagtattataatttttttccagggctaaagaccagagttaaagttgtacatgtaattgatatttgataaattgaaagtagattatattgcatcatccatagaattatttttatttccttcaatggaggtctctttatttgtcttaagccaaaagaagcaaatgtggtagcatctatttctaagaaaagatgatagtggcatggttttctgggttgatatgaagattcacggatcatcagaaactctaagcaccccaaaatgaaagtttgtgtaattttaagtgatacaattatgcatagcaagttctatggggatttgtatgacattttctaatctcaaaatcttgtaggagcttttttccccacttccaagctacttcttataaatttcattttgagcttctattgccttaaccagaagcttttacattttggacctggaaagagatttctgactccacagagaattattttttacacttaacaatgtttgatattgtagataaaatgtcataccttaaaaacctcattttaagttagtttgcctctgcgactgaatggtctttggaactgagaagaatatgataaagagagcaagcacaaagggaccaagcttagagaaatatttgtactatttgatcattttggtgagtttctaaaatatattaagaatattctctatgtatagataattaatataaacttgaaatgtctttggcaatattatttctgatgcttatttatgtctgagaaaactaaaacatagataataaaagttctcccttaggtcattcctcaagggtaggccttcttttatatcctcatcaggaagcatggaaggttttgctatcttggtatctgcttacaaactatcattttacagaaaaaaaaaaaaaggaggagaagaaagaggaggtggagaaggaggaagtgtaaggggaggaggaggaggaggaggagaaggcccaatgatgatctgacacctcattacttttcttcagacaattatagataagaaacgctagccaatagttaaatacatatatggctttatgcctatatttcaaccaaaatttagaaatcttcccaaaccaacatttggagggagagagagatggaaacactcatttttatggtgaactctgatgtcagactccgttgtgtaagtttcttaatggatgagatttgggaactttccagtctatttctccacaatatattatagttgtcttaagtaattttatggcagagttcaaaggatttctttctttatgaagcaaggcttggaaatgtaactatttgagggttcaaggggatggccattggacatcttaaaaataaaaccaaacaaaataaacttctccattaggttttcacctggatgaaatcctcaccattgtaattctaatatgaaattctctgcagcattgtaaaatcggaagtttagttttgattctcaaaatgagttcttctgttgccttcccatgacctccttccatgcattttccaggaggtctacactttgaatgaactctgagtacctaattccagactacaactttttgagccacaggctccgaagttatttctacttcttgtcttcttcagttttatcatctctgtcttcctctcttcatacattaaatcagcgtagttgatttaagattaatccttggatgaagtcattttataaaattattttatattaagaaattatatactggtgggcaaaatctctccaaatggaaccagtacactaagagaaagggttgagggggtttatctaaattgatgtcaatgtaatgtattcgtgggacatttcttagtcctgtgtgcaatacaaggaagttaaaggtagccttgcctaatgacacggtatttttcagtgccgcttcgccagccggaaatcttccacaacacgcagcgctcctgcctgggcctcactgggttccgagctggccgctgagctggttctgcccactcagtctgacaggctgcggtcggctcgtgctacgacccctgatcccacgcccaccataggcgtgccaggcatggagcggtgaggggtgtgtgagtgagtgagtgcggaatccagccaccaccgcacagagccaggtgcgccagctgctgcagtgcggcaggcagctttaggtgccggcacaggcgctggttccctgtgaggcggcagctggaccaggcatactgcaagcaaattctgccttcgatgctggtgtctggactgggggaacacggtgacacccaaaaaacttagagacgccaacaaccacagagccccaaaagggtgttacagcatgtcaccgtttgtttgttcccgtagcccagcaaacaagggtgtgtcagagctctggctccgggagtcccaaggtctgcacctccagaagggttgcagctcttctctccttcctgccatatgcagcacagtgaacggggcaaggggtgggcaggagtgtgtttcggctcctttgtgttacagctcattcagtcctgctgcactactctggcccacagctcttgggctggcccggccccactgcagcttcttgtcgtcttgggtggccactcgggcagcagtggagggctggagggctacagtgttacagctccttttgcacctgatgttcaatgggtcccaggttcttgtcctgcatccaagaagaatgaggttgcttggataactggagagtgagcaaggtggagaaaagttttactgagtgacagaacatctctgggcggagaggcgatctgcagtgggtagtccccaggtgtggctgagtctggagtttttataggctcagaatgtgggaggtgcagcctgtaggtagccatggaaaaggcaatatttgattggttaaaaagcattattcaggctggacccattggctcatgcctgtaatctcagcacttcgggaggctgaggcaggtggaacaactgaggtcaggagtttgagaccagcctggccaaatatggccaacatggccatctctactaaaaatacaaaaattagccaggtgtggtggcgcatgcctgtaatcccagttactggggaagctgaggcaggagagtcacctgaggcggaggttgcagtgagccaagatcgcatcactgcactccagcctgggagacagagccagactccatcgcccaaaaaaaagaaaaaaaaaagaattattcagaaagaaccaatcaggaaagaacaggcaaacaggaacagaagttctcactctggtcacagactccattcagaaccagcagcccagttttcaggctttaggcttttttcggcttgaaggttgggtttcactggggacccacccctgtctgcctgggaatttgtctgcctcctgccactgtcactaacatgagctgaaacttagaaaaggagaccaatagaatcatatctactatttctcaattaacttgattcaccaggatccatcttttctataaaactaatcactaatgcaagttacttaaagcagtgaggtgcctatatcccaaagccatatattcaaaatataattgttataaagagtacaaaaagctcaaattgccattgaactgcaagggtaattgtgttaaagttgatctatgtactcacagcactgaaaactgtcataatctccttgtttcagactaagtggattatttatgtgtgataatgggcacatatgctcattaacatgctgtcataaacagctgtgttaaatgtattatgtgttctgtgacataaataaggtgcttaacatgaggttgtgtttaaaatataggccccaggaagaacaaaaaagcaatacatgctttctaatatagttgcctgctcttgaatttcaaatttatttcttctttattaatgctacttgtatggaaattgtgggtattactctagcgaaatatcttggcattcaaggacattagaacttctttctgctgtctcatccttagtgtttctcaagccaggtttgctagcttgtgtttcttttctggtagaggaagagatcacgtagacatgggaaaggtattttcagcaaaatcagccttaagtgattcagcaagcttagagcagggttcatttgacagatgctctcaattcaatcttgttctaaaagcctccaaactagatgttgaacttagagatcatctagttcaacttcttaatttttgcagatgaaggaactgagtttctgagggcttaaaagacctttctgagtcatgaattttgaagtgataaaaccaagacctaaggctagatatccagacagccaattcaatgtacttcccactagaagaacaggatgtactataattgggttgactacaccaaaaggatctgtggggagaaggagcttatttgaaaataaagacaccaggctgctgtcatctgggatctttatcaatatccatctataatagagttatgtgctcaccattattttacaatttatattaattcaagcaaagttccagatgctttctgagtgagtggccaaggtgaaaggaatgaatatatgacagtgagcgacacaagacatcattgggcagaataacagacttcaaacgtaagttttagaaaaattgagtatgcaggaacgaagcaaataaaaccagggagaaaccgtaagaagctgttctgctttctcttcactgtaaaatggggtgtacaaagatagaaatagttctgtccatcaggaccagtatgagttaaccccttatgagaatatggattacctgcaatttagatgcctgccttttaaatgacagaagattggaatgattttacaaagtacaacgaaaagtgttcccattacagaaaaatgaaggaagctaatgaagtcaaggttgctatcgtggaaaaaaaaaatgaagactaaaacataatttaggtggtattttttaagaaatgaaatgccatttcaaacaaataaagggctcttaaagaaaatgtccatctcttctgcattttcacacaaggtgtttcaggagaaaatgggattaaacatcagcaagaaaattcagttagactcttaaaatgattaaatattgaaaacaagataccgagggacattgtagaatctctagccccaaagattgttcaaaatgaaattgaaagtaatttgacttgaatgatttaagtatacacctgtctgagcaaatggtggagccaatgacctcctgaaaccttgtcaaggtctttgactcaacatgtgagtattctgtcaaatgctatactgccagcttcaaaaacaatatactttaactgattatacttgcttcctcccctcaagattcttaaatgaatttctattacccttggttgattctttatgttcatttacgtttatgaaacaaattcaactgtaatatttatttagatttccaagcccatgagaaacatttggatgaaaattaagacccttcagggatttgtgattttaggtagtagctttattgacttgcttctgccagtgggatttacctattttaaaacccacctgagctttgtcctaaataactttgcccatgctgttcagagttgacttttattcttatagaaccctgtatcagattggattttttaaaaatttcaatggatgccataatcagaatgaagagatagaaatagtctccccaaaagtcttagctaccacactaataactattgctactttaaaatatctaattttatttggaaaatattagttttttctgtctaaattttcatgtactgactgatatgtggtaataagcatgccaggatttatatgaatttgtaatttctcataatattaacttttggagccaattgttttcttaattatgattacctcgactgggtacttttttgcttatttaacataatatccttgattttagtttttatttattcttggacattgttcaaagccctcagcttttgtgaaaagctttgtaaagaaaagacagggaatctaagcctgagatttatttgaatacatgaacatatttccctgtgctctcttgttccaggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggtaggtggattcttccttctcttcctcctcctccttcctctcttcttcttattcatttttggggatgagaaaataatttttgtagaaataatgtacattttaaaaatcttttaaattttaagttgacaagtaattatatatttttatgaagtacaatgtcatgttttgatgtatgtatacatcgtggagtgattatatcaagctaattaacatatctgtcaccacatacttctctcttttctgtggtgagaacatttaaaatctactcttttagcaattttgatatatacgttgctgtgcaatagatattaaaagcttatttcttctctctcactgaaaccttgtgccctttgacaaacatctttccattccttaccacgccccatcttcccaagcctctggtaaccattctgctctctagttctatgagtctgacttttttataatagattctacctgtaagtgagatcatgcagtatttttctttcagtgcctggcatgtttcccttagcataatatcctgtaggttcatctatgttatcacaaataacaggatttactctttttaaaggctgaatagtattccattgtgtgtgtgtatgtatatcatatatacacacacacacatatatatatatatctcatattttctttacccattcgtgattgattccacatcttggctgttgtgaataatgctgcaattaacatggagtatagatatctcttatataccctcatttcaattcctttggatatatacccataagtaggattgttgtatcatatggtaattctaattttagttttttgagaaagctacataaccatttttcataatggctatctaatttacattttcaccaacaacgcacatttttaagaaaaaggaaagatgtaaaaagattcatgtttattctgtcatggatttgactgacctttctccttaaattatcttagaaaacagtcataggacctcaactggctgcgtaaagttatgagattatttttttaaacaaaactgtttcaagttgacttactacttatatctaagggaggacttctcattaacagaaaaatattagaaaatataatttgctaattttactttacagcttcattaaatgctaaacttttgcagagtccatttttttgttgtggggccttaagaagagtaaattttattttaattatagtggcatggcctacaacatatacatgtcaagtaagaaataaaaattccttctagtgcttccaaatttcttaacgcttggtaacatgttggctcaacagctgagtaataagatgaacagtttttgttttcacctggatacactgaagtcatgtagactctgaaaaaatggtactgaccattctggaacccatgatattgctatttctgccccactcttctggttagaaggcagctcataattatttctgttggcccctgaaatgttagacctgcaaagtgaagaatcagtttttttacttgtttctataaagatttgaccaaaacctgtctttttttttaacttttatattgaccataaagcaaggcaagcagattgaacttgaaataaatttaagttatgaatgggtaagcagatttgaagggctgctttcaacgtaatctttagttctcaataaaaacaatattgaatcataggctgtttagtcatttgttatgggttttctttcccaggtcctacttagtctagtctcatcttggaagactgatcagaataactcattttcatcaataacaggacaattgggcagaatcaccactccttcatgcactctcctagtgagggtctgagaaagttgaaatctgaaagatgtgattttgtcaggtggtgctataaagaattacatctcatagatatgtggttaattcccatatgtagcttcaaaccactcttctgtagcttttctccactaagaactctgtagactgaatgttttttctccctaaaatgtgtatattgaaattctaacccccaatgtgatagcactgggaggtggagcctttgagagataattagatcatggggtggagccctcatgaatgtgattagtgccgttataaaagtaaccacagaacacccctgctcctttcaccatgtgaggatacaatgagacgtctgtaatctgcaacccagaagaggaccctcatcagaaaccaatcatgctggcaccctgatctcagatttccagcctccagaactttgagaaatcaatgtctgttgtttacagcctacccagtccagatactttgtgatagccacccaaactgatgaaggcagagttttccatagtcagttaagccagattttacctagaggtagactggctagccattctgcttttctttggactgacttggcttttgcacttgaaagtcccatatcctgggaagccacctcagtgccaggtaaaaccaggacagtgggtcactctacctcaaagtgtccctggtctgctttagcaatgacagactgaggtgcagatgcagaaaaccccctctactcaggagacaggccaggtgacatcctgatggtgaaaatcaaggctataaagtaactggaaccttggagtgatgagtgtctgaaatttgattgatgagtataaagtgtagagagaactgaatgttaatgttaattatgattgattaggagaaacaagtggaataaatccttcagatttggtaaaagcagctttctcagaatgctccaaatgaagtggaaaggggacaatttgactttcagtcactagagaatttctggcctcatagatcccacccatcagttgtccacaaggccagaggaggtctgctgatttgaatgaagcaggctgatattttgatgccttattatgaaaggcagctgcctatgcactgttaatgaaaatggcctgttacattgcagtttcagtcttcatgcaatctacattcacatttacatgtgctgtctttcagtagtgaaatgaagaagagttccttcgctgtgagatattaaaatacagtggcttggactttagtattctgtacaaggataggcacacggattcagtcactgagttaaaatctcatattagattgtatcatttcaaggcaataaggctgttcacagcattttaaacacttaccatgctgtttggcaacacagaatacatcaatgttatgtctgctgaggttaagattgccaaaccactagaattcacaaggggcatatatcttcccagtaataaagaccatggacctgatttaatctcagttttaaagcattagcactcaataaaccagtcaccactaaatggtaacagtaggctttgcttgggtaaaacaacaacaacaaaaaaatgttttgtactctcaggtgctgtatagagcccatattaaataatgtccctcttccatttttgctttctcaaagtgtcttttgataaaaagaagtgtagcaaatgaaatctgtctttaatcagtcagcacattttacacaatgatcttgccatgcaccattcatcctattttctaggagcttctcaagtgctcttaaaggcttgagtgcacacttggctggagagggaaggaaagtaggaaagataaacgaagaactatcattccatccaacattttcttaaaagttgcaaagtaacaggctactgactctcagtatttctagtcattttgagttctatcagtaaagaatacctgggctattaagcctccatttgaaagcaacttcatcatactggctgaaatttgggaattttatttttatccaattagctctaatctaaaatgctgcagtgtttctgtgccatgtatacttctatttagtcctctagattgagaacagctgaagaagggaagcagcgctgaacttatctatgaagctttcctaccatcccctctactgtgtatctagcaaagtatgtcatgttaatagtagacatttgccttaccaatgaagacctggggctttatgccatataaagagagctttccgctgttgccatcctcctctctacctctccttctttgtctcccttctactcctcctccttcttcactggatttcagcagatcaaactcacccatatatgtgcatacataaacatactcttaacaaactgagttggaataatttgctttatatctcaatagcctacaaattaattaactattgaaaactttgtgattagaaaattgactgtttgggaatattcaagtgccacttaaaaaggaaaaagcatgagcatttcttcattccttccctaacccttaccgtgaaaatgaacttgcatctggccaagcacatcttccctactctaaacgttgccagctatctgagcctctggagtattttctgttcagcagacataataataacctacctcccaaggctgtggtaattttcaaacaacatctaggatgtaaagctctagtgcagagtagattcttattcaatgacagccatagtataaatagaactaacaattattattattgtgttattttaataattattaggaatgaacaactttcaatattcccatgtgatgatgcaaaatattttttttcagggcaatgaaaaataggcaacaaatcctgagacatacatattgtaatcttggatcagatatctgcctttgcaatctgtgaacacaaactggcaagcctgaattaagttttcaaaaagttaaatctatgggagattttttggcaagcagtgcccaaatcccttggaataaaagattcatttttgaccactggatctactattatgttaatgcaatcaatacagtttgtactgaccagagcaggcgtttgagattgagtgaccttgcaatcatttccaaaacatgtacagggcactcctctcagccttcttaatggcttttcaactgaaaaagattcactgaagctggttcatgggagttcacttggtctcgacttggagtttaacacaactggtaccctcctggggatgaggaattaattctaatatgtaagaagactagataacaatagatttcctatgaataaacataaaaatcccattttattttgcttttttatacaaccatgaccccctgtccacccttccccacacctacccacccacacagctccttgtccactgacttgccctgcacactctaaggagcacggttggagcctaagtggtacttctgcttgcatttatacttctggggatggcgtgggacaggctcctccaagggtaaagcaatgttgactgctggatacattatattgtatttgtgtccaggtagatttgtctttgttaatttttcagcatttacattttaacattaaaaccactgacttgctttttatagcagtttctgcttcagaaagtgaatctctatacattaccttgtaatgctcagaaactgtgatttaagtacccaaattgacaggttaagaacttactggaaaaagctaagagctctatggccagagattgggacttagatagtctaaatccagatgcacacttattcccttatcactttgcttctcaatctaaggactagatttcagaacgctgtaaacaatttcttatgtaatcagtcatttatttttaatcaatgaaactctccacaatacaaattaaggaaaataacaataatggtaataatgataataataatgaaaatcgatttatccacttagtcccttgaaaatgtcaactccttgtgggaaacactatgatttagatgttttcttctaagatgagaagattttgctatcatagctatacattcaatagtgacacatgacaaatctgtgtcagaaaaacagacagcatataatttttaaaataagctcataaataatgatctttctaggaacacaatttggtaatcttttatctttctaagtggttttacaattcaggcgaagtttgcatattttttttctgcttcttaaaaatcaagaaaataaaaggccaactaaattgcatttcttgacttgttatttcattcagggacatatttttttcttccctattacaatagatgttcaagatgcaaattgtcacactctgcttttaaataacacctgcattataattaaaattcccctgtgtttttaaaaaataattaattacttgaggagttgtttcagtgaattctcttctagaatgcctcccatttaaatgagttatgaaataattagtgaaagcatattatggtgagagaagctagaatgaagcattttgtgaaatgataacctgacctttatgttcttacttaaaagaacctgaaaaaaaaaaaccttaactgaagagaaggaagaataaaccacattgcctcaggtcactcaaatgttatataaaggaaacaccaagaaaaatgtttatattccttctctctacaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaactgttatatgtttactagtcttatcatttttctttaattttattgctaaatcaaattgagatacagccatcaccaatatttccccaacgcctattccatcacacagcccccacaccctcaacttaaataattgcattttaaagagtagggttttagttgcctccttcctaagtcaattaactctgcaataaaattaaaatacaaatatattcctgaaaaatatgcagagtgaaaagacatcttctacattataaaatttacaatagagaacttgacaaggctttttatagtagaaacatcaacaaaataacctaaaaaaaattttcaacctttcatttccttttctttgttatgaattctaattcatgtgacaatggaaatagctaattattcattctaaatttaatcagtatcttaagagctctgttcttttattcaactcttaagctgtctacagttcgattttgctggtactgtaatgaaaatgcaagagaaacatctaacacaactcagtaatagtaaccaaaaactcttttgaattttagaaaacctttttggaatacaaaaatttaagtttcttgaaaaacgtcaagataaaaaagattcaaatcatagtaatgtgagagaaaataatgtaatatctgttcctttacatcacaaggaaaatatattacactgttaatcttgttaatctttaacaaaacacagattaacaagaaaaaagcataacaaatttatttaaacaaagttatacacaagtaactttcagaaatgaagacccaaacccctagggaaagctttatatttttatgctaagtcttatcagagaagtggagaattgtggaaaaacatgattggacagagagcatagacaaatggaaataaactgggggaacttgagtaaggtctgattgttcaaataattgtctgcacctctgtatgatattccttcctgtattagtctgttctcacactgctataaagaactgcccaagactgggtagtttataaaggaaagaggtttaattgactcacagttctgcagggctggggaagcctcaggagacttgtaatcatggtggaaagggaagcaaacatatccttcttcacatggcagcaggaaggagaagaatgagagaagtgcagagtgaagtgggggaaagccactcatgaaaccatcagatctcatgagaactcactatcatgagaacagcattggggaacaacccccatggctcaatcacctcccacgaggtccctcccacaacacgtggggattacaatttgggttacaattcaagatgagatttgggtggggacacagaagcagaccatatcacttccccggctatggggcaggactcctgtcacatgagggtttcttttatggacagctctcacatagaaaggtgggagatagtcagagcgtgacctccaaaccaccacattttggtgtagcatgtcctgcaccccatcattaagtagaataattgtagcattacattagatagcacagttatacaattctgatgaaataatgatggataataactttatgaacctatttctggtactgatttttgtcctatttttatgtgtatggtaaaatatattatttggactcaataactgtatacaaacacatttgaattaagatattaatattagatacaaagcttttctacaaagtaaagagacatcaaaacctagagtgtgtcctggaagccaagtaaattaattagaggaaatcatggaaaatctcagtgtatggtacttcaaccatcttaaacgtctactgtcataagcagtatatatagatgaaagtaatgaatacagttagtgaacacaattacttatctccctgtaaaaagttattgttaacagtctttatatttataatctatatctgcatactctataataagcagtctaatacattggtcattgtattagtccattttcacactgctgataaagacataccagagactgggaagaaaaagaggtttattacagtctacatggctggggaggcctcacaatcatggcggaaggcaaggaggagcaagtcacatcttacatggatggtggcaggcaaagagagagcttgtgcaaggtaactcccctttttaaaaccatcacatcttgtgagagttattcactaccatgagaacagtatgggaaagacctgcctccatgattcaattacctcccacagggtccctcccacaacatatggtaattcaagattagattttggttgggacacagtcaaatcatatcagtcattatgcctatcattgctaaatttgcctattatttggtagaggtaagagaataaatcagaaaaagccatttggattcatgaaagagcgagataattttgacctagcaaatcagttgttttggaccttgaatcatgaagttaacataaaacaataacaataaaacaacaatgataaatatttctgatagaaattcaataatcagagtaggtcccaaatttccaaatttatcttttcattctatgttatactgggaatgaacaaacacaaacccatgcacacacacacacctgtgactcttagtgctctagcccagagttctttggaagtttcctgttaaaagacagagccttagcctcaaaggtcaaagcgcttccactgaaaaaccttgtttgaaaaattccctctgtagtctcagctactcgagaggctgaggtaggagaatgtcgtgcacccaggaggcagagcttgcagtgagccgagatagcgccactgcagtctggcctgggtgaaagagtgagactctgtctcaaaaaaaaaaaaaaaaagaaaaaaaaaaagaagaaggaaaaaaaagaatttccacagcatctgaggagcagcttttaggtccacagaatttatcacaggttcttaaccagcgcttattgtgaaatgtaactcaggtatctctaattgggccagatggagctatggagttctaatttctggagggcagttaagcctcaaagtttggtttctcagagtagcatgtctaccttcagaatcccaatgagcatgtgtcagagaaaagtcacatttaaatagtttgataggctgggcatggtggctcatgcctgtaatcccaacatttgggaggctgagatggcaggattgcttgagcccaggaattcaagatcagcatgggcaacatagtgagaccactgtctctacaaaaaaataaaaaattacctggctatggtggtgcatgcctgtagtcccagctacttgggaggctgaggcagaaggatcacttgagccaggagatcaaggctgctgtaagctgtgagtgtgccactgcactgcagtctgagtgacagagtgagaccttatctcaaaaaaaaaaaaacaaacattttttaaacaaaaatttaaaaaatatttgataggtctcagtatatctggggctgggagtggtggctcatgcctgtaatcccaacactttgggaggctgaagcaggaggatcacttaaagacaggagtttgagaccagtctgagcaacatagcaaagtcccatctctacataagatttaaaaattagccaggtatggtagtacatgcctgcagtcctagctacttaggaggctgaagtgggaggttgcttgagcccaggagtttgaggctgcaatgatctatgattgcaccactgcactccagcctgggcaacagagtgagatcacaacttaaaaaaaagatggtcatatatgtgggatatagtttgtgtgacaggatctgtattctatcacatctgcatatttcccgtgatgatctgtaaaggaatgagtttacactatttacatcctaacttaggttacccagagatatttagatataaacacagtacacagacacattcacacacctttccatttagatggctcttcctagataagcttctgtatcttcaatctactgatgaacaccatggtcataaaatctgcttgttgatttataactcctgttcttttcatacacattttaaaaatctgctttaaaaaatcagtttcattgtaaccctgaggctttatcacccttgaaacaggctgctcatcaggttcatttactaagattttacctgaaacacttcaccaactagaaacctatttaagaaagtatgttaaagattaataaagcctatatagcttcaacattaaatttcagtgctggttggttttattggattggatttttgtggtcccttttgcaaaggaattcatctccaaaggctgaaacatgacataaaaaataattagtatttctttgatgcagaaggcacaggttccaggagcatcctttgaatcccacagtgcattgggcactccatgagccaaccttgtggctatttttctaaagttgtttccagttatgtcccagcccaggagtggccaggtttggaatatgtaattgcagataaaataaatgttctcttccacctcagtatacacattgtgaatatctgggatttgtttatttgtttttattgggaaatagtttatataccataacatttaccctttaaaagtatataatccagtcactattagaatattcataaaatcgtgcaaccaccaccactatctaattccataacattttcatcactcctatctccccttctgctcctgctctggaaaacacttatctacttcctgtctttgctatttaacataaatgagattatctgattatcctgtggcttgttttttcacttaatgatatatcttgggcatcttcctatatttgttcttacagatcagtttcatggtttttaattcctgcataatatttcatggtttatgattcacatattgaaagctattctatttgtttctgaatttttgcttttgctaataattcattaatgaatgttcttgtatttagtaaatgctcttctgtacatacctttgacaagtcttcttcttacctagtggtgtaatgacttaatcaaacggtatgaacattttgatagaaactggtatattcaagagcattttattagcctggacctaaacattgtaagccaggatttgttttactgctattgactgagcatatagagctgggttcttcttaacttgtaaatatcattgaagcctactgcctactctgataagaatagtgacgagttgacactgttaatgaatagccataggcatttgtcagagagaatcttatacatggaaacctagaggaatgcatctcatccatgtcctgggtttctgactatggtttggatattcatcccctccaaacctcgtgttgaaatttgatccacaaggtggggcctaatgggaggtgtttgtgttatgacagtggatttctcagaatggctcagtgccatcctcacagtgataaatgagctcttgctttattagttcccaggagagctggttgttaaaaagagcctggtgtctcctccctctccctcttgtttcctctcttatcatgtgatgtctgtacatgctggcttcccttcaccttctgccacaaatggaagcagcttgaggcccttatcagaagtagatgttggcaccatgtttcttgcacagctttcaaaaccgaaagccaaatgaacgttttttctttataagttatccaacctcagacattcctttatagtaatacacatagtctaagacaattttccatgtactgatttgtgtctcttctgctgtctgtaaaaagaagtttctagtagatatcactccatgaactatcttgggattcctcttaggtccaaaataacaatttttcaggctctgtatataatgtcagaccccatagagtcacatcagcataccatagaagaatgagaactctttctggtggcctaaatgtcttttagcatctgagtcctgcctatacctctagcctcattttcttttcttttttttctttttttttttttgagacagatcattgctcatgttgcccaggccggagtgcagtgatgtgatctcagctcactgcaacctccgcctcccaggttcaagccaagtaattctcctgcctcagccacctgagtatctgggattacaggcatgtgctagcactcctggctaattttttttttttttttttgtatttttagtagagatggggtcaccatgttggccaggctggttttgaactcctgacctcaagtgatcctcctgccttggcctcccaaagtgctaggattacaggcataagccactgcacccagactctagcctcatttgtaaccaaatccatactcatctcttcatgttttacagcaatttgataaatgtgcattctggtgccacggctttgcaccctttattctatatgccttattctctcatacatcatgctagctcttgccttttcttcctcagactcagttcttgcaacccaccttcaggaacctttaactggccccctagactaggagaggctccatcttctttgtgctcaccgtaatctatccttccctctgtcattgcatggagcatattacactgtatctttacaaggctcctagacaaacacgcctccttccctggccaaagatctcataaagacacagaccatgttacatttgtcttagcttccctaggcagtgagactccacagaaccttgctagttgtgtggggtaacacggtggttagggacacaggcttcagagctagtcagcctcagaatctatctcttggccattcactagttctgcaaacttgggacaaccatggaaacgttctgggcctagttttttcatgtattaatggctatgagatagtgtctatcttctatgcttattgtgaagattaccaaataatgctgaacagaggacctaaaacatagtgaagcaggacgtttccctgaccccttcactggactcgcaacaggggttcttcctttactcagcccactgctctcaactccttgtggagggagcgtacaagtgaacaagtcagcaactggagtacacaagtgctagaaccagtcggccattttggtgccggtaggatcaaactctaatcactagacctgctgcacacccttcacaggagggagcgcacaagcgagcaggtacaggagccagagcaagcacttttgggcgccagcaggagcaaactctatgcaggccccatggcagcatccaggtggggtgcctgcaattccggaaggcccagagggtgtgttacagtgctttcagctctgccatctgcagacagcttaagtgttagcagctcagtgggcccatagctaccctctgccaactaaggcaaagagccagtgtgacagcctcctgtatctgcactcatggctcccaagctcttgtccagcatccaggaaatataaggttgcatgaataaattgaaggatggtaaatgtgggggattttattgccgatgaaagtggctctcggtgggaagagaagctgaaaagagtacagtgtgggggaagggtaggtaatcttcccttgaagtctggccatctctggctgaattcttttttgaagttatgccatcaagctgttcctctgaagtcaagccacttctctccaatcatccggctgcttctcccctctgctggctgagtatggggtctttacaggcacatgatgagatgcggtggggccatgggtggtttaggaaaaggcaacatttgagcaggaaaacagggatataagttctccttttaggtggtgatttcaggctttttagcttgagggtgagattttgtcagggaccgacccttttctgcctagaatttctctgttccctgtccccatcaatggtaaaagctcaataagtgaggctttatgaaaaacagaaaatcagggtagtattaaagattccccaggtaccttgcagcaaataggaagagagaatccccatgaagaaggctttttctatgtggggacacatatcctgtgtctttgctgctctatgagtattggcctgtttcccatgcaaagtttgttcttccccatctaggtgggccctctgcaaacatacgagattatatttatctttttaaagttcttagcaccaatattgtaggatcaatacttctgcctgaagtaaataggatcaatcaaataatgactgtgctagaaagtagttggataatactcagggttcatgatttttttatttgatgatattgaaacacatctctttaacctcacttagcaaaagtcagaagtaaagtttgtcatggctttgaagaactttctatgggtcagcaaaccttgggacaatttcactacattctaggaaggcatgtaaactacctattggccagctactccaggcagcctttaacatatcacaaaagtaaatggtcattacagacataaaaataatggggtcaagagactcatgcttattatgacttgaattaacaactatgttttcacacaaatcttcattatttataactggcttagacaattatccctccttttacgcttgttggtttcttgtgttcaaaaactgcaagcagttactttattttgcccgaaggtctaaatttgtttcttccaacactaagccatttttcccaagtcttatttttcccttgaatttgtgtaaatacctgtagtacaaacgtttcactttaaaaaagggctttttaaaagccgtttttctaggaaatattttaataatcagcattatttatgttgcctgtgtagttatgtaaataatttcagcctttcctcacaaacaactcttataacttaacatgccttcagaaaatgtgaataagattaccagataatgcctccccagtaagcatgttagcacttcaggaagaaaatgtgagtgctgagttgagaatgtgtgttaggcacaatgacaataacaaggaggattacaaatgaaatagcgctacaaatagcaccacagtttggaggaggaaagcaatttggtgaagtgaaagatgttaaatgttttaattttcttctatgccagtaaaatcttgtaaaacaaggtgacatattaaattttctatactacagtctctccaagagcctgtcaacattttcattgtaaactctattttcagagctttataactcagcattaagaattcactctggcttgacatttagagtgtaaggtcttacctggggaacatgtgtttcatatgttttaaaaattacgagtttatccatttctcagtttataatgagtaaccttttcacactttttcccttgtctgctgtgcctcagaaattgcagggagaaggcttacctatggtaaatcgccaatgggggaagaatctacagatgtggtcaacacaggtcagggctgctgattttcattactgaaactcacaaagagcttctgtagaaagcaaagagctctgctatgctgccctcaacatttcagactagactttgtgctatccaaggggtatattttaccacgacaaaaacctgactgattgcagaattcttagtcccctgtctgtttatttcaacatttgtattatgttgtgtctggcataagacctttttctaaagctttacaacatacaccctaatcttgcttctttgtttttaagtcttctttgcatgtgtttgtgtgcatgtgtgtgtgtgcatgtggtttattttccacctttctgtcattatttagcatagggaggttttcagtcaatattattcagtaatacggctaccctctttataccttgaaatacctacagtttaatctctggaagaattagtttttagaaagttagaattagaaaagggtgagggagaaataaacaaggaagcaacagaagagaaaaatatctgtggccatttgatatcagaccttaaaatgtcttgaggactgagtaactaccatggcttcccaaaaggatcatatgtgggttgtctaggaaaaaaatggaattccttcaataaaatacatggtagcaagtcttcagttctaggttatttcaggagaatcctagaaaatcatcacttcctgatatgtattgagaattatttcactcccacctaattgcattgtattttacatggctgacaaattatcttccaaagtggatataccattttgcatttccactagcaattaatgacagtttgttgctccacataaccttcatcatttgatgtcagtgttctgacttttgggcattctaattagacgcatagtggtatttcactgttattttaatttatcacttcctaatgacatatgatatagaatatcttttcatatgcttatttgccaccagtgtgtcttctttggtcagatatatgtgcaggtcttttacctgttttaaaattgaattattcatttttttctgagtgttaacaatttttgtatatttggtttgagagtcctttatcagatacgtcttctgtaaatattttctcctgttctggagcttgtgtcttcattctcttgatggcatccttcatggagcagaagtttttaattttaatgcaattcagtctatcaattatttctttcaaggatcatgcctttacatattgttgtatctcaaaagttgtctaaaagccatctctatacccaagatcatttagactttcttctatgttttcttctagttttatagtttcatattttacatttacatctgtgattcattttgagttaagtttgtgaagtatgtaaggtctgtgtctagattatttttcttttgcatgatgatgtccagttgtttcagcatcaattgttgaataaaactgtctttcaccataatactgtctttgttcctttatcaaaaaccagttggctatattttcaaaacatttttagtgtgtttatttctttccatgtctattaacaccatccaaacagaaactgccatcatctcttgcctgcttctcctaaaacagtctattaattagttgacaatatatttcatacacagaggagagttgtcttttaaagcatttgaagttggtggatgattttccactgcttttaggatcaaatataaacctttagtgaaatataaagccctgtggaatctggcttcctcctgccatcccttctctctcttttcctctccttcctccccagccaacttcatttctgccaatttcttcataatgctccagccatatttttttttcacttccttgagcatgtctcacttcctcccacatcaagtcttggactatggagtaatttcgtggaaatcctaaacgcagctgcctttggtttagctcattgctctgttcattctttaaagctgttttgctgtttctttctctgagctatctgttgagtgtttaggtatcactgctaactactatcgcataccatgccctcaatgtccttcataacaattgccaattataatttcattattatttgtttagcacatgccttcctcactagagtgaaggcttcctgagagcagtcagaatcatatctgtcatctttgctgttgtattcacagtgggcacagtattatagtgtctgaatgtcctaccagagtcatgggcagtgactgaactggaatcatcagaactgcagagccaaggagctgagggttaagctcaagattactggagcccaggacttctctattcatctaggagtgaagtaatccaatgaaaagtcaaaagactttagttatcagtgtacagggaaaacctagagaacaaggacttggtgagtcatggaatcttggacttagaaaagataaaagtctgcatgtagaagtcagtagttttaatagtgatctcacattcagagcattacatgattcagggttcatcttccttcgccatccttcaaagcacatagtccagagatcatttcgttttctatacatggttcctcacatgctgaggaagacgggacaatgttcttggcctctccttcccactgggcctccacaggggaaaattagcagcattcattttttccattttaaagaaataatccgcttttcttttcagaaagcagttttccaatgctctgaggtttacgttcatgcctcactgggcctgatttactcagtgtcatctgagcaaagaggcgccctgggatggcccagcattagagctggtgcttgagcccagatgcacgcacagaatggtacatgaagcaggcagaaggtggagaccatatatttcttttaatgcagtaaagaaaaagtattcacatagaatgaatatttaaataaatgagtaatgtaattatttttcagttccattcaattaaaaaatatttattcaaattaaaagggaatatgcctgagccccttactagctgacattggtgatttctctagcgctttctcccttagagagccactagccttcttctccttccagaggctggggatgctctcacttttctttcctatactctatggagggacagataagcaggaaacttcctctacatagaaacactagtgagtcaatttccaaacccagagacattttggtgcattacactcactaatataacatggagacattgttatcagagaggtctctaacaaagttttctctgtgctattttatctatgtgagggaggtgggaatttcttcaatatcaaaaacctcctttaatattgagcagttttttgcacttgatcttagccaaaaggccaagtagcactgaaatgttttttgtttgtttgccccctccacacaccttctctctctagtcacctctctcatattttaattaactcgtaagttcagtgcttctcaaatttggtgtgtaacagaatcttctgtagaaacttgtgaaaaaaaaaaaaaaagaaaaagaaagaacaaggcccaggtgttctatctcagtgaggctgttgtctttattagctccccaggtgattctaatatataccaaagttttaatatgtctatggtttcatgtttacacgagataacactatgctttgttactccataatatcctctttttttcctaatgtggttgtttactcaatgatacattctttttacttactagagttgaatcatttttgattcttggaagctattaactatcagattctctttattagaagttattgtcatgacaaacacttaggtaaatggcgattttgtcaatttatgctgaatatctcttggtttaggaactttatgttaactgttattcttttaagactagaccattgtaccatgactaaaaacagacagtaaaccatggatatcaagagaataatagcgagaggtttgtaagtgtgtattgtggggcaccagcaatttatttttcagaaagccttattaaatgcatctctacggattgccatggtttatggcagaagtgatgtgatgatttgtattagagttttaataagtttagagttgaaaaatttattctgctttcagttccttccctctggctgacagttaatgtccaaggtacttaatcagagaaactaccatgggaggtctaataatactgtgcaacaaagggaaaagcacatctctaggatcaatttcagagccagctgtattttctccttaaagaaataataactcaaatgagataaggtcctgccttcaaggagatttcagtccagaaaaagatctgatccatcacagtgcttttgttttttattatattgggtggtgttttgtctttctttatttctttctttcatggtaaggactcaatggaagctgaaattccccgaggagtgttttagcatcttatctctagtttcttgcctctaaaagttgaagttacagtagcacagtatacatgtttctccttcttgcttatcctggagacttcctgcttaaatatatattgaaatggttgcaaatattttcattgccaagaaaataaactgcaaattgtttggttgtttggcattcagagtgctatgggcatagatccttgatggcagattgactgtatggctatagctatcatatgatgactcttcaatccctttatgacttttatgagagaaccccaccacatcctccagaggctgctgtaacgattaacagcaactgcaaataactttgcaaaaggaaattatactttgagtggaagagcctagatttaaggtaatgaaatccctgaaaactatagcctatgtgttaagatttattctttaagttggttagatatcaaactatgattctggcctttgaactcttaatggtgaagatttttatcttacatgatgaacacattacaacaattttgttatctgaacattgagtaagttagtagccacaacgaagaggtcagccttatattttatatccttaactatgagttctatttcaagatgatgtattcaccaaatctttattagtttccccaacaatactgtgggcattgatataaaaagtttataggaattgaaaaattaacccccccaaatatatatctctatatatctatatctatctatttatctatctatctatatattttgagacagagtctcgctgtgtctcccaggctggagtacagtggtgcgatctcggctcactgcaacctctccctcctgggttcaagcaattctcctgcgtcagcctcctgagtagctaggattacaggcatgtgccaccacacctggctaatttgtttgtatttttagtagagacggggtttcgccatgatggccaggctggtctcaaacccctgacctcaggtgatctgcctgcctcagcctcctaaagtgctgggattacaggggtgagccactgtgcccagcccatatatatatatattttttaaaggtgggagtatatatacaaaagacaacaacaatttgtaggaaagataaatcagatacagggggaagacagatgaatcaaggctgttgaagctgcagccaaccaaatttccccaataataatttccacaggtggttgttaaatttaccagtttgtaattaccaaattgttgtggggcctggcaaaccactctgtaacaggggccccagatgcttgtgatattcagaatgattaggtaaactgtggcgtggagccatggctgtcagaaagtgtggtccctgatcagctgcatcagcatcatctgggaacttgttaaaaatgaaaattgtttagctttattccagatctgttgaatcaaagatgatggtggtggagcccaaacaatccatgttttaacaagcccttcaggtgattctggtgcacactcaagtataaaaactactggtttagaccaggcccagtttgattgcagttgatgtggccggctgaatgttgaagacgcttcagtaccaagaaaaaaccccaaggtaggagtgagggagaaagggcagaatgaggaagtggggatattaatgagatatctaattctatcgctgtagctacatcttcttccctgtttactttgtgcagaatactcaacaagtagccattactcccaaggtaaaagaagcagcatcttcttaaaaactgagtagactggagaggtcagagcagcaaagaactctgcattctgttgaaatggcaaaggttcccttgttcccctcgcagagtgtgtgatgggggtatggcttgcttcttcagtgccccgctgctcacccctctaggggagcatacagtcgggtcctggttactgcctgttttctccagccccactcatggctgctggactagcctttgcctgctgggaaaggttaaggagaggtgcccctgaaccatgagtgtctgcggctgtcgaggtgaaggcatatatgacacctctaggaatagttagtgtgatttacaccttcggcagctgagccaaatcctcactttacttagtaacattgctgtagcctgtaccaaaactctttacattgtaaagaaagtgataagagccatttcaaaccatgtgagagaaaagagagaaagtctggggcttttgaccagcccagttagagtggagttttttaaagcccggtgaagggaaacagagcctcttaccagcaggaaaaggtggcagggttttggaggaaaggcagacctgacagtttcccttcgtccacgctcaccttccaggatcctgggtgaggccccagttgaaacgggaaaggttcgcctgtccccctcgcagggtgtgtgacatggggagtggctcgtttcttcactgcctcactgctcatgcttctaggggagcatacagatgggcaggctatggggttccaaccccatggcagtgtctaggggtgaatgtttacagctcctgaagccccagtgggcgtgtgtgatacagggtgctctcttagtttgctgtctaccggaggcttgtgttaagcagctcaagtagactctctaccttgtcgcaaggacagatctttctgtatcccgggttcttgccttggtgtactggaataatcagatcacacgtgagcttggagaatgagtgcaaagttttactgaatggaagtagctctcagccaatgggggagccagaagggagatggttttcccccagagttgggctgctgggtggccccagctttcctccaactgccgggtcaaactctgcctcgtcccgccggtagatggcctgcaggcctgccactattagttggtgtgctcttctgccagagtgctccctcatgccctcttgccatccagccacttgtgtcttcttccgccgatgtgctcctcttgacgtctggccgcctgtgtgtctgcccactagggtctcaggcttttacaggcccaggatgggaatgtggtcttggaaaatgcaacatttgggtgtgaaagtaggagtgctcatgctcacctaggtccgtgagggtggagccccagccagggacctgcctttctctacccggcacttccctgcccccttcatttaaagggtcttcccttcccagcactcctgtatcactgtcatcaagatgttcccagcacaatagggaacttctttctcactcacactacagcagagttggatactgactttctccccaatcaacagacacaagcaaatatttcaactggctcacacttaatataaatttacaacagtatcaccagacatttacaaaatttttgcaacacaacagagaaaggcaaaagtgaacagtagaaaaataaaataatcccaagataattgaaggaaacaattttataataaatactagtactcttagaggaaattgatgaaacattgtacatatttataaaccaataaaagaaactccaaaagaagaacaaaaatgagctcttaaacatttaatttattatatttataacttatagttttaaaatgtattaggtttgttaagaacttagatattttagtagaaattttaaaagaaaaagaagggttcaaggaatacaggaagtctataagatctgttctatttttaaaaaagctggaagaaaaagtaggattaggtcaagagttctagagtatccgggtagcaagaaaaccagaaaagattaaatggaggggaaggacgtttacaaatatataaaataacatccctgagagatcttctgattgaaagggtctaccaagtgctgagccaggttgcaggaggtggggatgggcggggaaagcttatagtggatctactatacgatttaagaaaatgaaggataaataaaagtttcagagaaaaacgcacatacataccaaaacatactcagtctccctgtgactcctcaacaaactaagtgtaaaatcataaaacaatgttccttattactttgagaaaagttttctgcaaactagttatttaaacattcaaactattaatcatgtgagtataaaatacattgtcagatgcacaagggctcagaaagtgtctcaaatctttgctagaaagttaatttttgtaaccacgtatccaagaggagaaggtccttgactagcaataggtttgggactagcatgaggccaaaggtgcaagttcagagcctttttgtgtgtgttttgattttgtttttccattatgggattttttgcatttatttttactttttaaaaaattaccttataaaatgttatttatcttaaaattgagtgttttggtgccccgttaacttttatgtccacacatctgcctcgctagtctcatctcagtcctgtccttaactagtgtatgagtttcctatggctgccataacaaactggatggctgaaaaacagaagtttattctgatagttgtggaggccagaagtctcaaatcaaagtgtcaggagggaccacagtggccctgaaggccatgagaactcaggccttgccttctcaggcttctgttggccccataagttatttggcttgtggctgcttcactccaatctcagtctccataatcacactaccttctcctcctctgggtgtcttcccctctgtatgtccatctcaaaattcccatctgtgtgtctcactggatttagagcccaccatgatagcccagaatgatcatctcatctcaagatccttaattacaaaaatcctttaaaagaaataaggtaacatttacaggttctggggagtaggatgtaaatgtatttttttggtggtggggacaatattcagcccatcagaagcagcaagcagtggatgcaaaatcaggaaataataaaggaacattccagaaagatacctgtgcagctgacctaaagagtatctagtccagactaaagcagaagagaatctaggaggcagatctccagggaaaaaaaaagatttggtagaatcagtgggatgtttgagggagcaaatgaggcgattataaaggcaaatttttttaagtaagaaatgccaagtgtatctatggcagaaggtagatggaaaaatggaaaggagagctaaaagcagtggacaaggacagcagtctcttcttgctgtgtataaaatgaaagattatctaatcttgatagaaggaaaaacaaagagctgcaacaattgtattacttacaagggtttttaatggtcaccaatatagataatccaaatagcaatatactaagcgaagcaaatcgtggcaaaagtgaaccaaatcctcagctatcatactaagaagtcagtaaataatgtctaaagttgaaaaacttaaggaagaaatacactatgtagagacgtgaaagaagctgcaagtaaagttttaaaagttttcgatagagagtgaaactattgtatgcaagtttatttcctttggtgttttaaatgtgcactaatacataaaaataaaagaacttgtaacactttcttcagttgcatgccttgggaatgtcttttaatgaatcttggggtgtctttaataaatagaattttttaattttttgcattgtcttataatgcctatttcactattaaactctgtgaaccgttaacatttttttccaggcattggctgatacattattaaaatgcagtgaaatgaaataacataaaaataaagacattctaaatccaaacaattttaaaatcatactcaatagaccctttccccatcaaattgttgttaaagtttctaaaagcttcctttagatacatatttcccatatctcatactggtaacacaaagctcgcagattttgataattttgagaggcataatttgagtaattgcctagttttttctttttcttttctcgtcattaaagtctttagtagttttgtttttactgtcttgcctgagaaaacctttcctaaaccaaggttgtcaagatattctgttttattatcctctaaaagttttgtcactttattttccacacttaggcatcaaatacacatgggcattgtatatgataggagatagggttgtaattttattttaccttatcaatatccaattgtgccctgctcatcaactgataggatcatacttttcccactgctttccagtgacttaaaaacatatatgacatatcaagagtccattaatgtatgatgtgtttcaggactcagcattctgcatcagtgttctatatgcctagcataaatcaaatgtcaatttaattgttgtgctgagataagttgatgttcttggaaaattatctttcaccttgttcttttcaagtgtatgttggcttctgatggccctttgcatatccataaatctttttttttatactttaagttctgggatacatgtgcagaacatgcaggtttgttacataggtacacacgtgccatggtggcttgctgcacccatcatcctgtcatctacgttaggtatttctcctaatcctatccctccccaagtggcgcataccccaacaggccccagtgtttgacgttcccctccctgtgtccatgtgtactaattgttcaactcccatttaggagtgagaacatgcagtgtttgatttcctgttcctgtgttagtttgctgagaatgatagtttccaacttcatccacgtccctgcaaggacatgaactcatccttttttatggctatatagtattccatggtatatatgtgttgcattttctttatccagcttatcattgattaacatttgggttagttccaagtctttgctattgtgaatggtgccataataaacatacatgcacatgtgtctttatagtagaatgatttataatcctttgggtatatatccagtaatgggattgctgggccaaatggtatttctagttctagatccttgaggaatcaccacactgtcttccacaatggttgaactaatttacactcccaccaacagtgtaaaagcattcctatttcttcatatcctctccagcatctgttgcttcctggcttcttaataattgccattctaactggcatgagatggtatctatttgtggttttgatttgcatttctctaatggcatgtccataaatctttagttgactttgatgctttctccattaaacatgttaagattttgattgaaatgcattcaattataaatttggaaagagaaattgacatctttacagttttgggatttccaatctatggatataatttactacttcatcgtggccttttatacctttattttaagtgttattaattaaccatcaaggtttttcatagctttctgcaggttcatttctagtacatcatatttatttttgcctgactctttacatagtatttttagttgaatttcatctgtttttcctttatatgagattcaatagatatgtagttatacaaattgacacaacccaggaatctagctcaattctgtgcaattctaataccttagcttgacattcttttgaactttacagttttgagattaataaaatttatgattgtcttgtaaaaaattattaattccagtttttagatatctttcaaaatatatagtctctagaggtatagggaagaaaaagtaatattttcctcatcatagcaagggtcatggctgtgacttctattaataaaagataataagagaaaggcattcacatttacttaatctaagttttatatgacacaggaacctttagaactgaagaccccccaaagcagggaaaactgtgtatatttatgcttacgtttgatgaaaattggataattatacagaagaattacaactggaagaaaaaggagtataagctaatggtaagaaatgggagaacttagcaagtcctgtttattcaggttctttctggtgtccttgtgtgatattacttccctccaagtgtgaggcagaccacctgtcacgtgaaggtcttcaggggagaagggaggaggaaggtcagagacctttctgcttttgctgttttctcaatttccaagctgccatactttggagtagcatttcttgtaccccatgagagggaaatataaggagagaagtcttaggtggtgaaaagattgggattgtaagagtggaaagatatgatttctttcttccctcatcattagagttatgtatgacatttctacacaaaagacagattaacaagaaaaaaagcagaacaaatttatttcatcaaagtttttattaaataaagacttaaagacccagggaaagtgtctatttttatgttcaggttggatgaataatgctcagccatgtagaaatacaactggacaaaaggatctgatctaatgataataggttgagaaaggaaacctagcagagcctggctgtttgaattcttcttggtttcattgtgttgcattccttccccgcaacccctgcaacttccttgcaggcaaaggaagtcatagaattattttatggccagttatcacacagaatagtgcgggaagatcagagtgactttcttccttctgagcctctcccaatctatttcagttcaaggtactttgggatagcattctccgagctccaacaggatccaccaaactgctatctgagcttgattacaagtcatcatagacagttgaattttatagtcaacgtgtgttgaatacttctatgcaagtgtcattgtgaccgctgaaagggagtttctcacttagaggagctaacatagtatcaagatgagtaaaaagagtgcctctaacattgtattaatatatatagtattaatatttcatagtctgccatccacttcatcctccagtctgatcagtaacagaagttattgatcatttttcaaaacagcatgggaaattcattttatttatctcttataaagcttaataaacagctatagagatctttatgaagaggactttgtctcttgaaggacaatattctattttagtcttaaaagcattaaatttttcaatttttaaacaaaattctcatcaattggatgttatacccatctatttatatgtgagaagaacaaagcttatattactttgttttttttatactaccagggcatattttaaagtttgaatgtttaaacatacttggtcagttgaagagaatgactttcttcattactgattgaatatacagggagaaattttagcaagaagaatgtatgacttttttaaagaaaataatttctgaatgataaaaaggaccattttcccataaagacagtcaaggtaaaatacaattgagtagaactaagaaaggaaacaacctcttcagttaatgcattttcagagctaagcacaaaggtgcttcctaaacaaaaggatctttacaaatgagggtgctctttagagagaatattttcaaaggacccctatatagttcaacaggctccttcaaatgcagtgcattttaaaagcttagaaagtaatgatatgccctctagactgccaggcaggagttttattgtgaaggttttggcaacacagttcggtttgtagcatccgctttgaactagcctttcatgattctgagacacgtgcttataataataagtatttacaagtcaggagatgaaattcaagtttctatttttatttcccccatcctctcatctcctacattttatatattggacctaccctaagattgcttctgactctgcacactctagtgtcccaaatttattcctaaactctgcctctatcctaacttcttgcatacatactcaccctttctagccaaggacttgcattcaatcccaaatacgctgacctctggaatctcagcctttctccatgtgcatctttcttcctccatgtgtattcacttgaggacctttcatgcttgtgactggctgaacctggatcaattgctctgctcctgcttggctttattccaacctctcttgttcctctctaggttagtgtacaagaaaaatcagcatatccccaataatctgttaagtgagttgtgaatttgagaagttaaggggaatgtattccccattatactcttcgtataaacattttaattttaaaatctgacactctacctagaagaaatgggtggcagatttgcccagcaaggtaaatcatcactatttgttatatcatgtatactgttgaaaggcctaaatgtctttggacagatggtgccctgttagagtaaaggaagctaaaaacaagagatcatactgattcccagtgtgttagatgtttctaaaagtatgtgtatgtcataatgaaaaacagacctaaactaccaatactttcagaggaagcatagtcttagactctatttatcatttaagtgaataataattatacaagaaattcaatttatataagctgtcaattagaatgagttggacattcctacttgttctttttacagcaactgctcttaaaagtggtttaacaccgatttaaactccttgaatacagtaagcatatgtttatccagaactaaaaataatttatactactactcttttttttttttttttttttttttttttttttttttttacaacacaaaggttgaagtacataaaaatgctattgctttacacaaggcagcaaagttttaatcttggcatccacaggtgtgtaatgtgacttgagacctaacaacaccctctaattctttctgaatccttataaaaagtaagttatgtccatgatgttgatagtattattttttctgtaaaagacattgtagtgtttaaaacagatttctggtacagtccttgttctcaagcatttggtaaatagtctgacttaacaagagtcctcatgtctaatccctctaaatacaggcttatacttcactgtatatacaagtgtatatgtgtatgtattatatatagtgtgtatatatagtatatatgtgtgtgtatgtacacacacacttgtaaatacaagtaggtacaagtttatacttcactgtgccttacagggcaatacatacttcataaattgatgcataatgattgtgcatatttatggggtacatatcatattttgatatatttatacaatgtggaggaatgatcaaattggggtatttaggatatccatcacctcaaatgtttaccatttctttgtgttgggggcattttgactcttctaactttaatgtagtctcatgcattttgaaatatacaataaattacatgtttactaccacacactagaatttattccaactgcatatttgtacctattgactaacctctcttcatcctcctcctccacccttcctagactctcgtaactgtcattctagtgtataagtccatgagatcaactttttttgctcccacatgtaattgagatcatgcaatatctgtttctgtgcctgccttatttgacttaacatagcgacctccatttctgtgttgctgcaaataacagaatttcttttttatagtgaatgatattctattttgtatttttataccacattttctttatccatttactcgatgggtacttagattcctatcttggctattgtgaatagttctgcaataaacatagggggtgaaggtatctctttgatgtaccgattccctctccattggataaatacctagtggtgggattgctggattgtatgatatttctacttttagtcttttgagaaacttctgtactgttttccataatgtctgtactgatttgcattcccatgaacagtatatacgggttcaatttttctctacatgtttgccagcagttgttattttttgtctttttgttaatagccattctgactgaggtgagaagatcttctcattgtggttctcattgtgatgactgatgatgttgatattgaaaattttttaaatatgttttggccatttgtatgtcttcttttgagaaatgtctattcagatcgtttacccactttttaatagtgatatggctatgttgcttgggatatgtaccctggggttcatcgtctcatgctgagaaagaactcaggacccagacacatgtgagtgggttaagaagtagaaaatttaatagaataaaggagagaggagagcaggtcctagggaggtggagggggagagagagagagaagagaaggggggagagagagagagagacagagagagagagacatgtccaaaaaagtggggaggtggttgactgcagcagattttataggaaggctggagaaggtggtgtctgatttacatagggctcacagattggttgatcaggcacgaggtttacatagtgcacagggaagactggtcaccccaacctagaatgtaaatggactttccagttaatcgacaccatcttgattcctgttgattgacaccagtaagattggcaccatttgctctttactgtgcacatggctgacaaagagaagggaagatggagctgctatctttaacatgtgtagtccctagttactgctggcattcacctgtgcaagctcccagtttgcttgtctgtctgcagctctactttataggctgctctttgttagaaaatgatttggggctgcttttcattaaagagaaaagcattaccaaagactcccatgcccttactctctgcttaagtaatttcttaagtcctatatcattccaccctctgcagtggtaaccctaactgctgttagagaatgttggatgacaactttttctggctacttcctgctgaaaggggtatcatgtggggaaaagcagctagggctcctcctggggtcaatctaagggtcctcagaagaaaggtgtgtccatgtttgtttggtctgcagcaccatttgcagtttgattgctctcaatcattctaatgggttgtgatactggtttgcctccaccagatgctgctaaatattaatataaaagtaacattcttttttgaataagtggcattggatttgggtggctagagtaactttagtattgaccttggctaaatctttcctgcaattattaatcccctcatgacttctgcagaccatctaaggcatgtttaaactttctaacttctcctaagcatccttctttttaaacaaccaactattatttttaggacaagtatttaccatctttataatcctttcatacttcctttttggtgaaactattatccctgctataaggataataattaagcaaaatactacagcaatggaaactctgtgtccactattccagttagaaggtgctactgtttatagccctactgcaaatagcagagtgagtatagcaaatcttgcaagtgtggtgtagtaggtactttccacataaaatcttacttgtcaagatacagaatttatctttgggggtctatgaagttccttggttttattttcctaaacaaaactccaggttatgggcatcctatttactttcactgcttggcaggatttgcaggataattgctcagaactagcatattaatccagatttttgtgttacccatccctttttgtttcttccaagctgcaggaaatcaccatttgattacaggaataagcaggattagtctaaaatgtaggcaaaaaaacttaaaaacaattagtgagacaaggatttaatgacatgtatgatatgctttggagcataacttttatctctccagtcctcatttttggtaaaaaaacaaattatgataggaccatgttgtttgtagaaaaaactttaaccttatacttggcctgattatttggaataaagttcagcaagaatggttatttctacatagctcttttggattggcttagatggaactcagttccacaaggaatcttagataggaccttttaaagctgagcccggccataggtttatattctctaatacctgtgagttgggtgatccttttctcttaatgttccaagataaacttggagttcgtggacctgttagaaagtgacattctttactgaccacaggttaggaaccctgtgtggggactgtgtagacaaggtatgaggccagtcttccccaaggggcttttatcagctctgcaagtcgagattgactccttaaagggaagcatatacttccagtcaaagccttgataaaataaccagttttccaattgtgtcccattgcaaaagaaaaatggattattattgcgatgatgcaaacaactatattgccataagttaagagtactcacagatagtttccaatttctagaggaactaggcagagagaaacatgctccaaattttgttcacagaagtataccttactcaattattaaaagctttaaaaagttaaaagtatgtttccttgagtctaaaaaacaaaacaaggatcagaaatacttcaagcaaaatattccaaaaaggttgctttaactttctgagtacagtccattagttaactcttgttttgtttgacacataaacatttcagttcttcataagtcccatacattctttctctattccaatgttacaatcttcaaaactattgaaaacctgcatttgcaatcacctgttaaggtccttaatatggcttgatgataaaccacattttgagaaggaacaaagcaaggtgacaattgtctgcaaatggtgacaaagtttccagggtagttagttaaaaacatgactaagaagtttagttatctccatggtttacaataattttacccttaattatgattgatagcatatactcagacattagaattttagaaatcccatgcactgttggaacatatcttagtattattcactaaaatataacttaaattgtacatcattttggcaatcccatgcaactaaacatgtcaaataatcctgtttacctcttttctgaaagtttcaggggccttctgagccatccagaaatcccagctcagggaagataatttggatactagaagtttgatttttgggatgcctgttaaatgttagagatttaaaacacttgatgttatgaaatagaatcccagattaccataaattatttattttgccaaaatgatgactcaaaaagcaaaaatcttttattagcctttactattgcatgaaaatcctgttaaaagccaaatttttacccttgcattagtttattaatgttaaccccaatgtttaatgaaacctcagacaatttcatataatcttaaccaagttgaacatgaggtgaaatctgtacaagccttttataactgcttttgctaaagaggaggttagtgtcttaagacagtcttgctgtgcttttatttcaatgctcaatttataaaaagaccatataataccctttgaatttagttaatgtttacacatttttgcaagattaatttttacaatcttttcacaacttaaatgtgtttagctttattatatcaaatttaagataatccctcatccctgggcaaaatttacatttccatgctttcttataatcttttactaaaagacaccttgcaaataaaactgtttagtgatttcaaacacatgttgcactgttaactctttgcaacttttaatgaaaaacctggttagtaagcaactttatgtatcaggtgtggagcctaggaaccagacagaattgcagagtaggtctgactccacatgtcccaggccttacctatctgtaaagcatgcagtatacaaccttggaacatttagcaagcctagtatctaagtggtatgattaagaccacctttttgcattttgacgacacttgcattttgccaataatccttaaggctatttttatttcttaaagattatagtcatgtgagctaaaaaatattttaagtgcttatttttctttaatcaattagagctctttttgtagacattacgcataacacatatatagcaacacagaattcagaactagtatgatttttcatttgccagtttcttattgggattattggcttcagggcggagcccttggaggaacagggccaggaaggcatgcatttctagggcataaaaaacaggcacagctgaaggcaaagacagaccccccaaaaatattggtgccgttttataatggattttggatccccaaaaggagggagagcctatgggagaagagagtatggtaattttaccatgcatttcattgcaaggcaacccaaatccattcagcttattttgtaatcagcccaacccccacatgattcttatctcttgggggagtggggaagtttgtatgtttcaggtgaccaagagtatgcttctctgattcaaaagtgcaaagagttaactatccttccgtaactacgattagacatcccttaaagtatgttttctctctagttattccccacactaaagctctatcatgatgcgaggtaatttggtacctctaaaactcaaaactgtcagataacacaatgaaaaacagcaaagcctttggttttgagagggaattatctgcttttaattcctggggttttgtgagaaaaacaggttttttctcaaaagagagtttgtggtgtcacctctgtttttttcccaaggagttccaggctaccagaagttgtcttagggcctctcatgtgtacattaagagtggcaagacaaaaaatggagaaaaatgattcagttgactgagaagaaaaggctttttctaggaaagcaagattcaagaagagacaaacataaaggccttttaaaaaaaatctagaacttggatatctgctttgaattaagctgagcactctttaagaaaattattttaaatctcttgttactcaactttagccacgctaagcagttaagattttcagcttttgaactttataaaaagtaacctcacaggtgaaaccaacaagcctgagttagtttgtgacttaaccatgagtgtacaaggtattttcaaagtggtggtaagcagcttttgaaactgtcattgcaaaattgtgactgagacagtaaaggagatctgacccaaacaactccattttgtttccagcccctaagctatccttgcccatccctgagtgtaggctgaaccaactttgggaggagcctggtttacagtttatagtccaaaacaaagataatagccccttctgaagatatacttccctcttgtctggggaccagaccaagaaactagccacaagatcaggaaccatggctcaggagtcacgcagctgaaggctacaaaattttgaccctcccttaactgctctcaagatcagagcttaaggtattttgtaaacactgtcattgatagatcagctggtaccacctagatcaacaaactaacttatctgattttctggccctcacccaggaactgacttagcacaggaagatacccaccactgtaaaatggtggagactaaaagtattgccacgtggttacaggtattgctcccaaagacatgaaacaatatggaagcctgtagccaagtttgttatagactgttttgttgggctggcatgaacaggaggcttatgggatcctgggtctgcatcctagcctaacatatgttttcttttgacagaaagacacacaaagcacaccagatttgctacagcttaagactaacctcacaaatcccttttcattaatttaaactttacagataatataaacaatgatccttgttacctcttttaccagtttgcatgggaagagagaggccaaaagcctgaatggtaagaaatttctacccttttgctggcatgtcaggcttctgggttcccttccccctagctcaactagagaagcattttaaggtttggaaaattaacatttcccaggttggaagaacattataaaaaaagatagccattttataccgtaaaagaaggaaccacaccatacaaaagtctgggatatcagagttgtcaaagaggtactgcttcctttcctatcaacagtggtgtttcccctatttcttcaccttcccgattttctcttttccctttttgcctgttataggagacatattgctcatctccaaaattctctgctgcctgcagaattgcctgtttttcacctacagttggggttaagctttggagcagcataacatccctccatgagaagtcaaatatctgagttaaattttagaaagcttctatatacctatcagggtcattagaaaattggcctaagtctccctttacttgcctaaggtcctgcaatgagaatggaagttgaaccctcgtggcatcacctccattggacattttctgcagggttaagagctaaggtggcggaatgggaaattttggagatggtggagatggaggagctggtggtgtggttggagctggccccagataatggggaatgaaagggccaggatgctcaatggctgcctcaaatggttcccccaggagttgcttttctaattttggggaattctctctgtgcctgtctgatatgattgctaaaagagccgggctgattttgcaatgcttgcaaaggtctagcaaaaaggcaatgcccttatgtagaagaaaacaagccactttttctttaaaatctcagggtgaaaggagttccagtgcttcagaatgcaccccaggggagtgcatgctgaagatgatacccatctagaaagagaagtgagaaaaaggcatctgtttagtctccttccttttggtgtgacccagagtggaaaggaagacagtggaggcgttccccctgctgttttttgtgttttgttttttttttgtttttttcctaaatggttcctgggtcctggcatcaccaaccgtggctgcaggcatgaccctcagccatagaaccagaggaactaagccattggggttagtaatgctcacccaagtggctctagtcctctgcttgtgattttgctttgacttcctggacttgtgtaacctgcctgactcctcaaaaaatgtatctcaggagagattatgtgacagttgcatttaagcatctgttgcactttcctccttgatggaggaagtgtgctgatttgagctctatatcctgctagtatggttcgtgttaaagcatctacccttagagaatggttccagttaacttccaaacttaaaatacccttactaattaagtactattctaaatggaagcagaatacgtgccttaaaagaaagtaggtatcaaatggccattttcctgctgatgggatagtattgacactaaaatctggctttggaggatattttgctcttaattgttgaaggtagagttttcccatttgcagaagcaacataaagcctggtctctagaagaggggtgcaataagggcaaagaattgggaagccagggtgttttgataaaggactgacaatgtgcctcatggagagagtacctattccactagttggtgctgttgaccttgaaatgccatgaactctccagaccaagggcagagagtgatgctcactgtggggggtgcgagggtgggggcctctgttcctagaaaatcccaaagatgcctacctttgagctatatccacagttactacaacattcccagatctttccaaacaagattatttccctgaattgtaaaacttcctacacattgcatacatagagagattaagagatgtgatggtcatggacgagaaaggaggaaattatgataggaaagttggagatcctgttgccaacaccccaccagggtggtcagaggccgaggtcagtccataagcctttgggtaacactcaggggtagccccagccagaagttctcagttgccccaggacttcttccagccccatacaatggctacgtcttccatgaaaggaggctggttcaaacatggcccatatgccatatgcccagaaacccataggtattgggggattctccatgttctctccagtaggtgtgacatccgagtctttaagaatggcaggcatgctaatggtatttttaaatggctggcagatgcctgttattgatttaatttgattttaaaatggaggctgaggcaaccattccagttgattctattccattctattccattccattccattccattccattccattccagttgattcaattccattctattccattctattccattccattccattccattcgggttgattcaattccaattaaaggacagattttgaggtttttctccatatttaccactcacatgattctaccttctgatccctttcttttagaaagaagtcaggacacagacacatgtgggtgggttagggagtggaaagtttaatagaagaaaggagagaggagctcttgtgtgtgagagacctctgataaagaggtgtggtggcagactgcagcagattttataggcaggttggagaaggtggtgtctgatttatgtaggacccacagattggtttgatcacatatgatgtttacatagcccatggggaaggattgtcaccccaccctaatcttatgcaaatggactttccggttgattggcaccatcttgtctgttctttattgtacaagtggctgacaaagagaagggaagatggagccaccaccttgaacatgtctagtcctagttcctgctggcattcacttctgcaagctcccagcttgcttgtctttgaggctcaactttacaggctatttattagaaaatgatttgaagctgctttttattaaagagaaaagccttactgaagactcccatacccttaccatctgcttaagttatttcttaactcctttatcagtagtatttgttttttggctgttgagttgtttcagttctttgtatattctagatatgaatccctagtcagatgaatattttacaaatattttctctcattctgcatgttgtgtcttcactctgttgattgcttcctttggtgtgcagaagctttttagcttaatgtagtctcatgtatctattttggttttgttgcctgtattataaagtcttggccataaaatctttgcctagaccaatttcctgaagcatttctcatattttcttccagtagttctatgtttttgagtcttatgtttaactctttaaccattttgagttgatttttgtatgtggcaagagatacgggtgtagtttcattcttctgcctgtgagcacttagttttccctgcatcattattgaagagggtattctttctccaaggtattctctttgtgccttttttaaaaaatcagttggctgtaaataggaggattaatttctcggttttctattaatctatatttctgggttttatattgtgccattggtctatgtgttttattctaataccatactgttttggttattatagctttgtagtatatgttaggtagtatgatgcttctagctttttccattttgctcagtattgctttggctattcagaatcttttgtgtttccacataaattttagtttttttttatatttctcttgagaacgtcgttggtattttgatggggattgcattatgtctcttgaatctgtagtactatggtggcattgggaaggatggctattttaaaatattgattccttcaatctttgagcatgtgatgtgtttacgtttgcttgtgtcttcaatttctttcatcattttttttgtagttgtagaagtcttttgcatccttggttaaatttattactaggtggtgttttggtagctattataaatgagatcacgtccttcatttttaaaatctagtttgttattggtatataggagtgctgctttttgtatgttgtttttgtatattacaagtttactgaatttatcagttctgagttttttggtggagtctttaggtttttctatacataagataatgttgtctgcaaagagggatgattgttctttctttttccaatttggatgccttttatttctttcttgcttgattgctgtgctagcacttccagtactatgctgaataaatgtggtgaaagtgggcatccttgtcttttagttgttaaaggaaaggctttcaactttttttccattaagtacgatgttagctgtgttgtgggtttgtcatatatatggtctttctttattattttgaaataccttctttttattgttgagagtttttgtcatgaagaggtattgaattttatctttttgatgcctgttgagaagatcatatgatttttgtccctcttctattgatgtggtgtatctcatgtattgatttatgtacatggaaccatccttgcatccctgagacaaatcccccttaatcatgatgtattatcttttcaatgtgttgttggattaagtttgctaatattttgttaaggttttttgcatctgtattgatcagaaaaaatggcctgtaggtttttgtgtttttttaaaatctttgtctggtgttggtatcagggtaattctggccttgtagaatgagttaggaataactgtctcctctttaatctttgtaatagtttgagaataatctgtgttagttcttcatacatttgataaaatgcagaattaaagccattcagtcctgaacttttctttattgggacgcacctgatttctgattcaattttattattcattattaatttgttaggttttctatttctgtctagatcagtcttagtaggttgtatgcgtttaggaatgtttcctctagattttctaatttgtttgcatagagttattaatagtctctaatgatcctttctatttctgttgtatcagttgtaattccttctttttcatttctaacttatgtgggtcttctctttttcttggttaatctagctagcagtttaaaaattttaccttctcagaaaaacaagtttttgttttattggttcttggcaatgtttttcatttagtctgtttttagttctctaatttttgttatttcatttcttctgctaattttgttctgttttcttattttttctagttccttaaggtgcattgataggttgtgtatttgaaatctgtccacttttatgatgtcatttattgctataaacttccttctagcactgcttttgctacattccattggttttggcatactgtttttcgttcttattttttccaagacattttatttccttaatttcttcattgatgcaatagttgctcaggaccatgttatttaatttccatgtagttgtacagttttcaatattctttctattaaatattgttcaataatgttattgaatcaatatagaataaaacttgtcttattctattgctatatcctcctgctaatatgatttatttttcaatatatgaccttgtctcttcagtttttcatttaaattgttttctataggtacagttacttttttttttctgcttttggtttccatttacatggaatatctttttttatcccttcactttaaatctatatcggtctttataggtggagttagtttcttatcggtggcatatagctgagtcattgttttaaatgcattcatctagtctacatctcttaattggggaattctgcttacattcaagcttattaataagtgaggacttactcttgtcattttgttagttttctgggtgttttatataccatttgttattttcttatggtttatcatcatggtttggtgattttcagaatggtaacacttgattcctttctctttctcatttgtgtatctagtctaccagtgagttttatactttcatgtatttccatgatggtagatattatcctttcacttctggatgtaggactattttaaacattttttgtaggaaccagtctattggtgacaaattgcttcagcttttgcttgtctgggaaagactttatttttccttcatttttgaaagatacctttgctgggtctagtatttttggctaaaaggtacttgttttataaagcattttgaatatgtcattccattttctcctgacctgcatgatttctgctgagaagtccactgttagtctgatggaggttcccttttatgtgacttgatgctttttctcttgctgtttttagaattctgtcattgtctctgacagtttgacaataatgtggcttggagaagacatttttgaattgaacctatttggggatctttgagcttcatctatctagatgtctatatgtttttcaagacttgggaagtttttagctatttttattaaataggttttctatgcctttgcccatctcttctcctttgggaaattccagaattcatttaaaattttggtcattttatggcatcctactggtcacataggctttcttcattcattccttttttttttcttctgcctgcattattagaaaaattattttgcttagcctattgacacttgtatttttttatttctttgatttcttcagttctaggacttttggtgctcttaacatatctgtttcttttttgaatttctcatctagagcataaattgtttctctgatttatttgtattgttggtgttttcttatatttcactgaatttctcatcataaaatttctaataaggaattcaagataaagttcctgttttggggatctgttattgaagaattattttgttcttttggaggcatcatgtttcctttttttgtttcttgtgtccttatgttaatatctgcacatctggtgtaatagctgcttcttccaattttatggataggcctttgtaaggaaagatattttcctacagatgtattatagtattggttaagtaagttgctttggctttgattttggatgggtatagcagtgtagtctttgtatgacttcagttatattcagtgtcagcgatatctggaagtacctaagtggcttagactgcaattgttaatggaggttgtggtaagactttgatgggggtgggaacatcagctgggttagttcttgtgcaccagtttggcagcagtacaaatgttgggtctgacctcaggcctctggatggtgtgtgcaggcaccagcagtggtaggtaggttgaacttatactctgccctgtacaatttgtatgggtgctggcagcagtggtgatgggtgggatggaacccccagtggtatatgtagctgctggctgtgatggatggggccaggtccccggacagtacattcacatgcaggtggcagtggcaatgggaaaggctggctggttctcaagccgcataaaacacatgtgggcaatagcagttgcagtggtgtgtgaggcaggcctgttctcaggcaccactggtggtggtgggtgcactggacctgttagacctccatatggtgcctttggagggcagggaagattaatccccagatgccaggttgcttgcacgaaggttgcttgcacgaaggttgcttgcacaaaggctacacatagcagcttcttcctctggtacctaatgagatgttgcatagggcaaccatcagtatcagatagggtctgtcaatacccaggcctcgaacaatgtgtatggcaaggcaagctttgcaatacataatttttaagtgacttaatatcaggctatatcttaagatttatatgtctttaatagagtagagaaaacaaaaatttggaaaacatttccttactgagtggtagaagtagcagactagtctttggctgatccagagagactgcagaggaagtttcttttctttttaaaaatgttttaaagacagagtctcactttgttgctcaggctgccctctgactcctgacttcaggtgatcctcttgcttcagcctcccaaaatgctgggattacaggcatgagccactgcacctggccccctgcagaggaactttctaatacaattagaggtgtttttctttgttaaaaaataaaaatccaaatactttctgagttgaaaggaagctactctaattggccaaagattatttataactgtgtctgtgaggctagttaggctaggaaaaaaacctgaaaagggtgagtaggaaaaacaataaggcaaaggagaatgcagtgaggtggaaaagctgtatttagagccccaaaccattcgtatgaagttttgtatcttttttttttttaaggtggagttttactcttgttgcccaggctggagttcaatggtgggatcttgtctccctgcaacctccccctcccaggttccagtaattctcctgcctcagcctcccgagtagttgggaggtgcctgccaccacgcccagctaattctttatatttttagtagagatgaggtttcactatgttggccaggctggtctcgaactcctgaccttaggcaatctacccacctcagcctcccaaaatgctgggattacaggcgtgagccaccgtggccagccttatgtgtgttttattaatgtttgaaataaaacaggaactattacaaactcacatgaaatgttcttgtgatgcttaatacatatagacatatttctaaagattttcttctgaaattagaagccatctaatccgtggctacttgagacttccattaatttatacacattcagcggagctaacattcttatgatccatgaagttgtttatgttgtcctgcattgaactgcttcagattgctatagtttgaagtttgggaatttggggagtaatatactcctcattttataaaaaggaaataaacttcatcaaaggtaagagaatttttgttttgtggcatgatatattattgctcatgggtatacatgtaacaaggaagcatgaaaatgagaaggtgaaaaaaagggaagatctgtgacttgcttaatattgcacacctacaattgggcaaaatcaaaattgaaaaccaggtcagtctcatatcaagtcacatgttcataatcatgataggctctatccagtaatttcagcaattgtacccaaatacctaaagttaattccactttccaaatacttgtatggagcccatctggcacccatgaatcagtattttagaagttctctcaaatggctcggtgtccaagtgctaggttggttactacaaaaagcccagcataattgatttctgaacaattgccaggaaataaacaccaatctattaatgcagcttgatttctgatactttgttttatctgttaataactagcaatataataataatgcctattataattgaatcacttacaggattaatgtcaagtttggctagtttgttgttgggtgtggatattttaagctctaattgttcttcagttacatcattttttccacttgacggggaactctgtaagggcagagatggtagttcttcactttgaatcactaatggctatcaaaattttaagacgtagtagttgtcaacaaacatttgctgaactagtttaaataatttttctaaattatacttttattatgataaatagtgatagtattcactttcttgtggtgttcagtgaattaatgaaattagttactgcagagttcctagtgagaaaaggcatccatgggtcctactcaataagtaccttcagcaaaatctgttctgaaagtcaaagtgttccccagctaatactgtgatgaaaatgcctgcagaatcaaatgcaatatgacattcaatgttttaaatgagtcattaaacaaagaatattccaatattgtgaatcttctgtgaagtttttacagactgatggaatagaaaagatagtattctatttttacaacaagaaatactgggagatgcactacaaaatgacatttccagtgagatttgagcagcatcttatctttcaatgtgttctttattcattgattcagggtatcattcctggggtatataggtgaatatgacgatgataatatgtctggcagtacatagattgctatccttctcagttgaaaatggtgttgacggtgaggttagatgcagataaaaaataatctttgtgtgatagcattttcaacaccaaacagatgttgcatacttatgaatcagtgacttctcataagtagcaaaatgtacattgtgttaacgtatcaccttgttttcataagtacaattggttcctgagaggctgcagagtatagtagagtaaaagcaagagaagttttcttttttctccctgatgtatcagttattgttgcacagcaaactaccttagacgctgtggcttaaaacatctatttattttattcataattcactgggtaattctactggtctgggccagctggactggtataattatgcacctactataagctggcgtattggcagggtgcatcattgacaatagccttgttagagagataggagcctttcttcaggtagtctcatcctctggcaggctagcttggaattgtttgcattgaaatcccatggagattgcagggttccaagagtgagagtctcagtgtgcaaggtctgtctcttgagtcctgggctggaactttcaatgtggcttctgctacattctactggtcaaaacccatctcaaattcagctgaggcttaagaattatagaagtacactcttccctatgatgagagtggaagaggttactaccatttttagaatttgccacagcttctattgtaattctcaaaccaccctcttcaagaagtcatgtcttttagtgataaccataaccacaactacaacagtaacaacagctcacacgtatggaggacttaattgtaacaaagcctattctaatgttttatatggattaactcaattttcacaataacaatgaaggatgagtattagtttttctttatgggtgaaaaaaaaattgcctcacaaaggggttaatcattttacaaaacattaaaaatttccaaaagaagattgccttagtcaaataaatgcagaaaatgcaagacaaaataataattaaaagtctatctatgtttctatccatacaaccatttatcctcttggacttctcaaagttttgaatgcagtaaagtatattttgaatcttacagaagggaaagaaggttataagccacgttcaaatttggaatctaggaaccccttcattttgcagagtatctgttaacatcttacatgacagtggtattctatggaactgtttgtaaaatgctgtaattaggctttaaactagattccaaattgccctgatttgtagcacatgtatctctgtcactgagactataaagaatataaaacatgcaatatgcctgctttttttctctatgtgcttgtctgttcaaaaaatcagtgaccctttagacatgcagaagttaagccagatgtgtctatgaatcacctcaagggttttaagccaagttattttgcattgcattattctattctttttttttttttaaccattcccttcttttttttatcaacatccctctgagcagtaacacagtattactgctctaagggatgacagttggcaaatagtactatagcatggcaataagatacagaatgaaaattatacctgtgtcaaattgcttctgaatcatttacttcaagatagtcaaattaggaagaccacccctgagccatacagatgaggcagtaggttggagaaagttatctctagctctttaggttttagtatctaccgtttaatattgctattgccagagtagcaatctggaggagagttttggaatcaagattaggctacagaaggaatttaaggtgtgtgtttttgtatatatacatatacatgtatatatataactgtacgtaattgacccttgaacaaaacagggttagccatgccaacccccacacaatcaaaaacccatatataactttttactcccagcaattttttttttttgagacaaggtctcactctcttgtccaggctgcagggcagtggcatgaacagggccgactgactgcagcctcagtctcctgagctcaagtggtcctcctgtttcagctttctgagtaatcggaaccacaggtacacatcaccacgccaagccttttttttttttttttttttttttttttttttttttttttaatggagacacagggtctcactgtgttgtctggactggtcttgaactcctgggctgaagtcatcctctagcctcagcctcccaaagtgtaaggattacagacaggcgctactgtagcccagccctgaaaatcttaactactgatagcctattgttgaccagaaaccttgctaataactagcataaacagttgattaacacatactttgcatatttgttatatattgcattcttgcaacagtgtaagccagagtaaagaaaatgttataaagaaaaccataaggaagagaaaatatatttattaaagtactgattaatactgtaggtttatatcatgtgttgacaagatgaataatctgtctgaagtggtgggcaatgcagctgcagaggtcaatctacagtacatatcaaacaattcggccttttcttgtaatgtcatgacttgtctctgcctcttgggaacactttgaacatcactagtggcacttcgtatgggtcccatggtgttattcaaggtttacaatattgcactaaacactatgaaaaatatacaagaactgcaagagatcactttttccatgataaacaatttattgaagagatgaactgctctgtggagatgatgagcatcacacggcattttaagtggatactcacaacacttgaactcactgcagtaacaatgggaggtggctatgaaattatcacagtagtacaatgtgtactacagttaattttatgcatttattagttaatgctgcattctgtttacatttctctctactgtgaacggtgccatgtactgtctgtgcacattttaactgttttatactagatttgtgtatattgtagtaaatgataaaatagactagtacctatatattatatacatttagagtataacttagttttactttatatttaggctacacggtttgtctgcaaggttttcaaattattgcaaatctccaaaaaaagtttccaaaatgtctattgaaaaaaatctctacatataagtggagcctcacaattcacacctaggttgctcaagagtcagttctttatataatttgccttagagaaacaacacattcattcaatccacacactcatggacctctccaggagtttgtaaaagaataggtaatgacctaatattaactaagtaaatgccagcattttatttaatcatcaaaacaacacgatgaaatagatatttttaatcctcatttttacatatgtgatgacgttttgctggggatgcagcaccagatgggccagtccttgggcaccagcatggtggtggtggtgcgaaggctgcacctggactcgggcgtctgggtgatgtgtgtgggtgccagtggtggcatgtagggtagattgataacctggcccctgtacaatgtgtgtgggccaccttgaagaggaagaatcacaatttttacctccaatattttttaaatggcaccactaaaaccaaaacaaatcattaaatgtatttatatcttaccatgtgtcacattctgttaaacactttacattcttcatcttatttagtgtatacaactttagttctcatgatttctttttaacgaaggaagaaactggggcttagagagtacataaattggtcaatatcataccatttgtaaataacagaaaaggtccatgatttaaagccaggccactcatgaccaaaatctgttgttcttcattaaataaaacttcaacttatgaaatagtttcatctacattgtatcgttgaatccttaaaacagctcagctgggtcagaagtatcatcggtttatagacaaaaaaagataagaatcaaaaaagtttggtaatttcccccaaggtcataaagctacaggttttttgttgttgttagtttgttttgtttttgagacggagtcttgctctgtcaccaggctgaagtgcagtggtgcgatctccgcttactgcaacctccaactccctggttcaagcgattctcctgcttgaacaggagaattctctcagcctcctgagttgctgggattacaggcatgtgccaccaagcccagctaatttttgtatttttagtagagacggggtttcaccatgttggccaggatgatgtcgatctcctgacctcatgatccacccaccttggcctcccaaagtgctgggattacggacatgacctactgcgcctggccctaaaatttcgttttaaaaaaatatgcctggtgtttcttctagttgtccatatttctttcttatgacaacagataaaatacacaaactttatattttcatcaggatagatttttttcaagtctagcctctgccactaaatgtgtaattttaaacaaatttcttaatctctgtgagcctttgcttcttcatctctcaattaagggtagcaattctagctgcctcacagagctattgcaaagtttacatgaaaatgcatacaaatatgtctagacaagtgcccagtgtgcaggagagactcaatgtataatctctggctttccttctctctgtgcctttcaacgcaaatggaatagtttcaggataaagaatggtcagcttacataaccaagtgaggtgtatattaacagctggcaccaaaagtcatcttaggaactttgtcagaatatcttcataagcctttgtggaagatgtgactctgacagcagagatgtcaacaggagaccaagctataaaaggagaaggttagatggtctagataaaaaaaattatatgaatttttgttttgctcacaaaaaggaaggaaataagagacgaatggagaaggtagggaggagagagaagagccagagaggtaggatgaggtgaggatatatgtgctggacagccaggtaaaattcttccacaggttatagaaagatattttaaaaatgggacatacattgttaatttaaaattgtttacattaccttgatttaaagtctaccaaagaaactactttcagtaaagtctaccacaaatgaatactagaaatgaatgtttcatattctatatggattaccatgacttaaaccagaaatacataactggaagtagaagggaattcaagaatgtaagccaccctcgcattctcagaaatctgggcaacttgaggatctaagacaattttcaagggatctcaagagataggcagtaccagctgacatgtggattttgtgtttagttgaaatatcctctttttatttgaaagtccacttaaattcactgtaccaagaaatcattttaatttcagcatgatttagatacatttgaaggagacaaactgaagatattaccatgcttgaggtttaaggtgatgaaggacttttaggcatatttgaaatataccccttaactgttaacattgacaccagtggtaagaaatttcctccattagataataccggcttgaataaatcagaagcttgctgtgatggatcatttctgtatcttatttgcagttaatagatattatttcttagagcagtttttggttcactataaaaccaggcagaaagtaagagacttcccatacaccccagtccccatacgtgtaaacctcgctcccgtcaacatcccatgctctagtagtgatatttttgttaaaatagatgaacttacattgatacatcattatcacccacattccatagtttacattagtgttcactgttggtgagtctttgtttttacctacaaacttattacattggtagtgttaccatcaagccagtgctcaccaaaatagggtctttacctttttagtgccctgaagctaatatgcaaaattgaaagtgaatgcataggctttatttgatggccatgaaattgagaagcagaagctgggatcacaaacttctcagtctgtaagagccagaacttcacagataaagggcatctttaatgaagtggttgggcattaaaagaaaggagaggaatatttgtcttttctgggaatgggtagagaacttcttgtaaccaattgccacctttctttctgtcactttatggcttcttccggttgtcatgattgtaaactatcatggcagtggtgggagtgtcatttagtatgaatattagattataatatgaagttagaggttcttcagaagtcaagtgagccaccatcttggatcctaccagtcttagccagtttggtcatgagggggaacttttgacctcaggcatcctgtttcctaaagatatgcagagttggttaggtgcagtggctcacgcctgtaatcccagcacttggggaggctgagacaggtggatcatgaggtcaagaaatcaagaccaccctggccaatatggtgaaaccgtatctctactaaacacaaaaattagttagctgggcttggtggcgcgtgcctgtagtcccagctactcgggaggctgaggcaggagaatcgcttgagcgcgggaggtggaggttgcagtgagccgaggtcgcgccactgcactccagcctggtgacagagcgagactgtctcaaaaaaattcagagttaaggtggagtggtactttacctaggtcacataggcattatactgggtaatactagacgcactgcgcctcctgcctctctagcacggtgagatgccccatctgagcatacatctgtagctagattgctgatgactaagtataaaatacaaccatttcccagacatgtgaactgtatggttcactgcaaaactgatatgctccctgtgatattaatacactcactcatatttcacactttgtcaaagagaaagctgcgtatatataaattcaaacatacatacttgattgttttaaaataatgacagcaatattgaaagcacagctattagtttagtaatgaatagcaaaaagaggatgctggaggctttaatggaagaagaaacattattacaactttgtcctcaggatctcgcttttcattacatatcagtctgaaataaatatcagtctaaaataaatcaattccaccatattcttctctttttgcctctggacaggtttttaccagatccgtatataatacttcatatttttaccaactctactgcaaacaggtgtttatcctctttgcgaaatgctgctttaacataggtgcagatttaaagagtttaatgtgattttacgttttcttattatgagggagggatcatccaatcatacacctcatctctcaatctctcctggatacatatgggaaatatttcattcactggtcgtttggtccagggaactgaaactcatcccctttcatgtgttaattcggactgataccacattaaatggctcaggggccttggctctggggttgctgtgaccgctaatgctttgtgttgctaaaacccacacatcaaatgtgatgccttcattttgcagttattccctagcaagtttccctttatgtatgagatttcacaagcttaggtgcctaataagaactagtagaatcacgtgcacacatatacaagttaggaggaagtgtttaggcactatctacctgaatctattgctatgtctaaaaggtcttgttctggatttttgaatcagaattattagtttgatgttgagccttgttccttcatggtagacttttgccaaatgatgtgatttgacatctaaaccactaggaagcatttcataggtgacataccagtagacagcctgtaattctgactaagtgactcaatcaagatttggctttttttttttttcctacaacctcccacccacaaaagtctcaatatcatagattgaactataaatcttgtcatgaaaaacaaaagacaaaatagaaaacaattttataaatgtaaaatggatcactgttagaaaagaaaaaataaaaattggcatggtcaggaaaatacataaatggaaactccctattttggaagggataatgatggagaacactgttccaaaatacaatacataaatccaagggagtgtctcctgccacctgccagtggcaggcagaagtttccctgttgtacggactccttgctttaatcatattatggaaattcttatgattgattctgctgggtaaataagggtgtccttaagtttaaccccattgtctgtactcacttcttcttttgattgtcagttttctatattcttactttcctctcatgttctaagcattggatggtctggacctatgagattttagagcttctcaacggacttaatgaccaattaaagctctttcttaaactgtaaatttttggcatggggatcttgactaaaatgtttccacttactttaaccctaggtttatgtctacaaaagcgtatgcctgggtaatcctggtttcttgaggatgccatatgccaaacagtcagtaattgcatttctgttggtattgttgaccaattccctcatatcttacaggtttgggtgcagcagggatccagaaggaactgccaaaaatgacagctaggaatttgagggcatctttagaacatttgaagtttggcattttagtacaaatattgttattgttgctagttttaaattttgccaaggacataccctaaagtacaattaaacaaggaaaactagagataccatgtattttgttactgacaggtctttgttcttagagctcccaagatggcggcaggccactcccaagatggcagcaagccttttattctctgacctggggttcttggcctcatggattccaaggaatggaaacttgggccatgtggtgagtgttacagctctattagaagccatgggtcacagaagagaaccgtggaatccagtgactagtgttcagcttgattaggatgaacccgggcacttagctgctcaggaacaatggcgagcctttagccatatcgggagtggcaatgggcgacttgctggatcaggagtgcagcgaacacactgctggatctggaggggtggaaatcagcagtgggtctgtgatggcggcaaacagcagtgggggacggtgagtagaagctcaacttgtgccctaacaaacacagaccagaagagcgtgcagttgcaagatttcatagagtgaaaacacagctcccatacaatgagaggggacccaaagggggttgccactcccaactcgaatgcctggggtttatatctcaatcattgtccctccccctgtgctctcagatgataactgatttgactatttctttacctcctgcttttagcctaatttgtattttagtgagccctctacctgattggttgggtgtgagctgagttttacaagtcccgtgtttaaaggtgggtgtggtcaccttccccagctaggcttgggaattcttagttggcctaggaaatccagctagtcctgtctctcaatttcataagagaaaaatccttctaacaaccaaaaaaaaaaatatattctcaaaaagtttattgaaaggaaacaaattggatatagtttacaaaaagtcaccaaattttaattttcttaagacaacaggagctaatgaaagcatcaccaatgacccacttctaaagacaggaggaagagatgtatgggatgcagatagagacatctaaggcagggaggggatccaaaccagcacagagataggaaattctgctcataaatgggtggggagtgagaacgatgcaagccagggacccctggctggtgatgccctacctgggccttgctcagccatgctattatgccccagctcacctatgttatagcttataccaatctggcagttcctgagctattgtaccatgcccaagaacaataaggatgtgctgtatattgaacggtgaggagggcaaagaagaattttagtgcatgatgagacagctttcagtggagagggggacatagggatgttccccctacccaaaggtgggaaagtcccccatgtggctgggtctgaggtcttttatggactcaatggggagtgcgcactgattggttggtgagtatgcaaaaatggtcaaagcaaagataccactcaaaggtgggcatgacagtgtagaaaaccaattaggaaagggtaggtatttttgaaacaggtgaagggtagggatcaatcagaggaaagcacaccaaatggaagacaagttctcaatctagtctgaggatttaacttgtaacttggctttcaggcttcaaactgtcttcagctcggaggtagggtttcactgggggcccaccccagtctgcctaggtatttggctgactcctgtactcttgagagggatggcagatggcacgttgtttcagcatctgaaatataatgtggatgggcaactggaaagacaaaacagcagcagtggcatgaacagagcttagcacagaggggacaacacacaaatcgttgatgaatttttaaaatgtgggaaattgaacaattcaagctatagtctgcatttcaaaaaagatatgtttgcttaaaaaaacaaaaaacaacaaaatgaccccttcaccacaaaggatcagcctatatcacacacaggtacatgcaaactggcaaattgtcattatcgtctttcacaggttttatgaataaaaatgacctatgaatatttatatgataccctttttcttatcacttttggtggtattatgtaatgaaaataccagctcaggtgttgttatgggcgacattcattagtttgttgggttaactatgaggatgagctaattacttttaaaatgtgctttcatccagtgattcaacagaaaatacccatgctcaatagcattcgcttggttaagaaatgaaattgggcaaataacttatataaattaatgttggaaaattatattgaagagggactcataacttactaaaaatcactaaagaaaactaatttggattgagtaaaattttcatacattaaattgagtaactggtgaaagttttatttttttacattacaaaagaagtaaacaattttagtactacaaacacagtcataatcttattaaacataaaaagaattgatattataaattataagaagagatcatgctttgtagcttttcattatttttatcgaagatctgaatagacggattttctttttaaaaaatgttttttgcttcaaacttagctctaattctcttatataattgacatcaatcacacttttaattatctttatcgtatcaaataaagacatttggtaaatctgaggaaagaatgaaatccagcccaaacaaaatttcggtttattctgttattttttgaaatctcaactatgttttgtattttgaaaaataagcaaagccaaatttctttcaaaaggcaacttttaagaatttgctgtttttaatttggattaggattgagagccagcatggtccatgaaagtggtttgagaagaaaaataatctggttttcataagtagaaaccttgttgagttaggagaaaatcactcagtattttagaaattgattgaaaatgattgaatttagtttggagcactttttcttttcaatatgtaggcttacaaaatatagcatttataattcacctcagctaccctttctgatattatttttgttttatattttatgtgtgtttcaattaaattttgtaagatctttcttagaatgttattttccctttccaatgatcaatgtctatgccttgcttctaaaaatatatacttatttctctaaattgaggttgacaagttaattgtgatttcaggtaggagggaagacaagtatcttcagtacaaccaacaattcactttattaatgtttgtcttcaaggagagcacaaaggatgcatcagaaaggcagaaacacacatattgtgctcatcaaaggtcttaaaggccagagaagagaacttggcaggaaagttatcatccaagttcaattatttaatcttaaaaaacatatgatttagttagatagccaaaacctgggtagaactcagaatagatactatttattttcaaagcctaagggcatgcattttcagaaaactcagtggcttaaatagtgcttaagaatttacatttaattaaactggatgcaggtaatgggggtctgggtttcggctgtctcacattatgtacttgctgctcattgtgcccaaaggcaaagctccatttaaattcaacagatcttagcaactactgaacactgttgggctgagaatttgatagtgtatcaggctgggaacttacgcctctgggtaaagataggccagaattctgtgagtgttagcaatgatcaccagcaatcaggcagaaaccctagtctcccaaaattgtagagtggggagggtattcagtgagctgatccacttagtatttacagaaaaagaaacacatggcttctgaaactccaatgaagagaacacatgggcttaagatagctatgttttaaagaaaataaaatgatgtgaactttccttggttctgaaataaagttgaacttaatgatccctaatgatctttctctataaaatatcacaattccaggaaaaatcttcttaaattttctgatacaattagacactgatctctaatctttgtggtggttgtagttcactaaatgccacatgaatatgaatccacatttttgtaaagaatttgctagaatttgcagatgttataggtgaaaacatcaattggagtacaaatgtattagggtaaataaagggcaaaaagatggtagtttttagggagggggaacagtacagaatggcacatgagatgactcttgacattctgtatgcaaagtgggtctcatctggattatcaactgtcacaaaccagggatcatggtggattccacagtatcacatggtatggattaaggatatacttcacaggggacagtggaaacttaaaagttatatgtcgggaagaaaagacaatgtgtgatggttaattgtgtgtgtcagtttgactggtacacagtgtgcccagatatttggccagacatcattcttggtatatctgtgaggttgtttttggttgagattaacagttgagtcagtcaactgagtaaagcagattgccatccctagtgtgggtgggcttcatgtaatcaattgaaagcctgaatagaacaaaaaggctgagtcaatgaaaactctgcctgcctaactgcttcagctggatattggtcttttctggccttcagaccagactgcaatgatgctgcaacaatgactcatcttctgtcttgaggctgctagctttcaaattggaacttttactatcatctctcctgatattcaggccttcagacttggactgaaactacacataggctctcctgggtctccagcttgcccactgcagatcttggtacttcataaccattacaatagcatgaatgaattcctcataagaataaatcctattggatctgtttctctggagaaccctgactaatacacataggtgtaccctgttctttcattctcctagaggtgagccacagctaagatatcgtgggtttgtgttgcagtgcagggatcctgcctgccatacctctcctagccctgtgagtcaagcacaaggtcaacctcatcagtgaaggaacaaacaaaatattgggagccagccagtctggagtgggatagggcctatacatagaattttctgagataccagtagcctgactcctggagaccttgtgacccatgacaagtttccatcttgactgctgtgaggaggaagacacaagcagctgagcttaggtgcagtctctcctctgggagaaagagaactctgacacctcctctttcaggcaacgcaaagagagcaccagggtctcttccatacaatcttgatccttgtatcacaaactgatgatctatgaatagcaccatgaaaaatgtagtcttgcatacaagaaaaggttaagatagaaaataaagattgctaaataataggcaaaaaacatttagtatttactcaaatgtaatacgcttcctcccaaaattatagttcataaatttgtattgaaaagtaattggaaatataaactatttaattagaattcataggctatagaatatcaaaaagcctttcttaaactcagttatgatgggaaatgcatagatttttcagcaagtaataaaatgaagataggattacattggaaagagcaaattgtgcatgattctctgaatggaggaaaacagaagcaagattagttaagacgttggtacagtgagtgattaggaccctggaatgaggtggtgatggctaaaaaaaatgaggctatatttctgagttgcttgaaagacaatgggtcattcaaatgtggtgactcattataaatggatggagagaaatcaaatataacttcaacattgcaaaagtgggcaacaagaaaaaatagggacatcaaacggggtgggctgggggtatctattgtaggccaaatatagtaaaagactttatgatgagagataccatccaaataaaatgaaatacaggcttaataattttggtgaaatatggactgattagcatctgtttaatgagtagaaagttaggtaattgacatgaattgtgtcccctcaaaatacatgtgttgaagccctatccctcaatgtggctgtatttggaaatagggcctataaggagttgataaatgttacatgaggtcataagagtgggtccctaatccgataggtccagggcccttattaaaagaggaagagatagtagagcgctcacttgcgcttgccttctcacacgtacacacacacacacacacacacacacgttctctctccacgtcccaccacccccctgcccccctgtccccaccaatgtgaggacactgtgagaaggcagccacttgcaaagagaatagagcccttaccaggaaccaagtttgctgacaccttcaacttggacttccagagctgtgagaaattaatttctgctgttgaagccactcagttgctagtgttttgttatggcagccagagctgattaacacagtaactttcatgtttacaaaacaaaataattatgttttaccctaattattgtatttgaggcataaaagctaaaacatcaataaatcataagtaataatgatttattagataactatgatatatctccaatgatataggacatgttatataaatatcttgcaaaagacatcgacaactccagctggatttgctttagaaatgtttagctttggaattacatggaatgacagaatgtgtccaaaggccaccagtttgcacatttacaacagagaacaactttattaggctacagatagtgacctaacgtaacaaaaaagagataaaccaaccaattagtgaataataagtaatagcaactgataattattgtgcccttgcattgtgtcagatattttctaagcacctcacatgtatctgtttcggaaacttctgtgctagggagatactattattaatcccatttttaagatgaaaaactaaggcacagtgaatcagtaacttggtcacactcacacagctgtgaaggaaatgagtagtagtgaatgacaaaaatgctggcaattcataggtccagccattgtcatgcaggaaaaaggggaaatttttataaacattggttgaaaagttatactgaactgaaggaacttataaggcacaacacggtctaactctccagtcaacgaaaacattcctctctcagctgctctggtgggtcatccaggctcacagtgaatgttcccggcaagaaagtgccttcctgctttccaaagaagtccttttcaaggtggcggagcactgaatagtacagaattcatcagtatattgagttcagatcctatctataacttaggtacttttgttttcctgttttaaagataacattaagaacctgctgttttttcctctatagaatctggcatttacagcactttctcatcgatcacaccactgagtgttaccattcctattttacagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatcttagaacttttgcttctcagtgtcaaatatttttggttacctcagttactttttgcaaggtacagttttcaaatcccatttcatcctgattgtccttccctgaattatttaagtgtagtttagctacacttaaagcacagtattcgctaaaattggaaataatgttccagacgttatattacattgaccattatatcccttgatccaaattatttattgttgacaattattacttaagataataaagaataaacttctaccagaaataccagaaaatcaatatatacatatgtaagaatggaaaaatgaataatataaattatttactattccattgatcaggccaatcactttttgtgtaatatttcttgatttgttttctatgaatatttttataatatctgcctttatattacattgattattttgagttctgcttttcttcctttgcctcaatagcatcgaaattttatagatactcacaaactctgagaatatgattttaatgccagtccttcagtagtcatctttatagaaaatgctaagttaattataaaattataaatgatttggtgattagtatctttgtaaatattttgctaccttctcatattttaaattattaggtacatattttcataattgagatttctggcttgaaaagtatttgagaattatagaatcttttaagtcagtctctcttcctctttctaatatatattttcatcttaatgagtgatgacaatgatttttttcaaaaagaaaaaatgaaaacgtatttgcctaatgtgtatgtacacgcatgcatacatagacacccacatatttcttaacactgcatttttagaaaattcaaacttggatattttctttaggaaaactcccaatctgaaatataaaatgtttatatatatatatgtgtgtgtgtgtgtataatttatgtgaatacatataaatatacacatataatgaaatacagtactcaaggagaccaaaaagagaatgagggtaaagccagcttgtggaatgctttgcatactatgctaagtggattgttacgccattgataaattttaagcgtcatggataaatatgaaatgctacatgtcattgttttgaagaggtagtgatgatagtttcctaagtctaattttatgctgctggagaaaacagaatgattagaattcttatttatgcctacagaaaagaagctgggcacaggggctcatgcctgtaatcccagcactttgggaagccaaggcaggaggattacttgaacccaggagttggagactcacctgggcaacatatagtaagaccctgtctctacaaaaaatttaaaaattagctgagtatggtgacaaaaaatttaaaaattagctgagtgtagtggtgcatgcctgtgatcccagctactcgggaggctgagagaggaggattgcttgagcccaggaggtcaaggctgcagcgagctatgtctgtgccactgtactccagcctcggcaacagaatgagaccctgtctcaaaaagtaaaaaaaaaaaaaaaaaaaaatttaaaaagaagatgaaaagcatatatatcaaataggcagcattttggcaattagagccatttgtaaaatgggtgaatcatgaatcctattcatagttttatgcttactgagcttattgatgcaaatggcctgctctgggatactaaaagatataaaattgaatgaaataaggaacccaaaacaggtgaaggagaaagatcattagatcaatggtcaccaaacgttttatttaggtagcatctgagattctattggactatctgtacattccactcttcatgtgctaaacacatacttggtcatcaaaacattcagggaataacatgctaggaaatgcataacacagataaattgaaagagtaatgggcatcaaagccatttggtgcaataaagaatcattacctccatgacagtggctagttagagaacagatacaaaaagttagagacttgaatcattctatcaattacatctaagacttgcattcttaattttttgtatttttctaaggtgattcatggagagaattagcttgtgacttaacactacggagttaggcaaataagcatttaagtgaacatcataaaactggaggggttacaaaagagataggagatataatctctaaacttagagaagtttacagtcgttttacagaaatattttgcatgtaggtaacccctgattaacaatacaatcaagtgctgtgttgtgtgggtcaatatgagctatagtatcaaaataaaagtgaagaaaccaacaagacaaagagctaatcaccctcctcttcccaaattaatcttcctcattggttctaaaatatgctttcactggtaaaatccagcaatgtcattttccgagcttgcagggaaaaaaataaattaataattttctcaattataaagattgtgcctaaaagtttttcttaaagttttgttgtctacaacttcctgactagattagaatgaaatggaagatattacataaattagctgaaaattatatatctggttattttaagtttattatatttttatttcatgatgtctgcaaagaacataatgattcatgtggtcttacacttaaagcttaaatgggaccactttgtatggtgcagtttaagagaccatgtgtttttgtgtttgaaaaaagataaaagacctgtttattaatctcttataatccagacgtcagttgttagtgaggtgtgttgtcttatttagtatgtttttgagtaaacctaaacctaattctccttttatatagcatgattaacttgtgaacttttttttttttgagactgagtcttgctctgtcgcccaggctggagtgcaatggcgcgatctctgctcactgcaagctccgcctcctgggttcatgccattctcctgcctcagcctcctgagtagctgggactacaggtgcccaccaccatgcccagctaattttttttttatttttagtagagatggggtttcaccgtattagccaggatggtatcaatctcctgacctcgtgatccacctgcctcggcctcccaaagtgctgggattacaggcgtgagccaccacgcccagccaacttgtgaactttcatattattttttcaacgtgggagtgagcatgattgttgggtaaataatttcctgtggacacatttggtttcattcaccccacttgacattccattgctaaagtagacttagatacagcagtcctcccatgaatttaatatatgggaaggttaacaagcagagtaaatgaccaagtatttgtggtgattgaagttgccaagttccaggaatacataagccagaagcaccttaatgagtgatgaaactgatgatgattttcctcaaaaagaaaaaacgatgaaaatgtctttgcctaatgtgtatgtacatgcatgcatttataaaagcacccccaaacacgttcctaacaatacatttttagaaaatttacacatggatttttttatttaaaaaagaagactccaaatgtgaaatataaaatgtttttaatgtttttgtaacctagccatacattcatgttttttttctcaatttctagagctcgtgggtccatccaaaattatactgaattatactgtttaatttagcccattcagataggctacagaattgaacaggatgaaaagggcagcagtatgatgcatccaacaaggggccgaccagaaattctgacctccagatgcagcattaagttcaaataggatcagtaaccacattaggagggtcaccagatagagaagagaggtgatacatcccagagttgattgtgaacatcttagctcaggcacacagaaatcaacttactatcattgttcaagtctaacctcagagacactagcaattagaagttaggaattcagggtagaacactggaaaacgaagagcctggaacctcccttccaaaatctttttgttagtgaacagcctattctccaccttccctgaactctgaacagctgaactcacctggagaaaaaaaattgcaacatctgggacccttatctcaaggcaaccctaagaagtgggtttactctgttttcgtgctgaatttgttctctcattttatgacgttatttcatagtttctcttctcttctctaaactctaatactctttcttctttcctcttccttatctactacattcattttctagttaccaaagaaagtgaagaaatcagaaaaaagaatgctgtcattctttcaacatcaaacctactatcctatctgcatctatgccaatggctccacttcccccttgttacctgagtggcaccacgttacttctatctaaacaacctctcaacatacattccacatgccctcccctctttccaaccgaggtgtattcctctcttcccctccttcatcatttgcttcactatatattagattgttctcaacagcctaaaaacattgtaatagtttccattaaaaatatatgctggcagtatattcctttcagatatcatctcatacctgtatttatctttgtagaaaacttttttgaaagagtgttttattgtgttgacttcattccattcttgtctcccttcatcattcattccggctttagcccccttcaatgaggcttttctctaatccctccattaagaccaatctcatgaaagtcatcagtgacctgcatcttgggaaatccaatggtctgcctcagttcttaattaaacttctcaaacttttaacctagctgagtacttctttattggaatgctgtaaatatttatttctgtatgtatctgtttgcttgtgtgttgcccttctccatcactaaaacgtaagagcaagttctgttttgtatactccttggtcttgtatcttgttttgtattcccaatgtctaaaacagtacttggcattgactaggtgctcaaaaatcacttacagaatcatttaaacagtcatgtatttgagtaacaggcacatgaagttataaacacaaacataatttatcaataagacaaatattttgggagtcagatgtttcttacctttagtctgtccagagccagtacagcctaaaattaatttggtaattgggctttagaatctcttcatttgcatttgaaatgaacccatccaatatgtccactgaactacacagcttagagtgaactctctccagttgacttaggataagtaagcatattcacagaagccattaatctggatccgtatcccatgaaaatataagactaaatcttaactggttttgtgaaactatgagcaaaaaagtgtaagccctatattgtcaggctattccaacaggcaataccactgaaatgcagtagctcctccctaagctaagtgccaacaaggagtgaaatgtgctaggtgcccaattagtatctctacctactgctcattccaaaggtctccaaccagctattgacctaaataatccacctagtttcaggccacagccaagaagtctatttatagctcagagtaaactaatagctgagctgagaggcctttttcttatttgtaattctcccttctaaaatgtaaggaaactaacataccagaaacacatgaaaattataagcccctgcaacagccaaattccaattctgcgttttccccctaaacaaaaaggaaacaaaatgttgagagaatgtcaagctgctaccagccacattcagcatacttgggatccacagttttaatgaaatcatttagcctttcaaccacatggcacttctttatctgcagatgaaaatcctggtttttagtattaaggttgtgaaattaaggttgtctttaggattaaggttgtggtggagatacaattttttccttaagttgttttcttcaaggaatttatccacaagaaggttaattatgacatatttttatagatgcctaagtgtaggatttgttttagcattaatggaccatctaggccattacagaaagatgttgggatatttaagaagtggtattttttaagaaagtaagtcaaaacatgagaaaatgaacttaaatagctagaatttataatcttttaatctgggtctgtgtcccatgaaaacataagactaaatcttaactggttttgtgaaactatgagcgaaaacgtgtaaaccctgtattctcaggctattccaacaggcaatacctctgagatgcagtgtcccctccctaaacttttgtttataattacagtcaacatttattgaaaatttttggactcaggccaggctttgtggctcacacctataaacccagtactttgggaggctgagatgggaagattacttgaggccaggagtttgagaccagcctggtcaacatagacactgtctctcaaaagaaaacatccgtactctactgaattctgggtggatcgacaagtgaatgcaatggtcctcactcctgagggtgttttacttcatatgatgaaaagatatattagaaatacatttttaagaaatgtattaatagtgtgatctatgataaatatttggcctaatttcttctactttctgagcagttgtcttggcacggtgaagattttcttgagttggggaatacttggaatgtcaaagaatctgtcttgaggctacctgctattttacttactaaggtgggagatgtaggggactcactcatttcaccaggatttattttttggacaaggacaaaataaaaatgagcttttataaattgtgttataagaaaattcatagatcagaatcatagctctgattatacttcatgactataatattttcatacttggtgtctgtgtttaataagaatgagcccaacaactaggaaagcatcctgttagtatcttcagggggtgtcctgtacgggatacataatggggtgcctgagtgagataaagcaacataaaacttttatgtccagggaacaacacgtatgtgacaaagcaaagggaatctaggactagagaaggtgtaatgcctgcaggttgtttatacagcttgtactatctgggcagtgagtggaaaacttgatgcaaaacagaataaggaaacatgctcgctaaaactgagcatggaggtgagaaaaaatagattattttctcagaaagggtgaattgcaactccatggccagttggtatctttccatttaaaaagacctccctggttgacttgatttattctcaagatggcttcgacacacggaaaagtgggtcacttgatgagaaatacgctggttttcaataaaggggaaagtgatgtttttttcttcaacttagttccagtagaagttccaaaataactggaaagttattctgtttcttttactctccttgtgtcttgtgaatgatggcaggtttatttcaaaattgtgagaaaagaaaaacagtggttggaaaacatgaagtggtctgtttattttggccattggtgagaaatgttctggaaaagctatctaaactgaattccagctgtatgtcactggatgctggcaggatttattggtgggaagttatggcaaacatcttgatggctttaaatctgtattcatagctagtatcttttgtgtaattatacttaaaaatcattaatttcaaaaaaaaattagagaatttctctaatgcttgtacattgagaggggaaggaagaaaaactagaaggttagtcttttgaactgctatagttttaaagatgacagaacccttcatctcagcaagagcagtggaagattaaaaatattagacatggccaggcattgtggttcactcctgtaatcccagcactttgggaggctgaagcaggcagatcacctgaggtcaggagtccaagaccaacctggccaacatagcgaaaccccgtctctactaaaatacaaaaattagccaggcatggtgacaggtgcctgtaatcccagctacttgggaggctgaggcaggataatcacttgaacccaggacacagaggttgcagtgagccaagatagcaccactgcaccctagcctgggcaacagagcgagactccctcatatatatatatatatgtcttgactaagaccagggatatctcccttctgttattctgaaggtctgcctattgaatagtcaatcctgaagataagcaagataaagaattaagaacaggaaaccacaccaagctctctgtctccatttaccccttagacagatgtttctttaagttttttgaatgagcaattcattattgtaatgatatgacaaagagaatggatgctaaccatcctatgatccaagtttatcagctacatgatattggtcagcttacattcctttatctcttggcttcctcactgttaaaatgcacatgattctgcctaactaataaggtacttataaagattacattagaatatgcatatcataccttggtgtctgaaaaaagctgctgtattactcttattaaaaataaaattaagcaactcctattcctcttaaatttctattttatataaacctgcacctaacatgtggaaattgagagaaatagcttcagttttgtttgccttttttgttatggtattgatttctattatagttatataattatagtatataatggaaattacctattttttgtctaaatcagtgacaatggatgcaaaaagtacaacactccaaggaagtatctctgcccttgaaatttctgagaaagtttcaacaactacacttcagactaatggaaaatatgatcataattgttttggtttgttttaaaaaaatcaccttatgtttaaagaacattatgaacaagcctcaaactgttctgctgctctacacacctacaagtgaaaatcaatatttctttcaaaaatttccatatatgtctcagataaaagttgcgctgtgctcacatttttctaatgtgacatatggttggtttcaaatgcatgcccaggaggcaaaatactgaataaactgtgatgacttatagtttagaaggttttctcctgagggggggaaaaacagcagataatattgttacaggaaatccataagccaaaaagaagtttcaaataactctttctcccaagtcttccacaagctgtccttaaatttttaaagagcacttgaataataaaatgtgttggttatagccccatttttcttcatgactaccctcaaaacatttactgaagatgctattttaagctgccatttcaaaatttttaccaccagtttgtagatgatttctactcagttgtacaacacaatagcatacaatattccctccattcattctgacatggatcatctatttttctgcccaaaggattgaagtgagaatggcatttggaagacatttcaggaacagttagggcaagagataggattaggtgtccctgtgcctacacggaggaaaataagtcccactcctctaccaaaaagaaaatttagctttactctgatgctagatgacttagtgattagccggccatagcttgaaacattttggagtcttgtttttggtagagaagagggaacattctaaatttcttccattctctttttttttaatgggaatgagtctttcccctttgaaggaaggggctggagtgcagtagtgggatctcagctcactgcaacttcggtctcccagcctcaagcaactctccggcctcagcttcctgcgtagctgggactgtgcgtgagccaccacactcagctaatttttgtatttttagtagagatggggtttcaccatgttgcccaggctactctcgaactcctgacctcaaattatctgcccgcctaagcctcccaaagtgctgggattacaggtgtgagccaccacacccagccaaaaatatgtttatcattttacagtcagccctctgtatccgtggagtttccatatccatggattcaatcaacccagataaaaatattcagaaatatattgtatctgtactgaacatgtaaatacttttttcttgccaagattacctaaacattacagtatagtaactatttacatagcatttacattatattaggtattacaagcaatttagggatggtttagggtatatgggtggatgcacataggttatatacaaatactgcaccattttatagcccggacttgagcatccccagattttgggtaactgagggagagatgactttatacgtgaatgatcagtctagcaaacccagccagggcctggagggggccctactcagtctcaggctgagaacacctattgaggttaggtaggtcatttaagttcattgaactcaaatagtcttttagtatttaaattccttctagatcagaggttcctaaccccaattgataagcagagtttcctagttagagagcctttaatagctacatcctgagcttcacctttgaggggagggaccgaaaacagcattttaaaatggctgaggtgattttgatatagcatagctagcattaatttgtgaatttgcatttgggaagtatatccctagagaattcttaagcaacttctctagagtcttgtcaaccttgataaccacacgtatgtttgaatatctcatactgcaaaactattatttgcctaggcagcacatgctcttttcagtagacttgactgcatcaaagaaaacaatattaaatgaaaatgcacctgcataaattctctatcaattggtattctgttacttgggggccatagaaaatctaattcctaatccacacaatagctcttctactactatttgcagacaatggcaggcacttgcatttcagtcatttcttctctagaaaaatatttctagttcatttagtctttatgtgacttgattttaaaatgtatgtattccccttgcttttctttgaatttacccctgaggtttctcaagtgagggcttcaactgaacacaagtcccagtggggctgggttcgtaggtgtgtgagctgcattatctcaaaggaccctccaactcaggtctgtgcttggttttgtgttgttcattgagttgaaatttatagtagtagtttttttttttcttttttaagcaagggcctccacatttccactttacacagaggtcacacaaattaggtagcctgtcctgtgtcccagctctagtatgatcttgtataaacggttcaattcccacatgccccatgctaatggaacatggtatacattatctgttttagtagccatgttactcctcagttcatactctacatactacgggatgcaactccaagattgttttctactacacagccatgtctccttcatgatggatttttgagattgttgtgggaaacaaatacaagatgttatattgattccagttaagcataatctttaaagatttggcttatggttccagacctattgagacctgattaggttctgattgtatcatccatcatgtttgttgtccctcttaactgcatgccaccaaaagacacttacaaccccgtcttataaagtgatgaaaaatatcatagtaggaagcatttaaagaaatatgaggaataatggttttgatcatgtgatctagttgctattgtcttaaagataccgaaagtctccaatttcagtagccagtgtgtaatctttattcttcttgcctaaaaatagtttgatagtctttgttgtcattgtgaataagaatgtgaaaatacttcagttgtaatgggggcttcggccaacagaagactcatttctgaaactatatggtatgaaaaactcacctcagaggagttataattatttaatgcaaatgtagaaaatctagtgtttctgtctaccttggcaatgacatcttttggtttggatgcttcagggagccagttactttagtaagtgctttggtgctgtatgagagaagacatcctcaagtgagaaaggtacaagagatgtgtaaatgttttcccacttacaataggtgatttctgaattatttgcttttattccaatttaatcatggaaagttttaagaaaagtaaaattgtttaagatgatgacagttttgatttcagctatgtatatggtcaggtaatgaaatatgattttgtttgcttatataattaaaatacaattaggtcaaattaaatactagcctggctagctgttatgctgttaattagaattttaaacagtatttggatactttaatcatttccctattttatctgagtaatcattccctcagaaatacagaaatgaaaacctcagaagcccagaaacataacattacatttgagctaacttttcttttcctacataaagctgcatgcattagtgaaggctgatgctcagtttcttgtctgagatttctcattgtactaaaacagattcaagggtgaacttacagtaggatccgtatgctggtaggaacaccttagtcctagttgcagtgctggaagaacttgttaatttgctttagatctattatttacccatcatctctaaagtgaaggagatatcatggcacatcactgaagtctctttaatctccaagattgtacacatctgtaaatttgtgaaatgcctccagagagatagggcagtataaatgattcatactattgattcacttggcaagtggaagggctgagctcagaaataaaaaggcaattctattacagttcaagagtctgacaggaccccactactcagacctcaagaagtgctttgtagcagttgaaaatgatactttaaaaagcatgtgtgagatctgtgttcacatgcatatatatttatgtattactcaccaaaaattactgagtgtatactttttgccaggaactgttctagatgctggggatatagtagagaacacaacagacaaagactctacctttatgggcttttattatgtggcaaaatataccaggtgttaaataagataagcaattctattacattaaaactagactgaaagtttaggcagcaaatgagtgggagggatctgcaaaagaaaatttcactttaaatattgtggtcagggaagcacccactgagaagatgacatttgagtgaagatctgcaggaagtaaaggtgcaagccttaaagatttctggagggatgatgcccagaaagagccagcaggtacaaagttctagaggtgggagcctgccagctgtgtctgagaaataacaaatagaccagcatgaagggaagtaagcaagccaggaagagaggaagatgcagtggagatacaataggaagccaaatagtataaagcaagcttgtccaactcgcggccccatgggccacatgcagcccatgaccggtttgaatgtggtccaacacaaactcacaaactttcttaaaacattttagatgctttttgcaatttagtttttttagctcatcagctatcgttagtgtattttatgtgtggcccaagacaattcttcttctagtgtgttccaatgaagccaaaagattggatatccctggaaagtcttgtcaactattttaaggtccttttcactcagagtgaggaaatggatgtcttactatttaataggatccctctggctgctgagttgagaatagtctatgtgcaagggcagaagcagcaggcatgttaagaggctattggatgaaattgcacagtcacacattatctttttctaatagactaatacctattactagactatctgtagcctgatcttctactcttgaattagtcactcatttatagatataattgttgactggtacaaaatgctgtcattgttctagactgaagttatttaattgtaactgttaatgtgaatgcccccgttgggacccaagaaacctcttttatctaccttcatagacctagggtaatccatttccattaaatgtaggtttatcaaacccctactttatatcaggcactattccaattacttggaataaatcagtgagcaaaggagactaatagccttgtcctcatggagttgaattttaaagggagaagacaaaaataatggctgcaataaacaattgatagagtttattagatggttatgagtgtaatgaagaaactacaatatagatctcagggcatagggcaagtctcggtattagtaggacattctgatcaggctttattaggaaaatgagatttaaataagaccttaaggaggtcagaaagttatccacggagatttcttggagaagaatatttcaggcagaggaaacaagcagtggcaagcaaccaacagtgcaaaacctccaaggcataaacatgacggtcattttcaaagcatagcaagatgatcagtatgtctagagtgaagtgagcaatggagaattagtaggacatgagctatgattagaagtgagagccagaccatgtagttgcttggaggctagtgtaaggactttggattttgctttgtatgaaatgaaaagccaaagaaggagaaatatgatctgatcaagcacatcgttctggctgctgtgttgcgctggaatatgggagggcaggcgtgaatgcagggaagccagttaagctgttgcaacaatccagtttagagaggatgaaggctcagagaagggtgatggcagccgaagtgttgagacgtggtaacagttacattctggttatattctgagctgaatcaaacagaatttgatgacagattagatgtggggtctgagacaaagagaactattatgacaagattttggggcctgagaaactagaggggtggaattgctatcacccaagatgaggaagagtatagcaaaagaggatttattgatctatccatagttttgccttggacaagacaagtttcaacatttaagtgaagatgttgccttggcagataatatacaaatgtggatttaggatggaaaatttgggttgaatatataaaccaggtagtcatcctaatgtgttaggattatggtttacagtggggtttaaagccatgggcagcatgaggtctataaaggagtatctgaagatagaacaaaggaggccagtgcccgagccctgcatactcccaaatgaaatgatttaaaaagaatttttaaaaatcccttaaacacctcagaattcagcttcgtaccttcttctacatcagtaaagatctgcaatggaaatagtttaaacttttttcagactggtgggttatttagccatgcttgcagcatgatcatttcgggaggtactcaaagcatagtgtatcccaaacaaaaaagggaataggttttcctttacatgatggcaccagccacttggtagtgactgattggtatgctatgctgcagcagatgtggaggttggatgtgggtttcataggggaaagagcctcacaatggcttagtgaggccttccaagggagcaaaatgggcgaagcctggtgccatgggtttgcttatattttgcaaatctcataaatgagaactctattgtggggggctctgacttttggggatcaaactccttttaaagaattaggattataaataatacctatcaaaactctgcatgtacctgtgcaccctcaaaaaccctgtgcaccccaaaatttatgcatataattttagtaagacttctgggcgtcttccgtggactcgtttaagaatccctgctgtactaactcaaaaacagtcttaatagcttaacacaatttctttccaaatgtagtcagtttcaatattaagtttggtagactctactatttagcataagtagcaaacagacatgagatagttattccactattattgttctaatcacttcatggagaaacttgccaagaataattaaaagtaatttgcaacttcattgcccttttattggccattgactttgcaaacagaatgtagctatggaccaagtggcacatgttcatatggtttgccagtttggggtacacttataaaatcttttcattactaatgtagtaagcaaggctaactgaattggtcccctcaaagacagatggcaattccagacattactaaatttttttttccaaaatttaaaatgtacatattaatgatgtggaactactcttagattagccatatgcatagccctctgccatagccaaatgagaatatataacctcttgtttaataacaatagggttttgccatcaaagaggattgaatagatagagcattctggcatttaactattgccagaaattgtacctcagctttaattacactgaaacaaaactcactggcacatatcttccacatgcacctagtccacgttaattacctccacttagcaagtccacctgtctgagtgttagggccacattttcaatacaagttcttctagctgttacactgctaacccatggttctcaaacccaaagatccttgggaaggctaatgcatctcttttagagccctggagtttgatttgtagccagctgttttgaaaattccaacccataaacatttctgccacactttatagagggattctaaacacaaatgaccactgggatgaggcaattacaagacctgtgataaatagcaagcacatcccctgcccaatgacattgagtattttttttcttttgagacagtctcatcctgtcacctaggctagagtgtaggctgaatcccatcccagagtctcagatttagtaaaatctaaagtagaaactgctagcaagttcccaaacaatgctaaggtttctggtctggagccaccacattttgagaaccaccactacaatccttattaaatgttatatgtttctgttgggatatgaggtgaaatggacttcaaactgtttaaaaactttacttcctgacaagagctcactgcagccttaaattcccaggcttgagcagtcctcctgcctcagcctcccaagtaactgggactacaggcgcgtggcaccatgcctagctaattaaaaaaaatttttttgtagagatagtggctcgctacatagcccaggctagtcttgaactcctgggctcaagcaattctccggcttcggcctcccaaagtactgagattacactgaagatggttttacctcctagtagaaataagcaggtcagtctgccaagctccagcacagaactcccggggcctatgtgcttgggtacatacacagcagcttctgcagaaaacaggtctctcatctgtggcttagcactgtgtggaggagggcagagcttccacacaggtgggaacacatccggcttggcaattgttgtaactgaatattagcctcatgccttcttctctttatagcagttggatccatcttcaatcagcatcacagaacacaaactctccagctctttttaggaagtaaagtttttaaacagtttgaagtccaattcatctcatatcttaacggaaacatacaacatttaataaggattgtagtggtgattctcaaaatgtggtggctccagaccagaaaccttagcattgtttgggaacttgctagaagtttctactttaaatttactaaatcagggactctgggatgggactcagcaatctgctgtcacaagtcctctgggtgagtctgatattcactgaaacttgagaaccactaatcccaggcaacgtttccgaactttttgtgtgcctaaggattgcatggtgagctcgtctggggtgttactgaacatcttaatttctaacacttataaaagcacacaagctaatgtgtgccttctacaccaaaatatttgtaaaaaaatttgaaaaatatatgaccttattttacagaaccatttactgcttagaatcaaagcttatcaaaattatttgaaaaattagaaaagaaatatgttttcttagtgacaccatttttttaattctctgtggtcttccttgtgattagatgagtaatttataattatccaatgcatttaatatacttcagaaaggcaaaaaaggtaagttttcttgttggaaaaaaatgactggtacaattaactactatatgtgtttatgtgtgtgcatacactatatatgtatatgtatattggacatatatgtatatatttgatcttttcatgttactgctcgatattaaactatttcttcttttgtaggaattctatgaagttgaacaatttgcattttcttaaatgtcttattttacatgttttcataggcaaacagctttttaaatgcactttagtaattcactgatatacacgattgaatttaggttatttaacattccatgggtgttttgtaattcataaagtgagagtagtgtgttatttaacacaatgccacgtatggccatggataaactggttgttgccataaatcctgaaagaaatttctgggagaaaaacaatttatattacaatcctctttgttttccaaacacaagaataattcaattttaaaacaccactcaagatgcccaaccatttcaaagtaatttactttctatttttttcccttgactttcaaactcattttttatacaaattgtaaagcatggattttaaatagggaaaatattgctgatagacatttgttttgctcaggagttaaactactgctgatttcactgcattgaaaatgttgaaggaaatatgactgaatattttcaggagacagattttgttttgatttttgttatatcatacgatcctatttcaggtctataattttgaccacgcaactaaaatttacagcttcaaagaatcttcactttagcaaattgaaatggcttcagagtaaattcacttaaaataactctcagtttgtatagagatatctatatatccatatataatgtgtattttaaggtatatttccattcctttaaatgaattcaaaactgatttttaatgaaaatgattcaaaagtaacatttattgacaaaaacttctttgatacgcattttatttttaaaaaatcttttcacctaggcataacatttaaaaatatttcaaaaagattcagatggcaccatgagaaaaaataaaatttgttatccttttgtttactccattcttatgctgctatggaaaaatatccgagactgagtaatttataaaggaaaaaggtttaattgactcacaagggaggcctcaggaaacttacaattatggcagaatgggaagcaaacatgtccttcttcacatggcagcaggaaggaggctaatgagtgcccagtgaagggggaagcctgttataaagccatcagatctcatgagaacttgtgcactatcatgagaacaggatgggggaaaatgctcccatgattcagttatctccacctggtccctttcatgacatgggattatgggaactacaagatgagatttgcatagggacatagccaaaccatataattcttcccctggttcctctcaaatttcatgtcctcacaattcaaaacacaatcatgcccttccaacagtctcccaaagtcttaactcattttaacattaactcaaaagttcaagtccaaagtctcatctgaggtaaggcaagtcccttccacctctgagcttgcaaaatcaaaagcaagttggttacttcctagatacaatgtgggtacaggcattgggtaaatacacctgttccaaatgggagaaagtggccaaaacaaaggagctacagtctccatgcaagtctgaaatccaacagggcagtcattaaaccttaaggttccagaatgatctcctttgactccatgtctcacgtgcaggtcttgctgatgcaagaggtgggcttccatggccttgggcagctctactgctgtggctttgcagggcacagccccctcctggctgctttcatgggctggcattgagtgccagtggctcttccaggtgcacagtgcatgctgtcatggggtctggaggatggtggccctcttctcatggttccactaggcagtgccccactggagactctgtttgcagggttccaactccacatttcccttctatactgccctagcagaagttctccatagggctctgcctttgcaggaaacttctacctgaacatccaggtgtctccatatatcttctgaaatacaggcagagctttccaaacctcaattcttgacttctatgcacccactggctcaacaacacatggaagctgccaaggcttggggcttgcatattctgatgccatggcccaagctgtaccgtagccccttttgaccatggctggagtgtctgggaaacagggcaccaagtccctaggctgcacacagcaggaggggctctgggttgggcccttgaaaccatattttcctcctaggcctccaagcctgtgatggtaggatctgctgtgaagtctctgacatgctctggagacacttttcccattgtgttgatgattaacattcagctccttgttacttaggcaaatttccatggctggcttgaatttctccccagaaaatgggttgttaatttctgttgcattggcaggctgcaacttttccaaacttttatgctctgctgttcttgaatgctttgcagcttagaaatttcttctgccagataccctaaaatcatctctctcaagttcaaaactccacagatctctagggcagggacaaaatgccaccagtctctttgcataacgagagtgacctttactccagttcccaataagttctccatctccatctgagatcacctcagcttggacttcattggtccctatcactgtcagcattttggtcaaagccattcaacaagtctctaggaagttccaaactttcccatattttcctgtcttccgagccctccaaactgttccaatctctgcctcttacccagttctaacgttacttccacattttcagtatcattataatagctgcaccttatttatgataccaatttactgtattagtccattctcatgcttctataaagatctgcccgggactgggtaatttacaaaggaaagagatttaattgactcacagttctgcaggactggggaggctttgggaaacttacaatcatggcagaaggggaagcaaatacatccttcttcacatggtggcaggaaggaaaaaaatgaatgcccagtgaagggggaagccctttataaaaccatcagatctcatgagagctaactcactatcacgagaacagggtggggaaaccacccccatgattcaattatctccacctggctcctcacatgacacatggggattcaaactaagatttgggtgaggacgcagccaaacgatatcactctgtttattaaattgttcatctacaattttgaaggagcactctctatttgtccttatttttaaactttataaaatttttatttgaggctttagagggggtattatacttttatattatgaattttttgttctaccaagaatattttatgttgacatttttaattgaaatatatggctctattttcttgtcttagaaagtaagatatactgaacatatttgaatcacattctggtgactaacagatttttacaattgttcaggataatacttgcatgtattagtatgaaaaaattctacagttgtacacaatgtcagtgattgtactggctgtgtctttcccctagaagatgccggggtgtggtgggggaggggaagaagaaaaagaaaacttaatttttatggtaagaaatcgattattattctatcctcattttaaatcatcaagtaataataagtattaaacaataataagtatttactcaattcttactatgaaccagatatttggaacatgggaatgaagcataaatcatgttctttaaactaaaagaacttggagaaatggttgcaacagcatgtgataatgcaaattatttttggcttttatattattttataaatggccaatgagccaggacaacagtgaatttcataggagttcataaaatggaaacacgaactaaaatagtttaccaacactttgggagaaaatggaaattgagttagaatttgaagaggatcttagaagataggtgatttgggaggaagtgaaaagaagggatttaagctggttctgggaaaagaaaacagcttgagtaaagatggaaatcaatgttatttttatttagtagaagataacaaatttaccttgactgaagcagaggacatgtggagcaatcacaggaaaaaaaataactttagagtttaggccacattgtagagctgaaaggcaaaagaacttggacatttacttaaccatattacaagtcctataaaaacgttttacttagtaggagaaattatacaaatgaatcaacctattcaataatacatgaaaatgaaatgactttgtttttaattgacacagaagttttctattaaggtgatgaagtgtttgcacgtgtatgtgtgcatgttcaagtatgtttgtgtgcatgtgcgtgctggagtcatcatttatcacaataaaaggttgcagctacccacctaattaggcatgaagcaagcaaagactggataaggtgatctttgtctcactttgctcctgagacatctttgtctccagtactaatcagcagtgacgcgtcaagtcatcgtgagtgacaattacagtcctctcattacaggaaatgattgcacgactaggcagattgatgagtgtattggtgttccctaagaaactgagctcctccccaccagccctcttcttgacaacattgctgaatattattaaatacatatttaaggcaattcaggtaaagcttcttcacttggcaaaacaggttatgattgcttagaaatttattctaagagcaaaatttaacacatctccctgaattgtatcttcattctgagagtctgtgcttttctgcagtgccttttcaccttcagtttgtgcaacagtacctgtgatggtgtggattaggtgttacattttgtttagacatggaaaataaaataggtagacaaagtattttgttgaagactggttagttggaagctgagtgtcagactcatttcatttcataccttgcacttccagttgcagatacctttaaataaaacatagttcacttcttcccactacaggccaatggattggctctagcccagtggtcctcaaacttgagtgagcataggaatcacctgccctatacgcaaggtttctcgttcattagttctccagtgggccccagttacttaacatttctagaaggctcccagggggtgcagatgttgatgctgaagctgggggtctggagaccaagaaccactgaagcctgtctaaaggggtaacttcttattggtcacatttcattgcccaactgttcaattccttgatgttccccagaagctttcttgcattccaatcctatatgattttgagttctttctggacacagtctgctctgttatctgaacaaacattttatctgatgctttcctttgatttttccaatcatagtctcatggtctatcaccatgagacagggattgctttaactagagaaatgataccaatactgtttgcttagattgattttctgatttactagtattcaggcattaatatgatctggtgcctgcattctcagtaacaccaatatttgtagaaccattctaagtgtaactttgatcaaactaatcagcttggtatttttttcatggatggtccagctgtcaaaatacagatgtgttcattaacctaacgaaactgtcccagtatgaactatgctgattactttgactaaagtcatcatcagattggttcttgggatccttctagtccaaactgctcacgcagggcctaaaataaaatgactaaaaatctggctatctggctatcgcaagtagaacaattggaggctaaaaagtaaaatattattcttatttaaaccatgaacatcattaacatatttattcaaaagttcttgtccaacatctgcaatgtgccaaacacattcttccaggtgcaggaaacacagcagtgaactacaaaatgaagtctgaatttgtagaactcatattctcaggaaggagaaatgataaacagggaaacataaataaacctgctaccttctgaaaggttagatgctatgatgaaaaaaaaaagcaggaaaatatgatacaatgactgggtgtggaagctgatttaggtagaatgatctctgcaggtctccgtgaaaaaggcattcaggttgagacttgaatgaggagaagtagtcattcatctgtatctcagagtaggaaaggtaatggtaagacttggagtgatggtggaggaaaagcttttaagaagaagaaatagaaagttgcaaatgccttcagccagaaaaatctgggaccttgttggctgtggaatcatggtttgattttcttctaagtacatggagaatcagaggtgacataacttgttttctgcttaaaaaaaaaacaacactctgactaatgcatgtagagtgcattgtaggagagtaagactagaccagttacaaggctattttatcaggtctgttttagacattgaccttgaacttgcagctgaaactttttaaactaaaatgtctctaagtatttccactagcagatcctaaattgaataccaggaatttggctcctgcttttagataaaacactgtaaaaggcattctgtccgagaaaggaattgccatctgctgagaagtgacaatgaactgggatggtaccagtacatgtagtgagaagtagtgagattcaggacctattctggaattgtatttgaaaaggctgtctgaaaaaaaataggttcactgggtatagtgggtgctattggtgacctgtccagacccactttgctggctggagagtcatcctgtagttgttgggagtgctggctggcaaaagcttacagctgcctctgtcaatcactcgtttccatctgaacaacatttttgccattcccccctcctcccatccatcttctttcatcccctttctccataaggcaatgtttctggaagtgtggtcctggaaagagtatcatcaatatcacttagtaacatgttaatactataactgacaaccggaacaaatatgagatatatcaaacagaaaaatacaaagattaaagtttgaggatattccagaaatgacaatttttgcgcatatatatatatatatacatatatatcaatgaaactattttaatgaccataaaaagtattgcattgtaaagaaaatttagttttatacaatcaaattatcaaaacttatcattgaatgtgtacagtaactgttaatgccttaaataccattgcttcctttcaaacataatttcttgtttttcctttagtcatgagtttagtaagggaaagtaaatctcacatgattatttttagaaacatatatacatagtaggagagcagagacagagctttactataaggtattgttcacttgattatggaggctgagaagtcccatgacacactgtcttcaagttggagacctggaaagctattcatttagtctgaaggcctgagaatcaggaacattgaggtaggagattgatgtaccaacttgtcagtcaggtagaaagaatcttcaaccttcttacttctttttgttctattaaggcccttaatggattagatgatgctagcccaattggggagggtcatctgctcactctctccaattcaaatgctaagctcttctggaaacaccctcatagacaccctgaaataatgtttaaccaagtttgtgtgcatcacatggcctagttgagctgacacataaaattaaccatcactcttacttaatcagaaattctggagatgatggggtccaggactttgtgttctaacaagccctccaggtgattttgatgcatgctcaagttgagaaccattgaaatagagtggtccctaataagttatttgaacaaaaatctcctttcatgctttcctaacagggacctgcaacctaggatccaggaatgaaggaaaaaaataattgagggtaattcctaggtttttgtctttagcatctggcttagtttcactagctgagatgagaaaaacttgaagagaagcaagttcggagaaatcgatcattctattttgaacttggttactaatttaggtgctttttagatttcccagtgggaatgtcaagtagctaatcagatgaagtctggtattcatgtgtaaggtcaggatttgagttataaatgttacagcctttactgtatggatagtaagatttaggaagaggtcctagagaaagaaaagtgtatagcaagaacttgtatctttttttgcatatatttgaaacaaattattagttaaatgtattaaaaatacaactagactgtgtttatgcaaaggattaacaagattttgctaattactaaagaattcaaggatgatttagctttaagggtatatgaataatttttttacctttgttacctgctaagtagagaagccttcttccagaagatgacatctatacctacctatatttggatgctagagaagcagaacctggtgaaagctcaaggcaggtctgatccttgcatcaagcagagaaatacaaagattgaagtttaaagataccctagaaatgaccatttttgcacaaaattattttaatataaaaagtactgcattgtaaagaaaaacataattttacacaaattattaaaactcataattaaatgtgtgcaataactcttaatgccttaaaccccgttgtttcctttcaaacataattttgtatttttcctttacaagtgaaagtaaatctcacatcattatttttaaaaacatatattgtattcagcatcttttcatcactcactgcctattaaaaccccactaacaattaaacacatgctggtcataattgtgtcaactgcttatgatgccaaatttaacccagttgtcaggagcagattgctagaacacatattaaatattttcctattatttgaggactagcaccagaaaagaacaggaaatatgtagggaagaggggacccactgtgggctgactcatttttcagggggtgagtttttatatacaactttaatcctccttagaaaattattagcatgatatagtatgatgctgataaacatcgcttttttgaagtcagacgtaatgacttaggtctactatctaccaattttatgaccctaggcaagagaattgatctctctttgcccaattttcttgtcaataatgtgaacaccccatagggtcattgtgagaattaatccacataacagagacaaaatacatagaatattgcttggaatataggactggtcagataacatcctcacctccatatctactgtgcccaatctcctctgggcttcaggaatgcctagttaggcaaatgcatcattagatgaaccagtgtctgttaagaaggatgattgattgatagataggtagatacatagataggcagacagacagacagacagatagatagatatagatgtgagctgggccctgggtaagcactctttaagagggttaacctccatttaggaaaatcatctttaccttggtctcattaatacatgatcctcttgtatgttttccacacacatagtaattggccttgtaactccagtattaccatgtgttaaattccaaaggagtttgcaaccatttcctcagtgactcatcatggtatacattattttattcatttatctaatatatgttgaggtcataccatatgctggaaatcatgctggattatgtagatcagtattatctgtgagttacaaaaaaagaagtgacacaaatacatatgaactagtacaaagataaagagatctatgtagagttaaaactaaaagtcattctctaaagactgactatattgcttcttttattcatgaccagtcttgtgaacttagagaaaggtagggcttcctctttgatgtttgtcacccagtgatgtcaatgagtgaagatctgattttgaccatcaaaagtctctggacaagaagttctgaatgaatggctctggatttgtgctttatagtcagtatagtccatgaaacaactatgggaaatattctttggtaaaggaaggagaagaatttgccattaaagataggcagttttctgcctaacacaatgcaaagacctgtccaagaggtattcatctgtgctaacatctgacctccgtcttgacaagatgtcagtgaaaaatgaactcactgagatgcatttcagatcccttgggaaaagacagacagagagaggacaaaacataaggtttaaaagcagcccttaggagagatctgagaacaatttccaagaatattttcccatgtgttaccaggaaaaggcaatacatcttaaagaagactgagctgcccaatcagcttacttcacttcagtgaactcctccctgagacccctgtagctactctcaaagctttatattgacacaatttaaaatgtgaaagatagtaaaagttaatgtaattatcccactggatgatctcagcaattctcgatcaaagagaaaaagccatcataatgcaatgcctagcaatggctcaaaagcacagccatggcccccctgagaggataataatgatcccaatagcaatacaaccagatctcttaggaaaaagaccatgaaaacctctaaacaattagaggctgcaaacctggcaccagcatcaggtaaggcacagcctcctgaaaacagtgggaggcctcagggatcatgcccaagttcaaggtaccatgtaaaagattgctcctccatcatagggcatagaatagagccatgaacattaactctttaatagaagttttagaagaaaaacttcaggcaaattaaatttaacagcatttatttgagtaaagatcaagtcatggatcagggcacactcagaaactgaacaaggtttagaaagctctgcttcagcagcctgagaagtcaagtacagacattacttgattggctactgctaggtatttaccttatttgtgtgtgatctgggggaaagtccctccttagaggttagtttgttgtttctgattgattatacttaagtttccttttactgtgtacatggagcttcagtgtgcttatgtaaggatccaaggcactggggttgcctcagtctaatgttcttccagttttttgtttaatagaagcaatggtaaatggcatagttaacatctatttcagttttcctttacaaggatttcattgatttccagcagttaatacattcctctacactatgaactcctctcacaggaagcatggaccaaagaaaagtaccgttaaatttctccttatgggctacagtactatgaaagggaaagagtttaatgaagaagttctgagcctcaaggaattcagcttcagccaggcatggtggcacatgcctgtaatccctgcactttgggaagctgacgcaggcagatttcatgagctcaggagttccagacgagcccgggcaacatggcgaatgctttctccacaaaaatacagaaattagccaggcacggtggtgccaaaatgtattgtcagctactggggagtctgaggtaggaggattgcttgagccagaaggctgaggctgcagtgagctgaaattgagtcactacactacagcctgggcaaaagattgagaccctgtctcaaagagaaaaaaaaaattcagatttaactgcttcctcctcctcttctatctcccccttctgccactccaaacacacacacacacacacacacacacacacacacacacacacacttggggatacttgtcttggtgtctctcgcagagattgggagctttcagaaatggtgtgtcaggtctgaccctattctttttaaactaagaaaaaggagaatgttgatgactgagcttcaactggaaaaagtagtggtggagaaagacttccaacaggagttcaataaccatggagattatgtgatggatattcaccagaaatctgtgcaagaagtggatggttcaggcagggggcgagcacatggagctggggctgtcagtgcaaatatagggaatatttcatggattcagactcactgtgcagtaagaagtcagcctgcctgacttcaatatgtaagtgttatgttgtggagtcctgaccttacaggtagaatgaatccatttttaaatggaacgctttctactgagatgggctttcaatttggagcccgttgttattctcttttcgtctattccttatgtaaaatcccttcctgtaacatacacctagaaacatgttttatattctcaatttagacttggtttgaaagttttgctacttagccattttcttcttgtattaatctctgtgtttcacacttatatttgaatttacatacccagaagttaaggtcaaaatgttggacaatctgtaaagcataagcactgacccattagaatcagcatcagccattgtgttggagtagaatctggaaaccaccttgacccattggttgctggattttcaggtggctcatggagggatgagtgtgcttgaacatcacaacactcaagggctcagaacggtagctatctgatcatcagaacaaatatatttcattattttagcaaacagcataataatgatgcattaagttactcagttggaaatcataaagccatcaaactttgcatctgctagccaaacgacggttctatgagtatataaagatcgtaccatcacttcgtctctgtaaccacgttccctccctccaagacacatactcccaattgggtcaattcttcaattgagactaaaaatacaaaaagaaaaagcttgatacatcctctgactattagtttcctggttagaccattggatcaaggtttattactccaactacaaaacagttccttccactggctagtgtgaagcaatctgaaagagacgtaccctagttgaatggtataacttaaggatttattagccttgtaactttgagtaggtcacttaccatttctctcatctgtaaaatatgagtaggatatagtaatctctggtttctccagttttggtattttgaatctagttgtatgaattgacatcagtttgtgcctattgattatttaagtctgataaattacctggacatagtaaaaccaggaaggtagcttttattctgtacttcagaggaaaaacaggaaaaggttcattgatttgacttttctaatttttttttttttttttttttgagaaagattctcactctgttgcccaggctggagtgcagtggtgcaatctcagctcactgcaacctccgcctcccaggttcgatagattctcctgccccagcctccggagtgctgagataacaggcatctgccaccatgcccagctattttatatatatatttggtaaagatggggttttgccatgttggccaggctagtctcaaacttctgaccccaggtgatttgcccacctcggcctcccaaagtgttgggattacaggcgtgtgctaccatgcccggccgacttttctaatgtttttgatttttacttctcatcaccaaattaatttatgtcagtaagtagttacttttgggacaaaggacacacattttggtggtttaaaataatgcattttggaatcatatcaaactttcgtatttttttcccatagaattatttggatttttatttacttatatttacttaatgtaagtaattggagtaatggctttggagtttcgcatgtttatttacagttgtcttcatatattttatccattaaaatttatcctgtcttattgattgtagtcaggctctgactttactaatattttttcacataactatccagttgacccaacaacatttatggaattatccatctttctctaatggtttaagataagacatatttttccatttatgttaagtgatttttagacttttaattcagttccatttatccatgtattcgtgttcaaataccttgtttggcaacttagtgtaatctcagcacattcagcaacttctttatgattcagttttcttatttttaaaaaggcagcattgacagtgtgtacctcagatgttgcaaacatgaaataaaataatgcccatctaaactctcagaaaatcttagatattactgagcctgaaacactattattgtattttcttcttcctgctgctgaattccttttatattttgcaatcagtttcaacctactctgtgtgtgtgtgtgtgtgttcgttctaggaggtatgtaaacagattcactaagttgaaaatcatatagttgggaaaaggctttctcaggtttttctaattcccagaattagtactgtccagcaggaacctttattctacatagtatcctttctactggactgctgtttccatctgccctaggtcatgcctacctcagttaattatgtgttgtttccccttgaaaatcagcaggaatgcctttcctgcttaaaacaaagactgattccctgccagtctctttcacaaaccttgccaacagtggatggaattgatcagttttgtttctccttctctaactctacagggaaaactttactcataatcatggatgggaatagtgcccctagctgagcagctgagattaaatccagcaactgttaacctggtatagggcaagaagagagtattggaaacaacaaaacacaaaaattcacaggcaatatagcatcttttgtacctatttccaaaacagaatctcagctttgttttaataaagcatcattggcaacagaatatgccccgagcaccaaagttcataaaaagtagcctttataacatgattatttattagaatgcttcttcattttttagcacagaaaatctagcatacaatttcataacagacaaaggagccaaagggacatagatttcttatgtactagctagtgaaatgaacttttgatttcagtgttcacatttaggaggcttagcagagagagtacatgggcttttccactttactggattttggaggtaaaaaagaaaaacatccaagcccagaaataatgtcttataagccacgacaaaaatgccccaggtcatgagagaaaactattgcttctgggtaaaataaaattggaagcaaagagaactagaggttacagcaccttgatagttggtggggttcgtatgattttgagtcttcaaatcagttttggatggtcaagaagtatttttttaccatcccgaggctgttaagctacagatttatttctgcatttctacttataccctatgaaagtagctctaacatcatgtgcccaagggcagagcttaaaggaatattttctgtggaagtggaataatcagtcaaaatttggaatcactcccagttcttcggaagtaaagttaattaatctggaagcacatcgtttgtgtataagaaattcaagagcagcataatgagttcagcaattagctttaacttttcggaaacatttctcagaaatatatgcattgaagtctctcccccaactgtatttttaactggtgtattacagctgatttttaaacatgccatcccattggttgatcttgtcatagagggaaaaatccattattagctctgcttgtacagtaaagttctgctttattatgtaatctcatttctgatttactatttgctctaagtgaacgtatgactacaatgtgtaatgaacattgtgtagcatcttgaaaagacaaagattaatgcctccttgacagtttttttccccacttattccttggggaacacctattctacttgtcctgtaactggaattacacattcaccccccagtaatttttataatgatttcaccaaagaacttgaataaaagtagttcaataaatgacactgtaatacatatactttggagtcctattgtgtttttctaagaaaatgtaaaatcatatttagggtcagattttattttatgtgttattgaatgcattgtaaatctagagggctgtttaaccaggttccgtcaggtaaattaattaccaccacaactgggtttaatttgtctttttatcttttctgtattaataaagtcagtgttttacagcttcgatattacctttttgaaagttcttatgtttctattaatgaacaattaaacggtatttgtattcttcaaaattgctaaaaagtcagtaagtagataattataattaataacacattcatagtctaccagtatcttacgatgtatacttgtctttttcttcaaagtgaggtgacctcaccaaaatattcttcacagtaggttgagaatagaatttgaaacttacaatatttttagctcttttaagattatgttgctctattttatcctatttttgtatctcattcatggatcattcttggtgtttattcaattttagtcaaatttattaaatatgatacacattttcttaaaagtgtttaagacttactccagaaaatagtttgtcataaagcgaaagagtttttcagacaatagaattcccaaacagcctacttaattctgtttgtgaatgacttgaggcatcacatgaaaactgcaataaaccacagtctccatcactcccttttctttcatactgagtttgtaatctctggcctccagaaaaatatttggttaaaaatctagtcaaaaagtttgtatgttgtttccctttgggttattccatttatcatttcctgaaaaccaaaattcccttagccctcctagtctgctcttcttttccaaacaaatagcaaattgagtttaagaaggagcctgaaatgaacaatgtcaagtctaattctgaagctcagctaaagctaaatagacatgctagaagagtagcatccatctgaaatataattattgagcaccttttccatgctagaccttattctagctgctggatattgaaagaaatgtaaatttcaaaattatggacaaggatatgggaattgctgtttaaacaacctttactgcaattatgatcttaccagtgggttttgaccagacaccagataatcatcttataagttgagacaggtgatacttcactaacttactgtggatagaacattgaatatagctttatatacatgaaacatacatataacacaagcacacatccttcagctattcaaaatagattttatttttccaaatttcaatagcaattctagtacaagtataatacaagtttaacttaaaattggcatcctatctaaaaggctgaattataaaaataaattttggtaacatcttcagtttatcttactaggcttaaaggcatatcaagagaagaaataaaaatcaatgtattttatttctaggattggtactattattgacacaaggatattgcatcaatatactctctagctatcatttttattttttgcatattactttttaagggtggcctgtgaaagcaacacgagattcccaaattatagacttaaaggtttactttaaaaagatgagatgattgttatttaactttcatccatctgtttctctttaaaaaactgcatttgcagcaaatcaagagtaacacgattttgaaaactgaaaaacaaaaaacaaaatatctgagcagccaatatactttaggataattttctaatgttctatgaaaataggtaaatcaatacaaggtgaaaatgttttgtttatttctagagatgttgattatgtatcaaacccagtttgtccatgaatgttaaatagacacttaccaagtgtctatttggttaaaatttggttaaaatttattttaaccgaagaattcaggagacatcaggttattatttttatgtagttacagtgcttagatgggcatttgttgaacactggaaacttcttattctccaagccacataaataacaggcatatgaacattcagataatatggatgatagttgccattgttgaaaaatcagcatttattaaattcttactatggaaattacatatttagtatctcatttggtctacccagctgcagtatgaagcaggtactgttagtggttccagctaataagtaagtgattatagaaatgagtagaggttattttggcgatttttctatagttaaaatttctacctcttgacataatccattcattttcccccaaagtttctgccttgctttcctcattttataatataatttagcttgatttttatattaattgttcaattccactcctaagatcaaatgttagggtgggacaacgagacacagtgacagggagtttgaatagagacaaaagcccttggaggggagagtatttaatttgcgaatctcatgttgctttcacaggccacaaagcagatggtcaggttcagaagtttagtgcctggcacagagctgggcacaggataaatcttctgtaagccatttcaaatgaagaagtgaataaccaaatagaagaagtcgtaagaccatcctgtctcaaaatagttggaaagcaggctgaaggaggcaacattagtttctgttcattacatgtttgttacaatacagcgtattgaccaacttttcatactacattaaatttcacaaccattttatgaaacggtacacttttcaggtgtgaaactagcagaaaaaccagatgttctgatttcatcaggaaaaccaaatagatggatttaatccatggtagaggtgaggttgggaggtctccaatgatgctgtcacgatttctctgttctctgtttacctccaggaatctggatgattgacacaggaaacaagtaatttgcacacaatagtaagtggcaggactctgaggtcctggaaacagagtgtctgtctaatgtttcactacttcaggctctcactgttcctaggtcagggaccaagaccacaggtcttgtgagcagatagggtagagataacccaacatgcaaaaatgatgatttttacaactgatgagcaagatgtcgcagacagatgaagcctgcctgcctaacttcggggtaggagtcccagccttcagggttttgtgtaaatgaggagaggcaggagtcatagttgatattcaaagcactaccagcaaagaattttggtctcaattcccactctacagatcattagccactcagtttttggcaaatagcttttcttgacttcagtttactggtttcttcaactgtaaagtaggaatgttgaacattaggctatatggcagaatgaattttaatagatgtcataagtatagatgaggctattttatctgcttgatgtctgtaatgccacatcccagaccactggaaagcacagttaacactgcaaatatacaagcagttttgacttcttttgattctattttgcatcatgaaggcaaagtataacctctcatttattcaaggcccatttatttttttttattcagtgattgggtaaatgcagatagtttctaaaatgcctttctaattattggaggaattatttgaaggtttggctgggtatttctgtgagacgagatggggaagatggagatagaggaattaatatttctcaggtttatgaaaaattctaaatgaagagtaaacctaccttaaagtaaacctaccaggagtaaacctaccatgaagattgtgtggacttccctctctccatgttttcctcttagataaaaaaatattttgaaagtaagtatcaaatcatttaataattaaccaggcatccttcatctaaaatagttgatttacttgctagactcacatgcaccctagacatgccacaggtaactattcttttctgtttttaactgactgtgagcttgagaaaatagaatcgccttgtaagcacttgcttgtacagaagttgtttattagttatccatcacagaaagcccgccagcagggtttggggctatatgtaattccagaaaagaaatctttggtgtcttcatatccaaaggtgtttccactgacccattaacattgggcatgccttcagagaggcctcccaaggactgactgtgtctgtgtttgtcagagaagagataattggcccccacaggaatgagagccatgacctgagcttcctaagtgaaactgtcagaaaagcttccagggtcagacctgcagtctaagcagcctctacactctgttgctgacagtggaatcaagagttatgttgcataaagtccttgaaaccaggtgaaccacaagttctgggtgtcttcggcttcttgtaacactatagggagctcttgtgtgaatagcctaaccatcctcatctgttctcagttctcctgtctcccaggttctagtgctttccagcctcccgatcagtccccactatttccagtttctatttactttttctccttatcccaagttttcatttctacttagagcatcttcaacaaagtatggcacttccaataatttgatctgaatgcggagtaagacttagggtaaaagagtagattgttttgacattacttattttctccctgtattttctatattcacagatgtaatagtaaacaaaacgtcttaggtttccgtatagctttataaggttttaaaatgctgttttaattaataacataatgccgtattttgtcgataaggacatgaccgtgatgtggtacaaagactacacacatactttggaaacaatagttgcaagttcacttctagctttaccaagtatttgataccagagagaaaggcaaaatgctcatgatccactctagcttcagttttcttatttgtaaaatagaaataatcacttgtaccttgcacagttaaagttaataagcctgagcaatgtgatattgttagaggggcatctacataatctgcccaaatggtcataaggatggtgacaggtgacttaaaacattagcgtataaattctttttttttttttttttttgagatggagttttgctcttgttgcccagactggagtacaatggtgcgatttcggctcactgcaacctctgcttcctgggttcatgcagttctcctgcctcagcttcctaagtagctgggattacaggcacgtgccaccatgctcggctgattttttatttttagtagagacggggttttgccatgttggccaggttggttttgaaaccctgacctcaggtgatccacctgcctcggcctcccaaagtgctgggattacaggcgtgagccaccgcgccccgccattagagtctaaattcttatggtggcttgtttaataatgaataaaggtgattatgattcaattcaaataacacaactccttgtttaaataatttaagtcaatgtctgttagaaatacagttgcatgccttgaataagtaagttaatttaaatacgtgtgtgtatgtatatgtgaatatagatagataatttcattattctatttatgaagatgtctttttaagatgtttatggaacttaagatgatagaattactcttcatagctaattaagagagcaaggccgggcgcggtggctcacgcctgtaatctcagcactttgggaggccgaggcgggcgtttcacgaggtcaggagatcaagaccatcctggctaacacggtgaaacaccgtctctactaaaaaatacaaaaaaatagccgggcgtggtggcgggcacctgtagttccagctactccggaagctgaggctggaggatggcgtgaacccgggaggcggagcttgcagtgagccgggattgcgccactgcactccagcctgggcgacagagcaagactccatctcaaaaaaaaaaaaaaaaaagaaaacaaaatggcaatatatattatgaattcactacaacttttaattagaattttgttagtcataatggaatctttatattcttgaaaaatgatctgaaacgtctgttttttgaaaagcatgttaatagctttgttacaatagtcagcatgcatattgatttaacgactcctttgcatgactctaaaacatgctccatgtacgcaccagagttccctccttggcccacaaattagaagtaactgttatacaacaaattaggtatgaattttcaatatgaaattccagtgctccttgacaattctttttctctaggctatgagtgtgggtctcagctttaagctgatgggttaaattctatatgtataagcagatccacattctcttcttttagcttttctgcttcataagtattttgctgtttaactgatccatcaccattacatgtggtttacttttccattttggaaaaaaaatggtaaaaaaataatatcatgtatattccttcttaaatagattcaatactctggtaaaaacaaacactaagtaaatgcctaatggcgtgaatctgagaggagagtgcttttagtaaattcaggctgcagacatgtttgggtaacattttgctatccttgctctaaagatacatgctaatggatgggcaagagtagcattaatgagctcactccattaaattagttctttttttcttgttaaatatccaaaagagaaagatggtccacttaactagggaaaaaaagtttcattttagtgcagtagaaaatatgatgcatattttctttctaatttaatttctaaccattaagattcaattgtacaaatgacccactgaagcacttggagagattagaaaactataaactgaatgtcatttgaatttggctgtctagacaccatgatgttatatagggtaattcgaatttaacatcatatttttatgaggccaccaagataagcccagtgacttctgtgaataatcactaatgaggccctcaaatggaatgtgagaattgatctcttctctggtggttgtttttattaaacaccatattggccaacccttccaatcactgtgatttgaacttttgtttgaatagtcaagttttctcttggaattgtagaaaaaggtcgctgtcagtctgtgggctgaggaaaaaggattacagctctaatgagccaaatctgtgcaaatgagaaaataataatctcctcataattagaactccctttttaaactaactgttggtcgtgagtttttcaaaagaagaaaaatcatttcattatttggttaaaagaatatttggaaattaatgccactggaaagggggaattaaaatgacttcagctcgtttacccaaatatgttcattgctggaacctcatcctgattttctagtcaaaacaattattgttgttttccatgaagtttagatagcgagaatcatgcattgtctgttcatgcagtagttgacatttactgcatacagcaatcactttcagtctttctgaagactgcgctgtaggaaggaaggctagcacgcccattttacagatggagaaatggagtattgctttctcaagcctcaaagaaattcttgaaatggtattagaaatcaggactgtcagctcccatgctcaatttgtagatcattgtaagcagcagcagcagcagtaacagcagtactggtagagtaaatcgagaggagaaagcatttcaacaattccagcagtactcagttaggaggagattttatttggaactcacaacacacagaagcatgtgtctacttggttgtgggtgggtgctcaggactgccctaggatattaagacatattactttagtagaggcatacaattctcccaggctttcctagctccttttttgagcttctcctggcattgaagggtcttctgggtcccccgtgtatctgcaacctgacctttctgaggcttgaaaccaagagagtttagaagccaacctgtaattaaatagccatgtggaaaaccatgctggaaaaggcaaccccatgggggagttcaaactgaaaggaaaaacagtgaaggtataagatgtgagccttcttgtatcccttctgtggaatgtcacatcacagtagaggaggattccagctgaagagtgggtcatttgtgtgcaggcccctggaatggggcagcaatgtttgcttgcttttctggagtttcagggaagccaaagttcaaaagccaaggactttccatgattaaagttccattctcaagaaagcaccactatgcattaatgtcaataagtcaccatgacaaaccagtaaaatagggcaaatataatcttacttttcatatattagtgatgttaaaaaaatggcccattggctcatgcctgccatcccagcactttgggaggccaagatgacaattacttgaacccaggagtttgagaacagcctgggcaacatagaccctgtctctgcaaaaaaaaaattaaaattataatttaaaataatggcccatagtggtaatgtggctgtccctaagatcacaaaactagttgttatgagagcttgacttgctaatcctgttatctgatgctttgttgaggactaatggtggattgatcctgtagaggccaggggaagactttctcttcaccttctgaagtttcactgagaaatcaactgacaaaaagaagattcattgaaaaaaaggcatacatatttatgaacatacacatgcggaggaccacagagggattgcttctattccccagtaggattcagaagctcgtatacaatcttgaggttacagcaagaatgggtgcttggatcatggcaaaataggctatagtggtaaaacacatgaggggaccagggaagaggaggcctggatagcaaaaggtcttgttttgcagatgagatcaaatagatggtgaatgtttctttaagacctttaaaggtatcagatattcagttaatcttttctaaatctggactagagaaagcctggctccatcaatgcaggttttctctacatatgctcttctgccccatgaagacaattttcaaggctacttctgtttgcaggccctctgaacagccatctcaaaacaggccaaagtatattttggggtaaattattttggtttatttcagttcctactttgaaacttcaaaaaattacatacataaaaaggcaaattggtagctttggagaaatttgggttagaggttcttagattagataggcaaaggaaggggaagacaaactaggataagcaaaaagataaataaataaataaataaatacattattccatatcatcttgaatcagttttgtagtccagagagtagatcagctacagctgttttccattctagcaggtgcattgccaatgggctagacgtctatataggatgcagcaaatccatctctaataagaggcatttctatggaaactaagaaaaacaaaggttaatatctggagtggtctgtagatttgtttttctagagtgtctaatgcatcttcagatggcagtggcaatgtttctggattgtagtttaaatcaggtgttcaagtgaactttataagtagttcatacatcagctggcacaaaagctgcttatatataagttgctccggtgatttctcccaacatttatatcaagttgtgtagcttcagtgtgcagagcttcaagaaaagcacagtttttggttttaagtgattctaaggcagaaaaatgggagaaaaatttgaaaacattagtttggacacttgtagccaggaagtaattcaggattcagttcaaattatagacaaataaaaaaacctccaaaacaatgggcagggctagaatctaaaaacatatgtactacagttttcttttgaaacataatttctcctccggttccccttttctaccaaagacaaatcatgtgtagtaagaccatttgtttgcaaaataaattttagtcttagaatactcagccttattatttgcatagagtatagcaagaatagtgattggccatataggttctttaaaagttggctttgctagccgggcgctgtgcttcatgcctgtaatcccagcactctgggaggctgaggcaggcagatcacgaggtcaggagaccgagaccatcctggctaacacggtggaaccccatctctactaaaaatacagaaagtgagccaggtgccaggtgtggtgacatgtgcctgtagtcccagctgctcaggaggccgaggcaggagatatacctagaacctgcgggcggaggttgcagtgagctgggatctcaccactgcactccagcctggatgacaaagcgagaatctgaatccatttcaaaaaaaaaaaaaaaaaaaattttggcttcactgtgactttttcataacaaatctcaggttagacttttaaaagcctctaaagtctataaagccaagctaagtatttggcatcagactgtgcccgtaacacttacatgaattgagtgaatttctgttttctagaggtttcaaaatatcttgaggttcctgggcctgtcagaaagtgacattcttacttgcaaggtcaggaaccttgtacggaaacaatgtagacaaggtaccaggccagcctttccaaggagctttttattggctctataaagtcaacttcaattcctcaaagcagtctggtcgtatctgaaaataagccattacagtcaaagccattaccagtcaaagccttggtaaaataactagtacccacaagtgtgtcctcttacagaagaaactgattcttgtggaacctatgtaaacaacgatattaccataaaataggaatgttcatgaatagtttccaaattttggagaaatcatgtagatagaagggtaaatatttcagttttgcccacaagagtatagagcacccaattgttgtaagctataaagaaataattcttgactctggaaaacaaaatataaaaaagaatcattaatattccaaacaaaaatcatttaaaaaaagcgtttaagtcctatgtcagttcaggaccacgtaattaacttattctgcttgctgttgggttagcaatatttatgattacgtcagcttttaaaatagagccctggaaggttttacatgggtctaatgacaagatctccaaagttatcagaagcctgtattcaagagtatttcagggtacattctgtaaaatttattgaagaagcaaattttggactgtagctgattgtaaatggaattttgagaaaaattaaagcaataattttctgtgaatgataaaagacttagaatagccacgggtaaagatacaactgacaaggaaactttgttgtatcatggcatacgacaatttaacataatcataattgtgactgataacatatcagaattttaggaatctcatacagtattagaacacattaataacatgtttatagaaatataacttgaataaagttaactccatattttgacaatgctttccatatgatttttacataccagataaacctcgtatgttcctcttgggcttccaggagttctttttggaatttccaaaagttaattcaaggtcaaaaagacaattttagattcgaaattaaatatggaagttcgtcaaatatcaaaggtttaaaacacttcatatcaaaataaggaaagttaaaaatacttgatgaaaataggatcaccggtcactgtaaaataatagttaatcatttagctaaagtgataattaaaaaaaaatattccggccgggtgttatggctcacacctgtaatcccaacactttgggaggctgaggcaggtggatcacctgagatcaagagttggagaccagcctgtatgctgaaaccccatctctactaaaaatacaaaaattagccgggcatggtggcacgtgcctgtagttccagctacttgggaggttgaggcaggagaatcacttaaacccaggagagggaggttgcagtgagttgagattgcgccactgcacttcagcctgggcaacagagcaagactgttgtctccaaaaaaatatataactaaaaaaattaaaaaaaattcaaaaatcaaaaacacttactcttttacagagaggagaatcaggtttccaaataatcaaaagatggaataaagaaaatatgagatcaacggaatctttcccttgagttcttccctctcttttatttctttagtttacttaaaagatagatagaaatattttactatgtcttgttaatgctacacaaatatcttgttccaaggagaaacctaaattctacctttccatcagtatattattaatgctaaggctaattttaataaaatttatttcaattagctttgaccagagaagatattcataaacattttataacctcttacaatttttcctattttctttctttccctttttatattcatccagtttcatctattctttatttcttaaatacaatttacaacaacttttaaaaacctttagccagaattactattcccttaatgaaaaccacattctcatgctttcttataacatttcttaccgaaaatacatctcacttttcttatacactttgcatacagaattgtttctcttgtatctagtagttttaatcatacatattaatcagtgttgactcccataaccctaattttcagtgaaaacctaggaaataagtaattttaactgtcagtcatgtactaacaatttataaatacatatcgtataagttttaaaagcataagctttctatagaacaatttttctatatggaacaggacatatttactagcagacctacataacttttgtttttaagaaaaaagccaaaagcatatgagcttaaactcatatttagtaattaatgtcttagcattatatcttatttggaaatgatctagatattcaatgattattcatcatttaatttagcttaaactctaagtgcatagttaccaaaaaattttgagaaacctttttaagtaaatatattataaaacataacttttattaaaagtgtatttatgaatgtttatctcatttacagctatttaatctatttttaacaactatgtttggtaaatttcataagacaaatctagccatcatctcaaattaaattttctattaatcatttttgtattactgtctgttaggcaagtatcataaaagcaaggaccttaaaggaccttaaagttagaaacatacatatttcattgataactcagcagacttactttattaagctaacaatattaaactagtattatttaccagaagactgctaaagtaatgcaaacttaaaaagcatttaggtttatttacttaaattatgagtggtcatttataagtcaatttgctaccaggtagacaatatacaaatagacatgtatatacaaaaatacagacataaagatcttatagctttaatttttaaatttttagccatgagtcaggtaaaactcactagtttaaaagggcagttggattaaaactgtatctctgtaagtggaacaacttaaaatttatttcttccacatgttcaaagcctttactaaatttcagagaaaacagggtagcaaatttacatttgaaagcatagagagattttaagctttttcaagaagtctgggtgtgttagaggaagattaaaaatggatgctaaggtaacataaaatcataagaatttatcacagtattttacaaggaaacacacagatgaacctagagaaagttcagaaaccttcacaaaataatgagctaaatgcaagaaagtcatattttggagaccaatctagtttgataggtggctttttaacatagtttccattttctttttttaatttaattttgtattatactttgagttctgggatatatgtgcaggtttgttacatgggtatacacacgttacataggtatacataggtgccatggtggtttgctgaacccatcaacctatcaacaacaactacattaggtatttctcctaatgctatccttccccagcccccaatccccccaacaggccccagtgtgtgttgttcccctccgtgtgtccatgtgttttcattgttcaacttatgagtgagaacatgtggtgtttggttttctcttcttgtgttagtttgctgagaatgatggtttccagcttcatccatgtccctgcaaaggatatgaactcatcctttttttattttatttttattgagacggagtctcactctgtggcccagcctggagtgcagtggcatgatcttggctcactgccagctctgcctcccaggttcacgccattctcctgcctcagcctcctgagtagctaggactacaggtgcctgccaccacgcctggctaattttttgtatttttagtatagatggggtttcattgtgtttgccaggatggtcttgatctcctgacctcgtgatcctcccgccttggcctcccaaagtgctgggattacaggtgtgagccaccacacccgcctgaactcaccctttcttatggctgtatagtattccatggtatatatgtgccacgttttctttatccagtctatcattgatgggcatttgggttggttccaagtctttgctattgtgaatagtgccacaataaacatacctgtgcatgtgtctttatagtagaatgatttataatcctttgggtatatacccagtaataggattgctggatcagatggtatttctggttctagatccttgaggaatcgccacactgtcttccacaatggttgaactaatttacactcccaccaatagtgtaaaagtgttcctacttttccacatcctctccagcatcagttgtttcctgactttttaatgatcgccattctaactggcatgagatggtatctcattgtggttttgattagtatttattagtatttctctaatgaccagtgatgatgagcttttttttttttatgtttgatagccgcctaaatgttttcttttgagaagggtctgttcatacccttcacccactttatgatggggttgtttttttcttgtaaatttgtttaagttccttgtagattctggatattagccctttgtcagacagatagattgcaaaatttttctcccattctgtaggttcagcatgcaaacagagacaacttggcttcctttcttcctattcgaataccctgttcactctgatgagagtttcttttgctgcgcagaaactatttagtttaattagagggaatttgtcaattttggcctttgttgccattgcttttggtggttatgaagtctttgcccattcctatgtcctgaatggtattgcctgggttttcttctagggtttttatggttttaggtcttacatttaaatatttaatccatctttgagttaatttttgtataaggtgtaaggaaggggtccagtttcagttttctgcatatggctagctgattttcccaatgctatttattaaataaggaatcctttccgcactgcttgttttcgttaggtttcttaaagatcagaaggttgtagatgtgtggtgttatttctgaggccagtgttctgttccattgatctatatatctgtttggtatcagtaccatgctgttttggttactgtagccttacaggataatttcaagtcaggtagcatgatgtctccagctttgttccttttgcttaggattgtcttggctaaaggggttcttttttggttccatatgaaatataaagtttttttctaactctttgaagaaagtcaatggttgcttgatggggacagcattgaatctataaattactttgggcagtatggccattttcacaatattgattcttcctatccatgagcatggaatgtttttccgtttgtgtcctctcttatttccttgagcagtggtttgtagtcctccttgaagaggtccttcacatcccttgtaagttgtattactaggtattttactctctttgtagcaattttgaatgagagttcactcatgatttggctctttgtctattatttgtgtataggaatgcttatgattttcgcacattgattttgtatccggagactttgctgaagttgcttatcagcttaaggagattttgggctgagactatggggttttctaaatacacaatcatgtcatctgcaaacagacaatttgcttcctttcttcctatttgaataccctttatttttttctcttgcctgattgccctggccagcacttccaatactatgttgaataagagtcgtgagagaaggcatccttgtcttgtgccagttttcaaagggaatgcttccagcttttgcccattcagtatgatattggctgtgagtctgtcataaatagctcttattattttgagatacattccatcaatacctagtttattgagagtttttagcatgaagggtgtggaattttatcaaaggccttttcagcatctattgagataatcatgtggtttttgtcattggttctgtttatgtgatgaattatttttattgatttgcatatgttgaaccagccttgcatcccagggatgaagctgacttgatcctggtggataagctttttgatgtgctgctggatttggtttgccagtattttattgaggattttcataccgatgttcatcagggatattggcttgaaattttccttttttgttgtgtctctgtcaggttttggtatcaggatgatgctggcctcataaaatgagttagggaagattccctctttttcaattgtttggaatagtttcagaagaaatggtaccagctcctctttttacctctggtagaatttggctgtgaatcctcctggtcttgggtttttttttttgggtggtaggctattaattactgcctcaatttcagaacttgttatttgtttattcagtgatttgactttttcctggtttagtcttgggagggcgtatatgtccaggaatttatccatttcttctagattttctagtttatttgcgtagaggtgtttataatattctctgatggtattttgtatttctgtgggatcagtggtgatatcttgactatcagcttttaattaagctgacttatgaccctatagcgttctaaaagaaattctttcaaatctactgcaatgtggagtagacttcactgtgaatcctgcaggagattctaagtaggctgtctgaatatacaaaggattttaactttgttttaggtcagatttttgctctttaacttggtcaagatagtttctaaggctaaccattacattattatgtgtctttcttttaatttgatcttcccataaatacaaataaggcaattgttttgaatgagattgctaatatgtgtatgtgtgtatatatatatatatatatatgtgtgtgtgtgtgtgtgtgtgtgtatatatgtgtgtatatatatatgtgtatatttgtatatatatgtgtgtgtgtattatatatagttttaatttaggcttctttttaatttaacagattcaccttttggtcactgatgattaggatttttactggtgtacttgttctaatagcagcctaatagccttttcatggaaagcccatgatgtaattttccaggtataaaataagttaaaacgggtttaatggagagggcatagagggaatcctaatgatttttcccccaaaaaattactcccagaagtaggctaagattgccaaagtcttctgttgccacagacagttaagtatggcatttgtatgcgtgtagcatctctgataacctacaaatttgtggagtgctgccactaatgaaaccgctgttgcaaaagtatgacagtaagagaaatttgacatggctgactccatcttgcttctagcacagggtggctgtctttgctcattcctaggcatggaccaagctaatttgggaagaaatttagtttatagttaaataatagtgttatgggatctttggggtgtcattttcatgactgtgaagctctgtggccggtggcacttttgcccaagttttgcttaggcctgctgggctcattctgcccattcagcctggcagacactgctcagctcacactactggcctgaaccccctgcctccaagggagactgtgagtcaggtagggagcaccaaggggtgtgggagtgagcatggggtccagccactgcacacagtcagacacaccagctgctgccatggggcaggaagctccaggtgccagcatgggcaccggtactctgcaaggctgcagctggaccaggtgcaccacaggcagtttccccagctggcactggggaatgtggtgtcacctggaatactggagatggcaggaactgcagtgccccaaagagggagatacagccctggctcttgaagctcccaggtctgggatccccaaagggtcacagctcttctctacttccctttgcctgcaatgtggcaaatgggtcatatttcaactgttagtgttatagctcttttagcctcgccatttgttggttcccaagttctcgtcccgcaaccaggaagaataagttgcgcagacaagtggagggtgagcaagatgaaaaggagttttattgacaatagaaaagctcagaggagacccacagtaggcagctcctctttgtagccagggtgtcctgataactctcagcagagagggtagctcctgtctatagctggtcgtcctgttgtctgctctgctctggttgagcccagggcttttatgatcctcagagtggaggaagtgtgcctgcattggtccatgggtggccataggtgggcctggaaaaggcaccacaagtttccactctggtcacaggactggcagcctggcctccagccttcaggcccttcctggcttgaaggtggggcctcaccgtggacccacccccttctgcccaggagcctgtctgcctcctgccactgtccatggcacccagactgctcatgccgaggggcaccagcaggccagcaccgagctgccctcagccctcccttggcttcctcccatgctcgtcagcacccaaagtctagagggggccaaagtctgctggcgtgtcagcactgccctgagtgtatgtactcctggctgggctgtgacagcccgggcttggccccaaccctgttccaatattgcagtgggtgccaggagctaggagaggccagacggagagaacagacagccccaagcctggggggtaaaggcggccttctcaggcccccaagggtgcagagtgcagagacacctgggtcctgcgacagggagggcagggctacagccccagccatgactcctctcagcctggggtgggggctccaggtcctcactgggcccctttctgtccgctcctccaagcccgaccacactgttcccctgccagtgggcgacttggcctagccccatcacagtagctctcagggcagcaggctctcgggggtggggctcccactggctccggggagtgctgcacgagctgcggcccagatctgcctcctccttgcacactccctgcaggtggtgggcaagagtggtgacgcaggaacagagtccggagtggtggaggctccaggcctggtagcaggtcccgtgggggtgggggctgtgcagtcagctgccttggggacatggggcacaggggacccatcagtgccatttctgctcctgcagctgctcctgccaccaccactcgcaccttcccacagcagctggagcgatggcagccgctgctctggattgcccaccactgccatctacagcccttcccaaaaactaaactgttgctgtgaaacgaatgaaaggccactaagttagaagggtgagaacggctttaattctaaataataccagccattattccggaggccgtaggattcacaacttccccaattactcttgcagataagatcactgttgtagaatctaagattggccttttgagatatcttttcacatttctgcagttttgacaaccagacggtcccaccttgacctgccaatcagtcccgtgccccaccccccacccagcaactgactcagcaaaataggacagcttaggttcactatgatttcatctctgacccaatcatcacgctccctaccctagacccctacccaccaaactatcttggaaaaaatcttaacctctgagccttcagggagattgatttgagtaaaaactttgtctcccatgttgcatagccagcttcatatcacttaggctcgctctttactgcaatgccacggtctcagtgagttgactttgtgcagcaggcaggaagaaacttttgggcagttacagtcacagatctgttaatctatgacataggataggcctcccgggattggacttttccagcactaaccagacaacaaaggttgacatgacaaaagccccatagggatgagacttcttcagatgaacacctgcaagaggtttacacattcaggacaaaaagtgtgctgcttaaaatcttatatatcttgggttctcaaccattttcagactggccagctgacacgacctcaaaatcatgcttcaggcccaatcccaacccctccacggtggaaaccaagagagtgtgctcccacttggtcaccagtcaacctctcagtgacataaaataagatgagaaagaacagtgtcttttttttttttggctgcccacagcaaagtttatagatgctggtatgatcagaactgcaaaactgaacagtctgtaggactggtttgaataacagacttatgggggttttaggctcacattctaccctaggctacccctctttttttcctttagagatggaatctcacttttgttttgcttcccaggctggagcacagtgacatgatcatagttcactgccaccttgaattcctaggctcaagccatcctcctaccttcatagctgggactacaggtgcacaccagtgtgcccagctaatttttaaattttttgtagaaacagggtcttgtcatcttgcccaggctggttttaaactcctgggctcaagcagtcatcctaccttgacctcccaaagtggtgaccctctttgtgacaaaacaacacagaaagacaaagacaagactatttctaggaggaaagggaccaaaaatttatgaatattcatagcagaaggtacacgagttgctacatggaagataatcactcaaattcttttctctcattaatcaagattttgcagagcaaaaagggacaattatttttttccctctgcttgactgaatctctgtctactggtatgtcaagtcctgggttaccttaactgtggctttcagaaaagcacagctttggtatcatgctcatagtgccaaaactgtagggccaagggaaaaacttttcctttgccctctgaagtttcactgaaaaatcaactcatataaggcagattaataaaaggcatacatattcatttacaggaacatgggagaggaccaaagagggattatccccgctccccaattgggttcaggagcttatatgcaatcttgaggttacagaaagaatgggggcttggaatggcaaaacaggttatgggaggggaagaaaaggacacttggctagcaaaggtgggtggtcttattatttagatgaaatctcacaggtagcagccctcagagagaatcgacaatggtgaatgttcctttcagacttttaaaggtgtcagaagctcagttaatcttttctaagtctggacaagggaaagcctcagcgaaagcccagctccatcagtgcaaatcttctctacgaatgccgatctaccccagagacagttttcagggctacttctgtttgctagccctctgaacagccgtctcaaaatatgccaaagtatattttggggtgaaatatttttgtttccttcaatctgatgccaaatcactttataaaaagaacaggagactcatctctgcctttgttattttgcatggtctgtgatagacattactgataaagttgaacgtgtccaggaaatgtgataaagtaagaaccctcaatgcaaagactttggtcatgctggcagctgttcctggggctaagaaaacaatattcatgcactgatctgctggttatatttcattataaataggggttagtggccctaaagagagggctttgatcacttgtaagagctcagtgatgatataacacttgaaaaaatcttcaccacattttattatttctttgccctcctctggtcacttcaagttagaaatacaaattataaaaaataagctattacattttcacagacgaactaatgaaaaaaggcttttagaaaatatttaaattatcccagataaactgtgttaatcctactgacagtctatttgtaatataagaataatgctgtcaatctcacaatttgaaatcggtcacaggctgattttttaaaaataccttacaaaatatcctacaaaatatctttaccttcccacaagtctcatccagagtcactccccgataaactgtaagacaagtctctcagtgtttatggatcaaatttccctccaagtctttcttcaacatttgctagatttgtcctgctttctacctcccagtaaacagtgtacagaggtcgggacagaagcatctctttcatccggcaaagagcttatggaacctcagccataggctcaggcattatcccagccttggaaatagagccaatatgtaggaaatacagacatatcagtcagtagatatatacacgagcttgcctatgacatgaaaatggactgttattggctattccatccctcttccattcaacttggattatagctttagcatataaaaccttttggtccttccaaaccatacggacttgagtgggtagataaaccacaagaggtttgatcatttgtcaatagttttatcaaaattaatatatatagtatttatagaacgctgtgattcaccaagggggtaaatagatcagtcaacagtgaatacagctgatttggcttggcttgttcttcctaaactacgttgctgtcttgtgggtatatgacaatcgaagtaacacagaaggtggcataagtagattagtacttgccagatggatgatattgatatgaatgatatgagtatagatgagggaaggaaaggaaagttttccatgagtagaatgtgaatatcggctaatgagtgattgtccctcagttcaaaatcctatgaaagcaagttgtgaagatgaagatttttctatccagagtgttttagaaaggaaggtgtaaggatttgatctaaaattactttccttttgttctcaactctcttacccaggcttcattctactttttctttgtcttcacgatcaaaaatcagtgagtacagaacttgtattttcatcctttgttagataaaaatccacattttgtttgagagatgaagttaaattccttatggctacccctgggattaaaacacttaccctaaacttaaactggctaaaatgttttcaatagatcaaggaggtaaatacactcctgtaaagcagtagtgtatgttaataatatttttaaaaattaaccaaatcttataagccaattacttttaatgacagacaaagaagaactgtctttatggcttaaaaacattataaagaccaatttaacttatttaaaatgattttcgaaatggccatattttctgcaaaataattaagctgtcatacggacttctttataatcaaaattgaccattgccaatgttagttaccataaaggtatttaaatacaaaaataaaattgttttgagttataatcaatttttagtttattattctttattctcaggctttatacttaggaaatgttgaatatcctttgaccaaaagttttcaggtttaatttttcatctagttctccatcttgtctacatcatatctcttttatgggtctctattgctatcacacatgttctttaatttttatcaacaatggtgtgtttttgttttggattttgaaaatatttggtattttgtttaatgaaatggccattgagatacagccacaagaggagacagaggaaaggctcaggaataaaacaaagtttattatatttagaggtcatagagacagaaggcagggcacactacacagggccacaggggaaagaaactagattggttaggaaagagaagacaggagtgaaggggagggttagtctagagcctttactggtgtttctttgggaaaggcaaggcagggaagggtgaacagtgtagaattggctaggtataattttggtggactttgggctgtggggcggttcctgattttttggcatctgactttgggatgactaaggcagaggaatattgccttctggggtgtttgggccagacagaggaagtatggctttagattggttgatttgtacatcaacgcaatgttccaggcgaggtcctttgctctctctggagttgactagctcaaggaacagtaatttctcaccacccagaaaggcttttcaggatgtcaaaacaatataataaacaaagttaaaacacacaacagcgaaacttttttttttttctgaaaaaaggctactggctgttatttcttgccagaatcaataaaaattcctcctaaaagataattaaaaattatcttctctaatgtattgctgcaacctggccatcaaacagcactaaatgtaacttgtcttaatttttaccaaagaaaagttggtagcattacaatctgtctgtcttccttcgagagatagagatgtgaaatgcaaacactgaacataatgttctgtgtgagctctaaaaacaccaagaaatagatgtaggaagttacgtagaatggtggtctcaagtatcatccccaactgttgatacaaactaaacttgcagtcagggatgctatagcataaaatattcatgctgttattggtgctgaaggcgactgctgatttatttgcaattagtagtaaagaattcataacaatgctatgatgctcagccctcataaaccctgggaggcttctgtattttgcaggcttgcagttctgttgtcactgctatacttttttaaaaaagaaatgagctaaaccttgtcagagctgacggcactatcttttggagcttttcttctcccaattgaagataaaggcaaggaagctggcctgccacacagaggctggttcctggaccttctgggatctctcattccggtcagtttgctttatcgggcacctgcccaaggatgaagaaatcataactcataatgacttgtttgaaatattttagaccacgtgggtgagaagaacacactttaaaataaaaggaatgtgtagtcatccttccttacgtttgccttccacatatgtcctgctgatctagtattttgatgttctttagtgaaacaacatttatccagggaaattctaaggatataggaatccatcaacactagatttgtaagccaacaaggaaacaatagagggcaactaaatcaatcatttgtcataaatacaaatgtcactaatccaaagttggtggccacttttctgtttttacatcagagcctagagaatctattgtttactgatctgacactcttggtagctttttccagattccactttggtgctgatctacattccttttctcagtgataaatgccatttagagttgtattattaataggatttaattttgacagccagttttaccaaatttggcctataaaggcatacattcttcatatgcataggcatacattctttacttgatggctacatcattcaactattgtattattaagaaagccttgtatttacattggatgtcacagtttataaagaaaacatagatgtattttctcaagccatagaactgtgctttatagtgacaatttccatattatgggcccataatgtttagggttaattctgcattgtaatggctaacagaaggaatggtctggatcagtgcttctcaaattgaaatgtacttatgaagcccataaatatctttgtaaatgcagattctgactgagtagtctaggatgaggtctgagagtcaaaaacatgaatgtggggagcctacatgcattgtgctcaggagctgccttagagatttttgccttccatatctcccctttaaaattgcctctgacgtttgcttttgggctgctccctaaaataaccacctgccagtttatcatctcttgtcgcagaccctccatttccctagaatagtgttgctagatttaccaaataaaaatagatgacaccagttaaatttgaatttcagataaacaatgaatatgtttttaatataattgtgtctaaaatattgcatggtacacatttatactaaaaatgtattcattgtttacctgaaattcaaatttaactggatgacctgtattttatactgtaatcgtaccctggaaacaaatgccttggtgtgtattggtctaggtcaatctcaacactgttgacttggggtccagatacttgtatgttgtggtagaccatcttgtgcattataggaagtctagcagcatctatggcttccacttaccaaacacctattacaagcccgtcccttgttgtcacaactgaaagtgtctccagacattggcagtgtccctggagaaaaaagaaagcagccccagtttcgaactattggtctagagggaggagggtgtgtgtgtgtgtttctaaatatgtaggttgagaaaacaaaatattagtaaagttttcggcaaggtgcagtgcctcacacttgtaatcctagcactttgggaggctgaggtgggtagatcacttcagcccaggagttcgggaccatcctgggcaacatggtaagactgtctctataaaaaatacaaaaattagccaggcatggtggtgtgcacctttaatcccaggtactttggaggttgaggtgggaggatcacctgagccaggggaggttgaggcttcagtgagccaagatagcaccactgtactatagcctgggtgacagagtgagacaatataaaaaaaaaaattagtaaagttttggtaacgtgtctttctttgtcaaatatgataggagagatgtaatgggagtttctaagttaggttctgtggaagtcatgagattaaaaaaaattacaagcaaatattttgtcatattttatctacgtatgaatctgcttccctgtcccgtattctcctaaaacatgcaccaagtagcacttaaagctatattaatgataatgtaaagagtatactgtttcctgagtattttgttccatttctatacccatgaaataaacatatttcctgtgtgtctctggggctaaatataaactctcttccccagcattcatgatctttcactggcttcctcctccctccccaaaactcccctccccactttggggtttcctccatatttcctaacgttcctctctcatctgcttcatcaggccatgtaaaccaaactgacacagttcacacttaactgtgaattccaagcaatttctgatcatgtgctttgctagtattgccctccattcacactgcctcatagccatcctcaaatacattctataaaacctaactttcaagaaaccctactttatttccccaacccataagaatcactctcttttctggcactgtccataacacaactcactttctcccttggataagaaacagttactaacaagttatctcccatactaaccttgaaagactttagagtaggttttgggactgcattagtgttacattgtccaaatcaccacctacatgcagtccccaaggtatcctcatatttagcttatgcacatgcgtttaattctgcttagaatgttttaaccccgtagccttttctgacctccccatttaaaattattatgactctgagacaacacacactaaaccacctttcctaatttatttttccccatgaagtcattattttctctcacatgttatttttacttatttgtttattatctgattctccctgagagtatataatttttactaggacgggtcacttgtgtctctttccctagtgactggagtagtttctggcacagagtaggtgttcaataaacaattgttgaaaaagtaattaatgtgctgggatatctgaaggtatttcaaaaggtgttggtctcaaatatatttgatacttgagaatatcagtagaataattttgaagggacaaaacttccatgggtgtagaacttctaaaacacacccgggcacaaagttatcactttataatcctatcttgaggttatttcacacagaaggcttagagagaaaaagctgaaaagttgtattgattgcaattttgggggaagtgtactaaaaagactcccatgcttaaactgctctaataccaggtgcaggaaataccacaattgctgatagaacaaatactatattacttgttactggctgagtagatttagaaatcaaattggacctaaaggaaagtgaaagaaagctctttcataaacctttgcttctttttcctttcctcttttttattgtcttcataaaagtttcatttgagggaataaagtgccccctggggctgtgtctacatgaaaccttaaggtattaagcattcatttttgtgcagttgatcacacaagtcaatcatgccaaattgggaagttattctcccaatatgttaaccaactatacatgaaatttctagcccatatgttgtttggctttttttttttttttttttttttttttttgagatggagtttcactctgccgcccaggctggagtgcagtggcacgatctcggctcactgcaacctccacctcctgggttcaagcgattcttctgcctcagcctcctcagagctggtagagctggtattacaagcatgtgccattatgcccaggtaattgttttacttttagtagagacgggatttcaccatattggccaggatggtctccaactcctgacctcatggtctgctcacctcagcctctcaaagtgctgggactacaggcttgagccaccatgcccagccatgttgtttggtctttgtcaggactactgtcgcagctcaagagcagccatagacaataggtaaacaaatgggcataactgtgtcccaattactctttgttttatgatattgaaattaaatttcatatatgcttcacatgtcaggaaatatttttcattttaaatttttgtgggtacatagtaggtgtatatatttatggggtgcatgaggtgttttgatacaggcatgtggtatgtaataattatgtcatggaaaatgggatattcatcccatcaaagatttttcctttgtgttacaaacaatccagttacatatttttagttatttttaaatgtactatcagattattattgattatagtcactccgttgtgctatcaaatactaggtcttattcattcttttttttttctttctttttgagacagggtttcactctgtcacccaggctggagtgcagtggtgcatttcagcttcagctcactgcaacttctgcctcctgtgttcaagcaattcttgtgtctcagcctctggagtaactggaattatagccattcactaccacacccagctatttgtgtgtgtatgtgtgtatttttagtagagatgtggtttcaccatgttggccaggttggtctggaactcctggcctcaaatgagtttgcctgcctcagcctcccaaagtgttaggattacaggcgttagccaccttgcccggccttattcattctttctaattatgttttgtatcccgtaaccatccccacttccccctgaaacccctactacctttcccagcctctggtaaccatccttctaatctatttcctgaggtcaattgttttgatattttagctcctacaaataatttagaatatgtgaagtttgtatttctgtgtctgagttatttcacttaacataatgacctccacctccatcagtgttgttgaaaatgattaactctcattcttttttatggctgaatagtactccattatgcatatgtaccacattctctttattcattcatctgttcttggacactcaagttgcttccaaatcttggctgttgtgaacagtgctacaacaaacatgagagtgcagacatctctttgttatattgatttcctttttttaggtatatatgcagtagtgggattactggattatatgatagttctatttttagttttttgaggaacccacaaactgttctccataggggttgtctaatttactttcccaccaacactgtagaagggctcccttttctccacatcctctccagcatttttattacctgtctttgggataaaagccattttaactgaggagagatgatatctcattgtagctttgatttgcatttttctgatgatcgatgatgttgagcactttttcatatgcctctttgccattttattatcttctgagaaatgtttattcaaatcttttgaccatttaaaaacattggattagactttttcctataagatgtttaagctccttatatattctggttactagtcccttgtcagatgggtagtttgcaaatattttcttccaatctgtgggtttccttttcatgttgactgttctttgccaagcagaagctgtataacttgatgtgacccagtttatctaattttgctttggttgcctatgcttatgggatgttactcaagaaatttttgcacagaccaaggttctagagagttccccaaaagttttactgtagtagtttcatagattgaagtcttacatttaagtctttaatccattttgatttttgtatatggcaagagataagtgtcacatttcattcttctgcctatgaatatccagtttcccaccaccgttcattgttgaaaatgatttactgtaagtatatggatttattgctgggttctgtattctgttccattggtctatgtgtctggatttatgccagtaccatgctgtgttggttactatagctctgtagtataatttgaagtcaggtaatgtgattattttagtttttttctttttgctcaggacagatttggctatttggggtcttctgtggttccatataaattttaggaatttttaatatttctgtgaagaatgccatttgtgctttgatagggattacattgaatctttagattgctttgagtagtgtggaaattttaaaaatactgattcttccaatccatgaacatgaaatatctttctatttttgtatgtcttctttaatttctttcattagtttttaatagttttcattttgagatctttcacttctttggttaacttcaaagtatttaatattatgtgtggctatggtaaatgggattactttttatttctttttcagattgttcagtgtaggtatatagaaatgttaatgatttgtatgttgattttatatcctgcaactttactgaatgtgtttatcagttctaatagttgttttagggatcctttaggtttttacaaatataagattatttcatctagaaacaattttgggttcgacttgccctttcttttttagttctttatagggatcctttaggtttttacaaatataagatcatttcatctggaaacaattttggtttggacttgccttttcttttttagttctttaagatgcattattaggttatttgaagtttttgtttctttttgatgtagacacttataactatgaatttccctcttggtggtgcttttactgtatctcacacgttttggaatgttgtgtttccattactgtttgtttcaacaaatttttcaattttcttcttgattcaggagcatactgtttaatttccatgtgtttgtatagtttccaaaatgcctctggttattgatttctagtttgattacactggggtcagaaaagatgcatgatattagtttcattttttgaaatgttttaaaacttgtgacctaacctatggtctatccttgagaatggttcatgtcctgaggagaagaatttgtattctgcaatcattggatgaaatgtactgtaaatagctattaggcttacttggtctctaacacagactaaatctgatgtttctttgttgattttctgtgtggaggatccgtccaatgctgaaagtggggtgttgtccagctgttatcatattggtgtctatctcttcctttagcgctaacagtatttgctttatatgtctgggtgctcccacattagatgtgtgtatattttcagttgatgtatcctctgctgaattgactccttatcattatataatagacttgtttctctcctgttacagttttggtctttaagtgtattttgtctaatacaagtatagctacttctgctctttttttgtcttcattggcatggggtatttttttctatctttttgttttcagtccatgtgcatctttacaggtgagatgtggttcttgtgggcaacagatcattgggtctcatgttttaatctattaagacattctatggctttggattggagattttagaccacttacattcaatgttatgattgataagtaaggacttattcctgtcactttgttatttgttttctgttttatttttattttattttttatttatttatttatttatttatgtgtgtgtgtgtgtgtgtgtgtgtgtgtgtgtgtgtgtgtgagatctctttctgtcttccttttagtgaaggtgattttctctagtgatatattttctttctttttattttttgtgtttccactgtatatttttcaatttgaggttaccatgaggcttgcaaagactatcttataactcactcttttaaattgatggcaacctaatactgattgcataaacaaacaagcaaaatgctaataaaactctacactttgtctccttgctttttaattttttgttgtttctctgtgacttattgtacttattgtactcttgaaaagttgtggtagttactgcttttgagttgttcattgttaagtctttctacttaagagtagtagtttatagattacaattacagcgttataatatcctgtgtttttctgtgtgctattatcagtgagatttgtaccttcagatcatttcatattgcttattaacatctttttctttcaagttgaagaaattcctttagcatttcttgtaggacatatctggtgttgatgaaatcccctaagttttgtgtatctaggatgggctttatttctccttcttgcttgaaatatattttcactggatatatcattctagggtaaaagttattttccttcagcactttaagtatatcatgccactctctcctggcctgtaaggttcccaccgaaaactctgctgccagacatattggagcttcattgtatgttatttgtttcttttctcttactgcttttatgatcctttctttatccttgatctttgggagtttgcttccttgaggtagtcttcttcaggttaaatctccttggtgctcaataaaccttcttgtgcttgaatattgatatatttatctaggttttggaacttctctgatagtatccctttaaataaactttctgttcctatctttttctctacttcctcttgaagaccattgaaatatttgccttttaagtctattttctagatcttgtaagtgtgcttcattgttttttattccttttttttttatttcctccatgtattttcaaatagcctgccttcaagttcactaattctttcttctgctcaatcagttttgctattaagggactctgatgcattcttcaatatatcaattgcatttttcatttccagaatttctgcttgattctgtcttgttattttaatctctttgtgaaatttctgatagaattctgaatttctttgcggtgttatctttaattttgttgagtttcttcaaaacaactattttgaattctctgtctgaaaggtcacatatctctgtttctgcagaattgatccctggtgccttatttagttcatttggtaaagtcatgttttcctcgatggtcctgatgattacagatgttcatcaatatctgggcattgaagagttaggcatttattttagtcttcacagtctgggcttgtttgtgcctgttctccttgggaaggctttccaggtatttgaaggaacttgggtacaaagcctaataatgcagtggttcttgcagactcatagaggtaccactatggtggccttagatttaatctgaaaaacttctctgggttaccatgcagaaactctcattcattttccttactttgtctcaaacgaaatttctctttctgtgcagagtcacctggaactggggttgggggcacacaagcactcctgtggctaccaccactaggaatgtgctggttcagatctgaagcaaacacaacactgggtcttgtctatggcctgctgtaaccactacctggctaccacctatgttcactcaaggatgtaggattctatgatcagcaagtgggcaagccagtcatgtttgttctcctcccttcagagtggcaacttccctcaggccctgggtaggtccagggatgctgtctaggaaccaggggttgaagtcaaaaaccttagaaatttacttgatgttctcttctactatggttaagctggcactcaaaccacaaaagagtcattcccactcttccctcccctgtccatagacagaggagcctctccctgtggccaccactaccaccagcccacacgggattcttccaggccaccactgatattcacttaaagcccaaaggctcttctgtcagcttttggtaaatgctgtcaggcctgagacccacacttcagggcagtgggttcccgtctggacaatggcaggtccagacatgctatccaagattatatgcctggactcagtgactccaagtgtccacttggtgctttaccccactgtggccaaagctggtacctaaagtgcaagacaaagtcccctttacttttccctctgctttcctcaaacagaaggagtctttcatcatagccaccacagctgggaatgtgctggatcacatctgaagccacaacatctcagggctctaggtccttggcatactaacttgacatcactgttggttattaagggcttaagggctctttagtcagcaggtgatgagccctgctatgactggattcttcctgtctaggcagcagttccctcttggaccatggtgtgtctaaaatgtcatttttgagataggccccagaatgtggccttacaactctgcccagtgcccttttctactgtggttgagctgatatccaagatgcaagacaaagtcctctttcctcttctctctcctcacctcaagcagaaggaaggagtcatttttgttgctgcaagctgcactgcctggggttgggagaagagggccgcaagcactcctttagcctccccatctggtatctccctaggtcacatgccatccgaatctactggctctaagcccagcccaggactaggaattgcctaggaattgaagtctttgtgtcctacagtgccttttgagtttacttagaaccccagagcgctttggaccatggtggcaaggcctgccaagaaacttgagctctgactgctagaataggtgattcccctctggctaggctcgtccaaattctctgtccatgaatgggcaccagctgagtccagcagggcttagctgtgcactgtgacagggcagcactgagttcaatgtaaagtcccccagtcgctgtgctgtctgtcccacaattgcacagactctctctgtgtgcatcttgcattacctggcaggctaagagctccccttctaatgtcacttgcctaagacaaggtcccatagctgtagcgtattcgttgtcttttttcctgtctattggaggaggggggtcagacaaaacctctgtttcctctgctgggaaaagggggagggatggtgttgatgattcaagactatctcctaccctcttcagagtctctttagcgatatgaagttaaaaccatgcactgtgagtgcccacctgatttttggttcttctgatggtgctttttggtgcatagttggttgttaaaatttggtgtgtgtcagcggggatggcaaatgtagccttctattcagccatcttactctgctctcctcttcctttaaaaattattttgcttagctgtttttgcttgtaggtcccacaaaaacaggcattggactagattttgccctttagctatagtttgctgccttctgccactgactgcttcaagatgatagcagtgccctcctaggctcttctagggtaatctgagcaggagcagactggagtggagtagccatggtaaatgcatatgagaacacgggcatgttgaatgaaaggcaagatttcaagtcagacagaagcttgaaacagtattgcaaactcagtgctgaatttgatcactaattaagaccttgtagattctttgtgcttttatctaaatcctgttatcactctgcaacttttaggactaattaatgcaggctcatctatccttgtactacctcttctagcatttagaaacaatcatcaatggttttttttttttaaactatcatcaacatgtatttgcagaaatggagagccaaacatattattttctatcctttgtgctgcctaatgctttatattaggtttattccatctgtgtcatcttagctgcaaaaggtagttccagcaaaaggtgaaggtgttcagagattgatactatgcaattaagacttaaggatactaatcttaaacttttatttttagatcttgtccacgatgatagaatcgagggtcacttcccctcttattcattaacgaatgttttaaaaagttgcttacaaattatataatctttaatgcttttataatacaatccctgtggataccagagaatatcatttccaagtcacaattttaggcaattgtttatctcaacttctagatattttttccctcaaaatgtcaaaatttggaatatccagtttcatagtatagcttatccaacttttaatagtaattattaatgtcatgattttttaaatccaatttttctcagaattagtttgcagcctctgtatcagcccaaaccatctgctcttagatctgttggtttttccaagtaggagacctttcttatggttttcactgaagtaatacagcactttcattttggcagggggaaactgggtttagcctttgaaagaaagtctcttaagacactgaaaatgcactttcaattagtaaaattagcctttatcacttaataaatgaagtgagtctctttatccattttatatcacaaagaattaaaatctcctgtcctttgttttaattggtgattgaaaatactttttcatctaaatgtattagcactgagcatgccctcccctgttgtgcttcctgtttgaaaagctaattaaatggtctcattgctgattggctggaagcctatacaacttcctggctgcaggccattaacaccctggccagaagtgctgacaaaaagatgaagagatttacaccctctgatttctgtattaacaacaaggacaaaacagtatgtggtcttctcagtggataatacaatttaaagataggatttctttttccacaggtgcatttgtctctgaaaattagcagttcagcttggtgtgaataataaggcatcttctctgatgagtttgaatcatattaaaaaatctgttatggacaagttcaaggtttataagactattaccatttctctaaatgaaagaacccaagtcagcttatttctagatctatgttctgattacttaaaaaaagtactggaaataacaagtatgaaaagtgttctattctataaaggcaaaatacatacatatatataaatattgcaaaaaacatttttcttaattatgtcagttatttaacataaaattactttttaacaacaaaaaacaatgccctgtgataagattgcttttcccaatgaattcaccactggttttaatagtttaccatatattttagcaagaaaacatgtgaagcaaatgtgtatgtgtatatacagaagcccacataaaaatagagggatatatgtatatatttgactagacttttgcatatataagtatacatatacacacacccctctttacacagatatctatatatacacacacatatatatacatacaagcacatgtatgaatattaatcatgcacataaatacacatataaacatgtcacaatataatacataatataaccaatttaattggcttttcaaacaggaagctcaacaggggagggaatgctcagcactaatgcatttagatggaaatgtgttttcaatcatcaattaaagattagatgtggagaacctctaatatataagatatggaactaggaattggagatggggtaaaaatctttactttttcatattcattatgtattctttcataaaaggaaatgattgaatatatttgatcagtaaggccctttctagctttaaagtgataaatctaagatttgtatatattcagatccctttcattaaaccactagggagttctgaaaatgatagtagatgagtatggaaggacagaaagaagtaacgaatgaaatatcaggctttcaataattaatcagccaatagccattgaccacatactactctaaatgtgctgtgctgggctgagactacaaaacaactgaagtctcattcttacttgtgagaagcttatagaatgattttggacagatatgtagctattgacatgaaagccatcaaggtaaagcagggattgagaagtggggtagaaaatttataattgggttctacgtttcagaaacagaagtcactttacaaaatatagagtgtactgtaaatcttgtttgtacagttaattgcttacaaaacatttattagttgtttcaaagagaatccaaccctttagggttgaaattattataagttttaaattctgaattaccataatgaatttttcataaattgaggtcatcaccaaaatattctgcaatgaaaaggaccagtcatcagaactttaagatgaagtcattcaattgaagcagaatattttagagttatcttaatagatggtcctttgcctaaatgcacaaaacaaaaataattcttactgtgatcagacttaaaacaaggagagtgttaattggtgtttttactatgcaagacagtgtgaatatccaaagaaatatagagtactatatctgaccttcagcaagctaaaatttaattggatgaaaatatggtatctgtaccaataaatagctgctgatttccaaatgagtgtcaatgaaactaagatctatgcaatatcaacaaagaaaatagaaaaatagatttgatttggttttaggagtttgagttaaattccgatattttagctgtgcattcaacaaatatttactgagtgtctgctgtgtaccaggcaaagaggatgcaatgttgagcaattccaaccaaggcttaacccttatgagttgggaaagagcaaactaattgaacacagggttggagccagagggaggcatagctggtgaggtatacaggaaaatataaagtcatgcttaggagctcaatgagaagactagtggggatagaacatatggttactgataaagaaatataggaaacaagaattcctagtaaatgatttcataaaaccgcctaaaacagctcactatggtacatatcaggtaagaaatttggaaaatattgatgtgttatgatattcccagatttaagcttaaagttaggttaacactttgtaaatttactagtgagagattaccttgaagacatacctcacatatcactcataggtggccccagattgatgaactctgttggtatcttaatagatagttctatatctaagactcagttccatagcaattttccaaaaggacaaactacaattacaataaaatatcgatatgtgtctcaaatactgttctgatgtagaagtatctatgcgtcactttaaatatcatctcaaatccccaaattctgaggctaagagaagagtaaaatatatgaaaagagtttgcctcaaaggacacaaactttgattcaaagcaaagtcatagaacctggcaaaatttaacataaattcagctgttttaaatgtatgttcttgatcttctcttccttgaaaagcggaatgactttaaaatagcaatatttagacaacctttgggaaccagagttctatctacaaaaccaattaaatcagtgtaaatggtgtaaaattaataagaaggctcaataaatgacaagatagcttagttataagcaaaggaaataataatttcatgttcaaattaatgctcaaattaacttgagtcggtcagatttctgtaatattggggttttcattgacttctctcttaccataagtccctaggcttgtttttaagctcctctattaagaaccctgatgataaatgttgcctggtgaactctgcattttctactagacaggcagctcccttagggcaatgatggggaatgtttataatttgcttcagtagcttcagtgtctggtgtgtctattacattagttttgttaaattatgtcctgaatgattgacataaattatgtcatgaatgaatgacatggatgaatgtaaagtctgaccacatattaggttgtttaaacatagaatcacaaagtaatgtatttttataaatgatagaaaccttgggggtcaacctctctaacctttttcatttttgagattcagagattgacattgaataattagcctcttactcctgtttaatttttaaccatatctcttgctcacatgtattatattttttgctatcttccataccactgcatttttatacctacataacctaagcaaaatcacagcctaaatattttacttggaaactgaggtttgttcttgacccatcccttttcctcataaacatattcaacattcaataggttctgttcattatacatcaaaatatagctagactttctcctttcttccatcccactattaccttacttgtctatttccttttgccttgactgctgttaagtttctctctgagattcctgcttccactcttgtattcaccaccaccacctcaaactattctctatacagcagccagaatgatcttccagatatgtaaatctgatcacgtcatttccttgcttaaaatcccttaataacatctcagtgtggttgaaataaaatgcagacttactaaagtggtggatgacatctgaattatccaccctgcttacagccccaggttaatcttttgccatgttcctcttggcccactgagcttcaaagcccatgtcctattgaaccacgcatcttttaaataaatacttcttgatgctttaatacttctttttaagttcatggatattaccatcaggaaaggtcataaacaagcttggaagcaatgttgttgctgattctataaaaactgcataagtaccctgacacttgaggtttaaagctgttctgaagggataatttacttcctaccacacatacctgcagccagatagtggccccaaagaagcagggtagaaatatatctgacttcccaggtgtgtcctttccccatctttcttctcagactaggtgtcatgtgatataactggacccaggagaatgaccccacaactgaaagatttttatgaaggatgatttactattctccaacgtactgacatttttctacagcccaatcattgctggggagtaagtacagaacaaaatgtgttgagataaaagatcatttcaggcttttgtggtgagctttgattctggtgagtttgagacacatttcagactataaactttagcgtcaaacattgtcattttcccttcgagtggctattatatcatgttattctgggtcaggttatcaaaaatttggtaattcttaaacaagttttgattttttcagagtctcagtagagaaggttgaaaatcacacaagttacatagttaagcagaaatattttggttttccattttcattgtgcaaatgcatgcacagtatgaaaatgcattttattagctccaattttcccccagtaggtacttccaaattgaaattaaaattatatagatttaccagaagtctttaatctaaattattatttctgttgggatttctggcttcttattttacaaaatggattttatggggaggaaaaatatattaaaattataagaggaaaaaattgactccttttggtatatttgatgtgaatcttagctattaccaaattaactttaatgaattatataatacggaataaaggctttgggcagactactctctctactgcatctttgtattgaaaacttgtttcatttaggcttctccttttttttgtctctctctaaagattttgaatatagcactcaggcacatgtctttggcaggaaaaaaaatcacttatattgagaagagggtagtcctatgaaacaaatgtagagtaaaaagtattgccagagaatctcagcagggccatttacagccatatgaaggcaaaagcttatattaataaacctaatacagtgcctggtatgtattcaatgactgccactgggaagaagaaaaataggaacttgggttaatagacggtcagatagaagatcatttaatcctttgggtaacatgctcaattaaaagtttgaaacaattataacccaataaattcttgtttcaatgacctttgaaatgaatagggaaatgtcttgccaagtttctttgtttatgaaaatccttgttagggttttgtaatgtttccttcagaaaatatgctggatgtgaattctgtattcctaccttggaattctgaaatccagaagattgaatcattttctgaacagtaacaggacttaactataacatagcacaagttgttacataacatgatataacatgttaatataccggaaacatatgttactatctgttaattaatttgggtattagtcaatatttattgagtgctactgtgtacctagggaataataccaaaacacaggagtcatagattcccccctcatgaagatcacagtacttctgtagtcaaaacacacaaggcttataatacaatttaaaaaaaacagtatcaggctctcttatgaaggagaaaaaacataagttttcgaactcactgcttcccattatttactgacttacttgccatctctaaaaacatgtgcagtctttagattcactgttttttctttacacatgttgcttctctgtctagaatgtccttttgtatcttgggcatctggtgaactcccattctttattccagacccagccatagtccaccatttctgaagctcttttctgattattgatttcccaataggcatcactgaggattacgctatctttgctccaccagcatctttcatttttgtcacagtgcgctatgctatatatttgcctttcctactagactatgaactctttgaggaaagaaactggtactgttcatcactgtattcctcaggcaattaggatgatccctggcacatattagatgtccaataaatgctgactgactctggattccccagaaacaggacacatacacacacacacacacacacacatgcatacacacaatataagtatgtatttatattatttttatatattaatatatgtttatgtgatatataaatattttatataatatataggatctatccatctatttagaaagataaatagagacagagaaagagattgatcacaaggaattggctcacatggttctggaggcttagaagtcctagtatctataattggcaagctggagacccaggagacatgatggtatagttccagttagaatctgaaggcctcagaaccaggagacttgatggtgaaagttccagttcaagtctcagttcaaaggcaagagaagactaatgtcccagctcaagcagtcaggcagaagatgaattttcttttattctgcttcttgttctatttgggcctttaacggattggataaagcccacccacactggggaagacattgttttattcagtctattgatttaaattttaattttatctagaaacacccttatagacacatccaaaataatgtttggccaaaaggctgggtgccccacggcccagtcaaggtgacacgtagaattagtcaccacactgactgactgactgaatgagtgggtgatctgggaattctcattaagtaatgcagtcagtgcaggtaggggtgcatggaagaagaaccttgataaaatagggaaagggtggtgacagtgatgtgatgaaaaacagaagatcataccaacttaaagagtttgcttttctgcttttgaaggatttgcctatcctgaattgtgcatacttccaagtaggcccaacaaatatcagccgtattcacaatcaacttttatgagcattgcaaccattcattagccatgtgtaatgagatttttagcttaatagaaagcctcagcctgaattctgtaaaactattcattactattgattataaaccaatctcaggtttttgtattaagaattttacatgcagaagaattaaaattattgtcaaagcttgtagaggtaaacatgtcttcatgaaatcaatatgctcgtgaagagttgcttgcaaatttcactgaatataatgcactgaatagagtattagaaacattaggaaagtttccttttgtatttttaaagatatgcttgttttagaaaaaaatgagcaatataattttcgctcatttaaaaaaagtttattaacataattttctatggatgtataatgttatgtacagtggatatactataatttgcttaaccaattaccaattgtgcaattagcccattttatattttttactattttaaataacaatattgaatacatatgtaacttttctttttgtatacttatgtatggattcctagaagaaaaattgagttaaattggtttttttgtttgttttgggacagactgttgctgtgttgcccaggctggagtgcagtggcgcaatcttggcttatggcaatctcggcctcctgggctcaagtgattctcatgcctcagcctcccgagtagctggaattaaaggcgcacacaaccacacttggctcatttttgtacttttagttgagtcgaggtttcaccttgttggccaggctggtctcaaactcttgacctcaggtgattcgcctgcttaggcctcccaaagtgctaggattacaggtgtgagccactgcacccagccgtggttaaattgctatgatgcaaatttcaaatcactttactgaggtggtgtatcaattcacactttcacagtattgttaattatcattttaagaggttttttgcaacactgataggctaaggtcctatctcatttttgttatattttcagttttaattactagtgaatatttgtccacattagaaatttaaagaatttctatagaaaatcttacattaaagtaaaacaagcaaataataaactcctagctgatctacacattaagtatgagtctgcatttggcttaatgcatactcacagttaagcgacctctttcagtcaccaaagatgacagcagagctaagatgaaagatagttgccactattcattatttgctatctagtaccttctgtaagaaggacttcattctaactttcacatacataaatggcattgatgttcagtataatttgattagattttaagaagaatctagaaagacaacaccatgtgagtttgaggaagaggtggtaaaactattatttaaccttgtgctcagaatagatattataatatagcttgactggaggaaataaagttattaaaatgctacctagaacaatgcttcccaaaactgcctctgttggccctataattaatcaaagatattgatgggacaagccagctcacgcttgtctgattgttgatactgaaatcaagaggagcaggactgttaggacacgttgtagttcatgtctgatcaccacctccaggggaaagctgggtaggggctgaaatccagttctggatttactgggttgattctgtgcagtgcctttataaaattcattccctcagagacagtatcctttcctaattatacaatggggcaaagtatgaaccaccaggggtcctgaggatattactaagaaggatgattccggagaatcctgaattactccatggctttgaaggccagctaagaaataacctagcaatgctcttaggtgagattatgatagaccaggctttaaactgactcttggtcatggggattataggagtccccaaatggccgtctgtttctgggtctcatgtatagtcaggctttcattgcttcaaggatctggaacagtaccaacactacagaggatgttatattggacaaaccccaaagatgattctgagaaagacttagttgatggccttactccttgcctatttttggcctagggcaagaggtcattgtgtgctgctaagcttgcagagctggacaaactccaggtaatctcattattccaaactgctacagactatgttggaaagtgacagagccaaagctcaaatccaactttcaaaatttggatgtctgcaatactctattcaaacatttagagtcacatagaacctcaaccaatatttgtgtatttttttctttctgtaaatatttgatatacttcacagaaataaaatacagaaaacatccacaggaatgtagaaatacttttcaagcttttatttatccacttaactttttaatagtatctgcctatagtatctgggtaatctgcctatactgtttttctttccctttgacatcctttagaggttcattcatttggtcatgtgattgcttcttataagatcacatagggtgaacatcgctggcacttaccagacatgcttaccaggacttcctttgcaatgtccaccatagagcaattgctcttcagccaaccacctgggagtctgtaattttgccagtggaaatgaagcaaaaataaaaaggagtgggagaataaaaaaagggaaatgatagcttgcagagggatgtggcaagtacaggccaaaatgagcttctaccaaatgccctgcatatcttttattggccttctggctgctttttgaaaaggactaattctagagaatgtctctttggcttgcctctattctctgccttttggctaatttgagaatttaaaagggcaaaggaggtctggctttgaagggatgtaaccttcaggctttaatttggagcaaacaaagcatttacagccgctctcctctggcagttgcagagtattaccacactgctgaatatttaaaagcaaggcgtgtttccaaccccaaggtctgtcccccaattgataagtctctttttattaaatgaactttaattacttaataattagaccttccacaggagaagatgtggatcctgatagtctgccaagaaggctagagggcaaatcggaagaatgtgccattttcagattagaatttaaaagaaggaacaggcccattctgggggtgtgtgggtggaggagagacctccctagaggcggcaagtcttggcataaacctggactgtgaaatgctttatttccacttttgcttgaaaactaaagtactttagaattaaatgaatgagagtacatgtcgaaaatattcaaactttctgactgtctggatctgatggaaagatttcttgtcgtctatgcagtgtgtgtatgcttgggtggaagggtagggagagactattgttctccttattttgattctgagagcctaacacttttgatgtccctacagatttagcagctttccattcattgccatggtgattttttacctcatttttttttttttagcatcacaaaggaaaagcccaaatgaaaaatgtttgcttcttttgctattaacatttctactgcctggtgacagcaaatatttgggttgtgcctagcttctgaggaaatatgtattggtctgaggagattgatggccacagccattgcccaggctgtcccagctgggtgaggggctggccctgagaccactgataactttgttcctggggacagtgatgtgaagggaggatgaggaaatcccattcaaaacgtctactgatttacaattgaactgtttgtggcttagataatattttcacaaatgccttatggatagcctctccacacctcaccacctctacaccaacccatctcttcaaatgaaaggatttattagtctcagctcttttctgctttcctgaaaaaaatcactgcttttcccttctcctattttattatttatttattttttaaagacaggatctctctctgccacccaggctggagtgcagaagtgtgatcatagcttactgcagcctggaactcctgggctcaagtgatcctgccacctcagcttcctgagtagctgggactacaggtgtgcacctccagacctggctaattaaaacaattgtttttctttctttcctttttttttttttttttttttttttttgagacagagtttcacttttgttgcccaggctggagtgcaatggcaccatgtcggctcacagcaacttccacctcctgggttcaagtgattctcctgcctcagcctcccaagtagctggggttacagacatgtaccaccacgcccatctaattttttgtatttttgatagagacggggtttctccatgttggtcaggctggtctcgaactccggaactcaggtgatccgcccgcctcagcctcacaaagtgctgggattacgggcatgagccaccgtgcccggccttaaaaacaactttttttttttatagagacagaatctctctatcgtgaccaagttggtctcaaactcctgtccttcagtgatcctcccaccttggactgccaaagtgttgggattataggcataagctaccactccaaggctcctctaactaattctttatgctttcctagttattgcttgtgtttcctaaactttccaatatttagggtctgaaacatttgcttaaactgattatcttaacaatgatatatatttttcattcaacatacgtttgatggccaagtatttgccatacaccatgctaagtgcttacagtatagaataacatagactcggctctgatttgtggaatttacagattagtctggacgatggctagcaaataaattccacagttaatcacaattgaagtaagtgctggagataaaacctgtaggacaactggttctatccggacttggggaaagctactatgaggaagtgagaattctgttactgcattgaactattaagtctcaggtattcaaacacactgttactgaagagctgcaaatagggtaaaacctttactcttccttgcatgggtagttaataaatgttctaggaacaaattggggttacggctgcttaacaggcattgagcaacacttaacaaagtaacatataagtagactcctaatgaatccttttaatgttaaaattagtgttacagaacaatggaagatccttttcaggactcaaaataacaaggtgagacccatttctctatggcagtctcataatggctctatatctcttgctaatagcacccaatgcttactgtacaactataattagaattgttgacatcaatataatttttgatgctgaagcccaggcacttttactttgtattaatcacttataaaatttgaattaaaactgtctttatcatttctaagaagattaaacagagcttccatatgtgtctgacttttccatatgtaaaacaaatgttctttcctttttatagtttctcactaataagttctgatctttgttaatgcatggagatacagataatgtggaaatctgtaagttggcttgtgtgggacacttccaacaacaccaggtgttcctgtatttaaagctgccatagcatcttgggccagtctaggtgtgaaggtaggaactttgaaattcattctgggaatcaaggttttcctaggctaacaatgtaagccctgcaaaatcaccaaaaattgtttgtctgctatttttaatagttaagtacttcaggctgaaatttgtctataggaattcaatgtaaggcagaaagtacttactaaacaacaaagtgtattgagtacagtactgctacttgagggtttgaggagtgaagagtattcacatataaacgaacgtctttttgaaatatttttgtttatgtcagggaaataaggtattttaagaagtataataattcagtactaaacctttaaaaataaccatcatgggctgtgtacagtgactcacgcctgtgatcctagcacttcaggatgccaaggcaggtggatcatttgaagtcaggagtttgagacaagcctggccaacatggtgaaaccctgtctctactgaaaatacaaaaattagctgggcatggtggcatgcacctgtgatcctagctacatgggagactgaggtaggagaatcgcttgaaccaggagacaggttgctatgagctgagatcgtgccaacacactccatcctgggcgatagtgtataagactcgggctcaaaataaataaataaataaataaataaaaataacaatcatactataaacatttgaaagagtttggtaccagttccatctagaaagtggagataataatacttcctaaaagagccattatgaagattaaataaggtcatttataaaagtgtttataatggcataaatgataaaacaatccgttcccaaagtcctctagcttgttaaataatgaagcggggaagtgactccaggtaatctcattattccaaactgctacacagtatgctggaaagtgacagagccaaagctcaaatccaactttcaaaatttggatgtctgcaatactctatttaaacatttagagtcacatagaacctcagccaatgttttgtatcttttttctttcagtaaatatttgatttacttcacagaaataaaatacagaaaacatccacatgaatgtagaaatacttttcaagcttttatttatacacttaactttttatagtatctgcaaattgtgagtactataaaaatttaaaaggtggagtgatgatttccagtaagtacgactaggaaaaagggagagatttttgattgagtacctaaaacatgactagagatttgataggtagatgttagcagagagcgtgttccttttcagaggaagttccataagaaatacagccaagaggaaaccatgtttaggacatctacaagttcaatagatctgagaattgttttgcagaagttgtggaaaatgaacctgaaagggacatagtgctagatacctgggcacatattaaacaaaaaactctttgcctggttttggggcaaaagacaatgccagaacattttgggaacttcaagatttcctgagtgaagcaaaacctttagtgatgtaggagcactgatattttgactatgtttggaatgcattcgagtgaggaaaacagagagataggaagaccattgctgctatcattacaacggatcagatgtggcctaatgagtctgaaccaggctttttccatgaatgggctgtggttgagcaggtaactatttttcacaaggatctagtgaaaattatacctgtatctctctctggatgaagcttgggaatcatttgtattgcattagaacattagatgacttttacgaaaatatagtatttcatacgtatgcgttatagtgagtttattgttcattactagatattcatgcacataccttgaaactatagtactaagttgatagtctataatttcttcttcttttaagactgttgctgggttgttacaccaccatgagatgtaactgctaaaatttagcacaatattgggagcattcagtcaagccttatagagccttataaacttagaattgcttttgaatgtgtagagtttcccatttagagacaaaaagaaaagactatgcatcatgtttataatttctcactatgacaaataatcaactctgtgaaattttcaaacattgcattgttaacttttaaacaggatgcagttctggccctggcttgttaagatctgaaatcatcacagagtgcatgcaattctattagccaattctgttaagtctaattatattaatatgcaatcccagcctttgtatcgaattcttccaagtagatgaagtttacataggaaaccaattgttgagtatcagtttgaattactatttcattttacatattccaggctctagaacctacttgcaaatacatttttgaatgcaaaagacattcggatgtaaaatagatgtttaattttctgttttattatttctttttttgagacaggttctcactctcttgcccaggctacagtgcagtggcacagtcttagctcactgcaacctctgcctctgggctcaagtgatcctcccacctcagcctcccgagtagctgggaccacaggtgtgtgccaccacacctgggtaatttttaaaaatttcttgtagcgacagcgtttcatcatgttgcccaggctggtctcaaactcctgtgctcaagtgattctctcacctttgcctcctaaaatgctgggattacaggtgtgaaccaccatggataaatggtttaaatgctttaaatttatccaatgtgtatgacttctaaagagccataaatctgaatatataaatgtccagattattaaaatcaacttaaaattttattctcacctacatatattaaatacataacttgtgtatattggaaaattattcctgactatatttccttaactacaaaataaaatactagggatgacaaccaagaagaaaactattaaataaaaatcaaatttgtgcgaaactcattgccctacataagcctcatatctgtcactactcattgcagctttgctttgtgtggtagacacagatcatgctctgtttaagtacatgccttaaatccatacctgagccaatctgtagtagattaacgtacttctttggaatagacacaagactgtataatgcagacagtctggaaactggattttgagcaataagcctgggtacaaggtaactaattcctttcgttcttcacccagtggtagatgcagcacagacacagattagttctaactgaaaaagaataaaattagccaagtggctggcgccccctgtaggcaatctgtagtgtttatccaggcatccccatggatccagatttcagagccttagtttaagaatcagatgagtaattttagaatatatatgtgagggataaattaatatttgcatcaatattaaggtttttgcatggtatagcattaatctttcttacaaagaacaatcttaatattgcatctctaggattgcaggtctatttctgtggatgtagctataatgagtgatatccttcagcagcttgtacctaacccacatataattttggtctaattttatatttcatagattcagttattttgtggtccaaaactctaatccctaaaagagacgtaaaatttcaccttcacttagggagggaaagtgaaatagcatcgcttattgtctctcatattaaattatgatttgacccaggtcattttacctttgcccttttggccacagcaaaatttgtatcaggttgtggggaaaattaggatcatgaaaattaatagacccaaattaaaactaagggtaattaaaactgaacacagtagaattttgtttactgaagattaatgagacaatcaagctttctggacaaaatttaaacctggacctggggaatgttgacttaaatctataaaataaaaatcacagtaacataaaatatgattagtaaaacttgacatgaaccccagactgatgaatggatcaaagtttattgtgacatgtgcataaaattaaaacaattctggaatgagtcaaatgaaaatagaaatatcagaatttaactgggatgaatagcaaacataaataattattaaaatttagttgaattttctctaagaatttgccagtggtctttcattgatggcacaattgataccaatagatttctttgtaataatttaaaaaaacacaagaatttcatggtcaaaacttaggatcacaaatatccacttgttcatatcagggggtttgagatggcaaggtgaaaacacctacccctctcatgtacaacgtcatggcagagaagccttctctctcaccatgcttatgcttgtatgcatggtgatgcatacaagcatgtatatgcatgcttatgcttgtatgtaatggccagtttatttgttttattttttcatgcatgcttatgcttgtatgtaatggccagtttatttcttttattttttccttatattggtcattcatatgaatgaatcattttcacatgttatttcatatgaacattgaagtgactatgtgaattagatattaccccatttcatggcccaaagaaatgaaacaagtttccaaagtattcatatgtaataggtggctcaactagtctagaaacacaagctatcctaattccagcttttaaatcttttcactacaccacagccatacctggcaaatgtggatgaacatttaccttaagcagtaaaccctaaaagacaatcctttgttactataattggtggttcctatcatccctctttcttgaagctgctctaggtcatgccgtatgacgagtccttcatgaatcttcatgacttcataatcctttgtccaaagtggggtaacaggaattctgtccataggaccaggattcggaagaacaagttgctgtctgtaggactgtcatctaaaaactgaactccaatgtgggatttcacttctctgaacctcaatttccttatctataaaattaggctaatcttatctactttgtttattttacagggctgttttatttaccaataaataagcttctagagatgaatgacaacatcttcattactttttagcctctgagcatactgtagtgccagacagaaaatgtggtaaagtgtgaagagcaaatgagacgatatttgagaaaacagcttgtaaaatataattttctacaaagaatacaaagtgattatttttattggcgattattgtgctttatttggaagacttattcttccttctttgtttttctcctaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcaggtattgcaatgctctttgttgccttcagaatgatattctctggaataagttgaaaaacaatttttttctttaacagatatttgtaattgttataagttctgtattgttcattgcgttttgtttattatttctttcttccttgccgaagcattcaatcaggttgtaccaaaagctgttcttttttttttttttcatgtcttgttgaagtttctggaaaaacagttatctctcctttattcattcacttgttctattaatatttagtgagtatttctttgtgcaaggcccattgataagcatttctcacatattatttcattttcctctgataacagtctaagaggtagttttgattcatttcaaaggatgaaggtgaaaatttgcaacgttaagaacattccctaagttagtattgaactatagatatatgatacatatagatatatatatgtatcatatatcatatatctatagttcaatattaaaattaggctgatcttatctactttgtttattttacagggctgtttttttttaccaataaataagcatctagagatgaatggcaacatcttcattactatttaggctctgagcatactgtagtgccagacagaaaatgtggtaaagtgtgaagagttctcttttgtatattctgtactccattagtcacagggatactgacttaaatgtatcaataaccagtgacaacacttacatttcatctaccaggcaataacagaagcaaagctagcatttattcccagcacatacatgcatctatttacatttccattacatacacaaaattttaaatatatcatacatatatcatatatatcatatatacatgatatgtattatatatataccctatatacatgatatatatcatatatacttgatagatatcatatatacatgatatgtcatggatatatacatgatatgtcatggatatatacatatggatatatacatatgtatatgtatatatccatatggatatatacatatatcatgtatatatgaatgatatatatcatatatgcatgatatatgtcatgtatatatacatcatatcattcatatatacatattttttttagactagggtcttactctgttgcccaggctgaatgcagtggtgcgatcacagctcactgctgcctcaacttcccagtctcaggtgttcctcccacctcagcctcagtagctgggaccacagaattgtggcaccacacccggctaattttttgtatttttttgtaaagaagaggtttcatcctattgcccaggctggtctcaaactcctgggctccagcaatctgcctgcctcagcctccgcctcccaaattgctgggattacaggcgtgagccactgtgcccagcctgaacaatcacttacttgtccattcacatgcttatttctgagaagcactgtgctaagtactaggaatccggcagtggcaaagactgtcccagagcctggcccattagagttctgggtggatgcacacatgtaagtaattacaatagggtgtgattgatatgatgattttaaaaaagtcatttctctccaactcttattttactttctcttctctgggaaatccctaagacactggcctcattttgcgattctaattagttagaatctcatgtaatgcctactttctcttttagccgaacttgtaagactgacttagacgctcttgtgagaatcccaaaaaaggcacacactggagaaattggaactgactacatctcaaagtatggatgttggcttcggtctctgcgctcttaactgtgtatagttatcacaagtacttcagctatgcagagagtagcattcttgtaattctaaaagcaaactggcaattcaattgaaagtttccaggtgctttaatgaggacatctctaaaacctctcttttgcagattctctactccattagtcacagggatactgacttaaatgtatcaataaccattggtaacacttacatttcatccgctaggcaatgacagaagcaaagctagcatttattcccaaaacatacatgcatctatttacgtatccattacatacacaaagttttaaatatttatattcacatattattaataatgcatctgttgagtatatcagatgggaagccaaggtaagctgcatggaaaattggcaagcatatgtttatcttaatatgacaggaaaatctgttttccagtggtattaaggaatcaagttgaactaatgaaatattaaatttgaaatgcagttttaaaagacacagagacattataatcaaatccccatttacctttgtttcttcaccttgcaacagccatttgcattgtaaaccatggagatttattttaagccaaattttgttttcttaatttgcctaaaatagagaacatgttgtacttttgagatgtgtgagcatttcttagctgaattgaaactgatatttttgtaaaggcatcacatcaaatgagggtttttatctaaattatatgaattcaaatataaactttagaaaaaattgagttaagatagtacatgcacgtgtgtacacatgcatgcgcacacacacacaggttattgtcatacttggctaagcctgtctcgtatgctagctgccaaataaagaacctgctaaaggagaatgcttttaacacattctcgagtttgcaagttggtttagaggtcaaattcacagatgcgcaataagtacaagattgagtgagtgcatgaatgaatgaatgaatgaatgaatggcaaatctctgcttctcttagttgccacttagcgttctctcatttcaaaaatcatcgtaatcctttatgaatcaattttcactctctgtaagtaccaatgtgaggcagtaataaattacatatataatacatatgtgtgtatacatgttaatacatacatgcacatatacaaacatcatattattggcatgacttaggactattcaacatggtaccagaatggttagaactcttgaaaggtatatcttttcctggagtcactaaattaccatgttgactgatgaagtaatttatatcttgctttagtttgagatgtagatgttaatgagaaattttgcaactttccccaacattaatttttaccatagttcataagaagtgtttgaatttatgtgtgtttatagttatataattctaaataatatttaatgtaatatacttattcaagtctatgtgaaacttatttcaggttgcctcttttatatatcaggtgtcttctatcaccaagtaactgaggtctattaaattcagagtttaacaaacagtggttttaaagtgctgtctttcagcgaccagtttcactttattcattacgtaaatactttattcaattaacttttgaatgaatcttacatacctgacatcttgatgtttgctaggaatgaaatgttggaataccatgccctacaaaagcttatagtccaatgggagaaatagacaaagcaagtaggctgtgctgtgagagaagaaaacacagagcaccattaccctcataagagcaataccaacaagtactagctaggcaaagagaagtatacaccatggaaaaagagcagcacgtgaaaagcataaagaaaatagagatcaaaagcttttcaggcgaactgtatatattctgtttgactggctcataggcaggaagcgataaaggggaagaagctggaaagaagggagttaaatggtaaggaggatgaggtggaatgctacagcgctcatcctggagagaattgaccaaaagcagctactaaggcaacatcagagaagatccagaaatgatgtttggtttggtcctggaaacatatcacatgtggcttatgggtgaagggatggaatccagactctgacagaagctggttagtagcatttttcattgagactggaagtgggagagtagtgttactgtgtttaaaacaaattatagattttttagaagatattttcccataaagttttatctcttccagattaagataattatttgtttcattaaaggtaggaaaattagtacctagtttcatttgttgattaatgttttaagacaaattgaatttttgctatggaaattatacatatgtaacagaatcagtaatacattgtgctaaagcattttttaaaatatcaataacaaaacactaagagttgagatgttttacaatgtctgattgtgtgtgatggcgaacatgtgatgaatggaagcagccattgtggttgtcaagttcactttattcatgtcgcatcatgtctgagtgccaagcaggacattgaattgcacaattataaatctgctttgggcactagactgactacaattactggcctatacaatggaattctttagtttgcctaatggcctaattgaattgatcaattggtaattcaatctattatttgtttaactacagttagatgactctgagtcctgtatagaccttaactaaatatttatctaattagagaccttggcttttaaagaaataaattggactaaaatatacatgatttttgtctatatttttattaaaataaatattagcagaaaccattctaaaatccatcttatttgaaaggaaaatcctgtcttcagttttaaaacaaatagttttagatttttcttcatcactaagaacttattactcaatggcacattaaacttttcagttttgctaaatattacttacatttcaaaactaatctattttctatgttttctataaaaatagaatgtagttacattatagaaaatagattccatttctatggaataatgatctgtgtaacaaagaggacactttcttcacttttaaaatgtattaagccaggtagttaattcgcgtagccctatgactaacataaggcagagaagggcaaattcaggtacacaattctagttctaaatgaacatagacaaggaactagttgggaaatttggaaggtttgcatagattattacttttataggtcataagggaagaactgtctgtacaatgattccagtagatgataaatgcagaatgagaaattgagctcactttatttataagataaatattcagattaagtaacatgccctaaattgtacaattaccaggtggtgaaaccaagatttgtacttaatcattctgtgtcagaccccatgatattaactacttattataacagttcaagtagggaatttatgcctaggaatttagacttgattcaattaactttgttgatgattgggcattgctgaaggtttttgagcaatgaatacactgacataaacatacacccaaaaaacggaagtgaacagcacattaggttaatgcattacctgatatttttgtctcatatttaacatttttttttttgctgcattgtaggagtttctcatactgtgttttcttttaaaaatctagtttgaagaaaactttctcttataccagggtataaacagggtgcacttagcctttcatagatttaagatggataaaatgatttcttgtgctcctctcatatatactggaaaaaaatgaagtatatgatcttattgtatttaagccagatgaagtccatgttttctagatatatcagatttaattcagatggcatgaaaaggtctgcatatggactctcacagtctatttccatggattctgctaacattgacttaacattgaccagttaataaatattaaaagttcccaacttgaactgttatagtaagtggttaatatcatggggtctgacacagaatgattaagtacaaatcttggtttcaccacctggtaattgtacaatttagggcatgttacttaatctgaatctttatttatcttataaaatgtcgcaagtaataccacatatttcatagggtggttgtgaggcttgagtttgacaagacaagcacaatgcctgtaacttcaaagtcctcagtagctattataattatcttagcattttagagtttccagttttaaataattctattttcatgtcaagataatttctctggtaataaattacctgattttggattctgggtctcataagtattaatttgtctactggtagttcattacacatgctttaagctatttatctgtagtcctagcacatttctgcattttattttcacatctaagagaagtcagagtttcctgcatcttcttcctctctagtaacttattgctacatgattttacctttctttacctctccagtaacattattttcctttgctgtatgatatggtataagaggaactggtttagaaataggagtcaggagataaataagcttgatagtgtttgatcttcattacccatgaacaattctaatcctctcaaacccttagtttccttatctgttaagagaaaagggtggacgacatcagcgtcttcaaatcttttcactataaaggatctcatttattatttcactccatactcaccctcaactctgcctttataatcctagacttcaacaattcaggttagcaagacaaaatctaatccttaaaagctgcaaggccatgctataacacaataattaatggtcaaaaatcaattttatgaaatatgagattgttctatttttagattaataaaaaatagttttaagtcagtttatgctgtcacacaaatcacaccaaaagaagataggataccttttattgtgtacaactaagttccacgtcattctgtgcccctctccacaccagatgataactttagcctgccctccttggtaactagggctaggcagagcacaggagtaaattgacaatcctattgtagtggaattagttatagtaggtcaggtcatttaaccaatgtgcaataaccaaggtaaccagtctttcacatggagctgatgacattccattcagatgtaacaaagcctaatatgttgataagcctaacctgacttactgtggatacatagaccatttctgtttgattctgaattaaaacgtaattatttatttcccaatgctatttggacggacatcaacaaggctcaggattccaagctgaacctttaaaaacttggggactgattacatttttctagtcatgtctatcattctaaaattagtgatctccccctcagcaaatcaaccagtttttttttctatttttattgttgaccttgagtgatgttagatatggattatattatattctcttagctactattccctgaaaagttactatttcctgtaagttcaaaagcaaaaacaatgtatttgagattgtcctccacgtaaaggaatgaatatgtcttggaaaggagagaacctgttttttcccaagagtctcatgaggccaaaatatggtcatttctgcatttacttatgaatgtgatatttaacagccctaggtgggtcatcttaagggtcaggcaatcatccgtgactctcacatgaacaagaaaacctccctgagggtgtgtaggatccagacttataacccatgaagcaaaagtcacaaaaaaatagtgaaaagacctgtagagcttgcttccttctttggcctcatttgccatctatttattcctggaacataaaaaaagacaaatttagtcataaattataggcacacctttattgattcaacactgacaaaatgggaaatagtccaaatgctttggttcattatcaaacaacaagagccaaaatcacaaacccattgcttttctggaaagtttttaatgctgctttatgcatgtatctatacatcatgaagatttttggattctccaaactaactttgacacatcataatggcaacatttgttttctgggattctactgtcagctgcaaaattaaaaaaaaaatctaaaaataaaaaaaaatcacttccttcagacttgctacaaaatgaatctgatagacttaaaatttgctgtgagacacaaggggtagaagccatacgccagtgataagaatagatgatttcctttcttccgccagactctaactagaaatagcaatatgtatgtgtacatagagaaagaaagaggaaatatgaacagatgtaggaatatttacagagagggaatgtcatttttagtactgaattggtgtaaatgaggaaggaaaataatagaatcctagagtggtgaataatagctccggagaaatggcttctttctccctccatgtccaaaagctccttggcttacagccagatggaagttttcatttttttattaaataaattctggttcccgtgatcagtttggattaggctggtttttcaataaagaatattctaaacacagagttaggagtttcatggaatttttcactcagagcacatagtagagtacctactggtgtttgaaggctcacggtacctgctgaatattctaaaacagaactagatgcgggatggctaagcagccagcaggtgaacagtaggttagcttgaaattgaggatgcagacagagcaaactagctctctgaagttaaattaatttgtaactcttatgcctgggaagaaatcaaagaaaataccccacagtagcctgcagtgccctttcatttccatttggaaatgtgtttgatattccatggaggcaggaatttaataaagaaaaccgaggagtacacaatgaggaaaaaaggcttttgcattcagaaagcataaaaattaaaagcaactactggttattttgaggaagacagttattaagttgtgaaaactggtatttttttcttgccaacgcagatgtcaacagtccataatttaatttctctgtgtctcagttattctttagattcagtgccgtaaatttcatgttgaggttcctaaataactgtttagggaaatggccctgttaaaggaaagccgtagtcatcactgcattagcataaattcttgtttactcaggatacatttgatcacatccagtgtcctaaaataattgtaaggagtgtttagggtcccaggttggataatttatatgaccaacctagtcatctaccatgagggaagataaaatagtgtggccccaaagacatttgggaaaatctgtgaatatggacagtgaatatgcccctcagtatgtcacacacactcaattaatttgaccattgtaatgttttaaccttttttaaaacaattctttaaaaaggaaatattctcttcctttaatacatcttcccttctttagggcatggggcctgatgatagttgactttttgtttctgaatatattaagtgtaaataaatgtgtcaggttatatgatccatgatgctatttgacttttaacaaattattgctgaaatatagtaattgaacatatttaattttgcactatcttctcaaaggcaaaataagaggggcaagagaggcagaaaagaggaaggaaggaaaaggggactgaaagagggaaaaagaagaaatatatttatcaatttctatttgagagatacaaaaccatttctatgttgaaggaaaatgggcttcttgagtatttcagaaacatgattaattttatgagactgtgtctgcatttgttctcaaagtatggtagatacctagaactttggaatttcttgagatgctttcaggggatctgcgaggtcaaagatttattttaataataatatatatcttttgagttttttaccatgttggcttaagaatgtccatgaaaaagcagtgaaaattattaattttattgtctcgatccttaaagtacacatctttttagtattccacatgtgtcaacataggaaaatacatacgcaaaaataaaagtataatgggttttgcatggtaaacacttctgaggtcatttgtgtttcaagctgaattagctaccttttttttttttttcttcatgaaacaccatttttacttgaaaggacagtcaatagaaaaacttgctgttcacacttggatacttgttacacatttctcaaaaatgaacaaagtgagccagctacttcaaggaaaataatatttacttccaagaatgaaattcaagtttttaagttagaaatttgcaaaacatgtatctgccactgggagcttgacagcttcccaacattcaagcacctttctgatgggattggtggtgagagtagcaaatgagactttttgctaatctataaatgtttcaacatttggaagatgtgtctaatacaatgtaccaatccaaataaccagtgattgatgtgacagaatcatgcatgggtaaaagatctattcaaaataccagctagatcagtagatttttacataacatagcacaaaacgtttataaatatggtgctagatttcacattacaactaattttcaaaaccctgcttattgagttttgctgaagtgttcaaggatatctctacaattatgtgaaaaggctatcaaagtacacctcccttttccaactacatgtttgtttgagatcagattgtttctatgtaattcgaccaaaacaacataacagaacaatgtcaatgcagaaagtatttttaaattaaaccaataatttttaagatttataaaaatggaaagaactaccactatactcaataataattttgttttggccgacataggtgtttttttaaaaatattatttttgatggggtaaaaataaatatttaatagactgggcacagtggctcatgcccataatcccagcaacttgggaggctgagacaggcagattgcttgagctcaagagtttgagaccagcctgggcagtctggtgaaaccccgtctcaaaaaaaaaaaaaaagaaaacaaaaaaaaaaaaacaagaaaaaaataaaaaatattggctggacgtagtgacatgtgcctgtagtcccagctatttgggaggctgaggtggaagatggcttgagccagggaggtggaggttgcagtgagctgagatcatgccactgcaacccagcctgggcaacagagcgagacagactctgtttcaaaaagaatcaatatttaatgaacaaatattttaaaaatctgttttgatttttagtatggaatgtatttgttgctatatcctgtataatcaaaagctaaagagcttcaaggggatattcaataattttcaaaagcacaaaagttcctgagacccaacagtttgggattcactgtctgcatcgttattctttgttgtaatgattgtagactggtcatcctcaactcaggtaacagattaagctaaagtaggtcaatatttctatttagaaaaaagtgaagaggaaagagagaaaggaaaggatagcaaaggcaacgtattgccatagggtggttccacattttaaggcaccctgtgtagcctgagatcagtatcactgtaatgactgttttctctttatttccataccaccctcttgctgtctgggaggattatctgtactgccaccaggataacaaacagaccagttcaaagaatcaggttaacattttctccccaatagggaaatgctaaactaggcttgagttcaagtaaagcattactgcttttaatcgatttagaaaaatagttacataactttgtacatttacgttcatgagcatcacattaaagaggtatgcttttgtagattttaataccaaaatttgacattagaaaaaaatccatttttttctgctggcttgaataaaactattgtcaaatatgttttctaggacccacgcttatatttttctctcagttttattttaaaatatgccatagatacatataagtacatgaaatatatgtatatcttagagaataaaatggaaaatgaccatgtatgtgtcaaccaatttatgaaatagaacattacaaatttgcattctgataccctctcctgtaattgaactatgttcattaatttactggaaaagtctttatattctattagctgaataattgcatttggatatgaatagtggtgcccatataacgagaacacaaatgatttttaatcagtaattactaatttcatcatggttccattaaaatcaatttagtcaacaagactcacaacctagaattttaagttcacatctcccagggccttttaatctattcttaccgagcttagaggaaaaattttcctttgctcttaaatatgtgcctcgaatgttagtcattaacttttataattgtttgctcctggtacaatttctacacactttgcaatactagagtttaagataactctgtactctaagaatactacatgttattttaaaacctttagaaaatacgcaagaatccaaagatgaaaaaaccacccataattccatcacacaacattaaccttgaaaattgcatctttatcctcctcatttaaaaatataaatatactttcttaatcctcctctctaaaactcatattgtaaataaaggagaaaaataaggcagatatctagtttaataatatttctgtagaacatttcagcagtgcaaaaacaaactaaaaatcaaactgaaataacaaagttatttggtattttaagtttctgagatcttggtttcatttttatgtatatatttcagttattttttgcagcataataaactaaaaaatttaatgactcaaaacagtaatgatttatgatttcttatgattctatagtttatatgaacagtttctctgctggttacacttggcctcacttatgtgcatttggctgagagagaggtttcaagatggcctcactcacatgcccgacagctagtgctggctgttgactgagtgcctcagttattctccacgtgactttctgtcttccatttggctagacttacatggtagtgtcagagacagcaatggcaaaagctgtaaggccttttgagaccgtggctgcagagctcatgcagcgtgactttcaccataatctaccagtcaaagcaagatacaaggccaggccttatttacaacaagagtaaaaggcatcccttttggattagagaatattaaaaaattttttgatcattaatctagcacaaagttgtaaaatgtatgaactacttactattaatgaaaaattgtgttccttttgggggaactttcttactatttgaacttatcaaatgatataaagaaataccaaacttattggggaaataagatcatgtttttctggcaaaagctgacattttcatatgaatgtatgtacaaattccaatgcctatgaagctacgatggtaacaaacatcactgaaatgagccaagtcaagattggagtaatctggaccatatatgctctatctgaaaatggaaaagtcgatggttctttttttttttggctgaataagtccagtgatgcctggaccactgatattttaaaacaaagattaaatattggtaagtaattttgttaaacaacatgaatctaaaagttacatggaaagacaagagacccagaatagagagcacaatactgaataagaagaacaaagtcaaaggatggacaccacctgacttcaagacttactataaagttacaacagtcaagatagtgtggtattggcaaaataatagatccatggaacagaggagagctccctaaaatagacccagacaaatacagtcaactgatctttgagcaaaatcaagtcagtggagaaaaaaatcgccttttcaacaagtggtactggaacaatagaatgtccatatacaaaaaaaaaaaaaaaaagaatccagacatacctttcacaaagattaactcaaaatggaccgtaaacctaaattcaaacacaaaattatgaaacttctagaggataatgtaggaaaaaatataggtaagcaaatttggcaatgcatttctaggtataacgtctaaataatcatgaaaggagaagttgataagttggactttattaaaattaaaaacttatcttctacaaaagatacttttaaaagagtaaaaaacaacccacagattgaaaaaaaatttgcaaaacacacttgtgatcaagggcttcaatccgaaacacacaacaaattattaaaaggaaagaaataaatttaaaaatagataaaagatctgaacagacacctcaccaaggaatatataaaaatggagagtaaacataagaatatgtttaacatatgtcattaggcaattgcaacttaaaacatctattatataccattacacgtgtattagaatggctaaaatacaaaaaaaataatggcaatagcaaatgctgacaaggatgtagaactttttttgctggtggcaatgaaaaattgtacagccacttcagaggacagtttggcagtttctcacaaagctaaacagttttaccatacaatctagctattgcactccaatatatttaattgagttgaaaatttatgtcctgataaaaatgtatgcttgaatgtttatagcagatttgtttataatcaccaaaaactggaagccaccaaggtattcttcaatagacgaatggataaactggtacatctagacaatggattattacccagcaataaaaataagtaacctatcaagccatgaaaatgcatgaaggaatcttaaatgtatattgctgtgagaaaaaagccagtctgaaaaggctatgtactttatgattctagtgatatgacatcctggaaaaggtacaactatagaaatagtaaaatgatcagtggttgcctggagtttggtagggatggcaggagtgtaatgaataggtgaagctcagggatttttaggatgctgagattattccaaatgatatggtaatacatatatatgacatgcatttgtcaaacccataggattatgaaaagtaaagggtgtaaataatgtcagctatggacttcagttaatgataatgtatcaatattggttcatgaattaaaacaactataccacattagtgtaagatgtttgtaataggagaaactgcattgcaagggatggggacctgatatatgaggatactctgaactatctatctgttcaactgttttgtaaataaaaaattttaaataaaatattaaataaccattttgtgttgcatgattttgttttctgataaaatagtttgagtggaaaacctcagctgggcttggtggctcacgcctgtaatcccagcactttgggaggcttaggtgggcagatcacctgagatgaggagttcgagaccagcctggccaacatggtgaaactccatctctactaaaaataccaaaatgagccaggtgtggtggtacatgactgtaatcccagctatttgagaggctgaggcaggagaatccgttgaacccaggaggtggaggttgcagtgagctgagatggcgccactgcactccagcctgggtgacagagaggctccatctcaaaaataaaaataataataataataataatatatataaatgaaaggaaaaagtgtcccttccatgggtaaattagtagcatcgttgataggtcctaggtaatttttttttcttttttagctagaagattaagtagatcttgatgtttttcacaggggatattgtagaacggtattgtatagtgtaagttgtagaaacatttctaccgaggagcagatggtaaaagtaaaatattcaaatgcataggcctctaatatcaaggcaactatttgtaaatatatattttgggaactttcgtgttcaggaaatttattattaagcagtattgtctttcaaaccatatttgcgagatttgaaaagtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagagacaatgtaagttcagactgtttgttggtagcaaaatgattcgttatttcagttgggagttagaactggtaatggaaatacaagttggattggtggtaggataggtttatttattacacaaatatttatttgagagtctactgtgtgctgggccctccctttcctttctcccttccactggagaaaataatgtgagcattgctttgcatatattattgagatgatgatgagtctaattttttctttcttggacaaatgaagtagaggcccccgagggaaaagcaaagtctatgtactaatacagaccattaaaaaggcaatctaagaatataattttaattatccctaacaatctaagcaaggtgaattgacaatctgtggctcacaaggaggagaactgctgacagtggtggaaagctgcccaagagggcattttatgctaaagttgccctgaagaaacggaagtagacatcatcccagaaggagtttgactctgtgataagactcaaaccacattagacagaaatgttttaaacaaagtcagcaagagttaggatcagttatggttgccaattttcaaagactagggagcaatatatgccatttcttcatacacttttaaataaatgtttttctgattttttattcaatatatcttggtgcaatcatttcagtaactttatgtagtaaggtatggactcatttttattttaagtatagtgtatttgagcagggaatcaccaaaggagtagaattgctggattaccaaacaatgcttggtaatttgaggaactaccagatggtgttttaaaccagtgacacaatttcacattccacccgtggtatatgagtgtttatatttctctgaggttacagtgagtcattatgtatatatgtgcaggcaggtagaatgcaaagagggagatttttcttatttttaaaacaataaaataatatatgacattcttgactcagaagaagatagcagtgaatgagtttttcttcttcctattaggttggtgcaaaagtaattgtggtttttgcccttaaaagcaatggcaaaaacacaattatttttgtaccaacctactacctcctcattcccttccatgtaaatggaggaacaattcagttcccattttccactgtaagcctttttgtttaatggacaatttatgcttatcagttatctcccctaaaatcaagagcatttgtatgattgtgactttatttggtgagacaaggtctctctgtttcccaggctgaggtgcagtggcgtgatctctgctcactgctatctccgcctcagtctctcaagtatctggggctacaggtgcacaccaccacacctggctaatttaaaaaaaatttttttgtagagttgaggtctcactatattgccgaggctggttttgaacccctggagtcagtaatcctcagccaggacaaagtgctgggattacaggcatgagttaccacacccagccaatgtgacttttgtcttaaattctatccatacctcttccttctgccacttgtgactttttttactcctccaacctactccagtgtacacttgagggtgttattgggtaagcggccatgacatatcattcggactctaaactttgtacagtgagcgagtgacacctaacctgcagagttgttaccaagattagacccggtgaaatagtccatgttcaaggcaactccagctcagtgcctagatacacaaatactttataagtggcatcataatcattgttttttaatacattgttatgacacgcattctccgtgattactcaaactcagaatagcaagtctcattcagatcatgtgtcataagtttgatgcttggctgaggtcagtgactcttcatatctgctaatattttagaaaaactcaaggtggaggaaaaaatctgtgataaagattcataccataggtattgtaattctaaagacagacattagaacttaattaagcaagacagtgagatttatcacagcatatgtgatcatgaaccaaactgtggaagtgggagtagagcaatagtagtgagagaagatgagtgatgtctggtagtggcaataagctgtacatcctagttgtttgggtttgaaccagggtctggaacatgtgaagcattctagaaatatacactattattatttaagaaaaataatttgagctaaaaatactacagactttcttgaggggagctcaagaatcatagtatcattatttataccttgccaaatactaagaaaaatatcaacattgtaagttattaagaaaataacccagaaaataagcattcacaattaagttagctttggataagaaggaatattaatcactcacatatataatacatatgaaaactgtcaaaataagtaaataggatttggtttaatgaatatggcctcagtgttgcaatatattaaacctagtcatcagccttaagccctctttttcttataccttacattaaatccataacagttcaatctccaaaatatatttcaaatctgtccacttgtcttcattctgacttcccccaccttatctcttcccccatccaactgctcttattcataacctggaccagtcctaaaacctcctaacttgtctctcttccattcttgcctttctataacccattttcatccagtatgatcttgtgaagaggttaatcatgggatgcaccttcgtagaaactctcaagggacttccacttttttcttagactaaactacaatctctctatcacatcctacaaaccactgtgggatttggtttgtcttcacctttctaacttcatcacattctaccattattcactaggatctatcaatatagctcctgctttccccttatatgcactaaacaattcccagtctcaggatatttgggaagctccccatatgtctagaattctcttctctcagctcttcttgtggctgactcttcgactggatcatagcccaaatgctacctttttatgggggttgtccttgtccattctgattaagaccatctctcatagttactgttatgcagttatttattttcctttgtataacttatcacagtctgttattatctacttgtttattaactgttgtttttttgtctccccagtgaaatataaaccccactggagtgaagtccttattttatgtactgttttacttactatgtccccaaaaacatataaataaataaactctgaatgatttgttaccatcatcatccacattgatgttttcataacagacatttattgggcacccattatgtgccaggcactttgcacaatgccttgatttctcttttcatagtctcaatatattatggagatactatttttaatatttatttttctctccactttaaagatgaagaaattgaggctcctcattatcatcattttcatcatcatcatcatcatgccagaaagtagaacttgaattgacattgttttcctttctcataccatggtcagaggaaagaatagggggcccttgggtgcagaaaagaataccaggataacccaaatgagctggtcaaacaagtagattatcagggattcttctgtcaaacaaaaaatagaacattgtgcaatttggtgtaatctttgtataatgtgtatttctcaatgtgtggtcttcagaccagcagcattgacatcatccatgagcctcttagaaatgaaaattcactggcctcacctcagcctgctgaaacagaacctgtagggttgggtcccaggaaactgtgccttagtaagtcttccaagtgattcttaaacactgctttgagaaaaggaagaccatctggtggtaagtaaaggaaatggaatgttaacaagagtaaggcaagacatttatattcagaaaccaaaccaacgaacaaaagtaggtttagtaggccttgtataaaatgatggatctcttattaaaattggagtataagggaggggcatcatgataaggaagaacagtcgaggcagagaccagagtaagaagtcagagtaggggtagatagccttcaggcagactagatcttcttgtctcgaccactttcactcaaattcttaaaatatcccttgtgtacataagattagtgacagaacatgaaattggactaagcccaaagtagaacaaaagtagctccaccatgattctatttacgctgattggtagaatgtgctcccctggaggatgggccattatgactgcactgagacagatctttaagtttgcagatgactctgaagctgttctagctggggagacaagaatatttggtaaagctgtgtgaatggggaaaataatagcagataaatttcagctgtggaaagtgtaatttaatatatctagggaaatataatacaaactatgctgatatgatgatgtactctttctgctatcacttatttctagaagaaaagatatcttaattgatgtcagctatcccttgaagacagtccaatggagtgtggcagttcaaaaggtcaatcaaatgccagagatcaccaggataaaactggaggaaagcagaattacaagatgttgtttatgtttgaacagagtagtattttagtacttggagtagagttcaaagttctactgagtacattctggtaaggtcataaggcagttggaaaggcctcaaaggttaactgaaatgatcaaaggaatgaaatattatagtaagaccagatgagaaattttcagcacagaaaaatgatgggtgaaaagggacacaatcaaattcctgaccatgaaggatattagtaactgaaacatggacttgttcaacaaattcaagaatactgtaggagaactctcctgaagcttgaaggtacttttaggacaaagaaaaaaagtttaagtctttttaatatagcctatagtaaatttactgatgctgttcccttctagagggttcatgaactggaaagataatcaggaacaaaaaaatatatatttatggaagatgagattccaaatggtttataaaagggaagctgtagattattatggatattttagtgtttaataaaggtagtactcagggcaatatgaaaaattatgcatctttataaaaaatgaagtccaggaattgatgactaataccgtattatagtttttaaatattctttaacatacatatatacatgtttgtgtgtgtgtgtgtgtatatatatatatacacacttgtatgcatatatgtaaaaatgcgctcatatacacacactatatatgcatatacatgtatacatttatatttgctttccttttaaaaggaaatattttgtcattaaagaaacatgtaagcattataggtaaatttgaaaatacagaaaagtagacaaaaattacatgtagcttcattcaccaaagagactactattaatatttcactgtactacttacatgtagtttatatatttcatattttctgatgtttatttttttattttatttttttcttttgagatggagtcttgctctgtcacccaggctggagtgcagtggtgtcatcttggctcactgcaatctctgcctgccaggttcaagcaattctcctgcctcagcctcccaagtagcttggattacaggcacctgccaccatgcccggctaatttttgtatttttagtagagacaaggtttcaccatgttagccagggtggtctagaacttcttacctcaggtggtgtgcccaccttggcttcccaaagtgctgggattacaagtgtgagccactgcgcctggcccattttctgatttttaaaagtaattactgcctgcaggattttgccactaattatgtagactgttggtttgagataggtattttttaatcaaaataatatgaaaatactaatataatgtaaaattcagtttatccatgtttagggtttttatatattaaaattaatttagtctatacatcttttgttttctgtcttaatctggtttaatattcaagtttgttcaactcatgaagtaaccacttttctaatacattatttctttaaatatcccattttatttccaatgccttttgttttatattttaatactatttagtatggaaagactgttttaggtgtgtcttttaatagcatgtgggtgcctcctatgtttgttcatatctaactattttcatgctgctgataaagacataatcggggctggaaagaaaaagaggtttaattggacttacagttccacatggctgggaaggctcagaatcatggtggggcaaaaggcacttcttacatggcagtggcaaaagagaaagagagatgcaaaagcacaaacccctgataaaaccatcagatcttgtaagacttattcactaccgtgaaaacagcatgggggaacctcctccatgattcaaattatctcccgccaggtccctcccacaacatgtaggaattatggaagtacaattcaacatgagatttgggtggggacacagagccaaaccatatcacttaccaatttgaaatattttgccttttccaaggagggtttggcttgttcatatttgttgtcacatacaaaataattatcatgagatatttgaagcaaacagggtctggctttgaatattgatactgtttattagctatattacaaagttgtatgaagattttaatttaatggtagatataaaatacttaataaaatgcctgccacagagtatgcattcaaattattgtgattatttcctctttgttatttatacctcttttgttttaataccattttgatgtttgtttgtatcttttactatatagtttttgttttaattttagtgcaactcagaagatagaagcactattataaattttacaagcaattaactttagactgatagaaataggtatttaaatgtatgaaaggctgatagagaatttagaatgccattatttctgctgcctctttctcctttggatttcattaataatagtactttcatgccaggtacattttctttatgtagaattgtttttgaaattttcctttgatttttcatcctatctgctgtaattactgtgcatatttaatcatgtccatataagcatgttaattgttcagtgacagaagtagaaggtgacatggcaagagaatgactgatgtttagtgaactatttgaagagtacatctgagagttcaagggtacaaacagtaaaaatgttttgtaatctctatatcgctgtgtttttttaattgatgcatgaaagcactttctgcatcatttacacaaggaccatatgtatttacagttaaaatttaaatattttaagacaagaatgaatgtttcacatttatttttattttctggcattcataaaaactgtagaggatattctgagtttatgttgtaaattgtaattttccaaaggactggcaatttatggtttttttttttgtttgttttgttttgtttgagatggagtctcactctgtcacccagactgaagtgcagtggtgtgatcttggctcactgtagcttccgcctcctgggttcaagtgattctcctgcctcagcctcctgagcagctggggccgcaggtgcctgccacgacaaccggctaacgactttttttctgtatttttattagaggcagagttttgccatgttggccaaattggtctcgaactcctaacctcaagtgatctgccttcctcagcctctcaaagtgctaggattacaggcatcagccaccacctctggcttgacaactagtggttaatgaaaatatcaaagtttgacaactaacttgggttttaaatagtaaaataaaaaatcattctaataacatttctcagtctcactttacacaaggaataagaaaagtgatggaagaagagacgcttccctggtaatgtgatgcttaaaatccatgtttgcctattacgatgagaacaatattttggcaatctgagaagataacttaggatgttagatctgagggattgtctatactttgtaggaaatgatacttcgaattccagagttcagctaaggctgaaagttaaaggcaggatcactcaggacctggaactgcagcaccgtttctgcatccaaaactagctgtgcaattgctgcaaataaaatctgagcctaaaggcacaatatttgtccgaagaagccagagaagtcccagtttttctttaagagttttacaagcaaaagcatatagaaagccctgataagtgacaggagaaggagtgggaggtaaaaaatgtattaaaaagcaaaagaagtctatagcactggagctttaagagtagtctccagaccagaaacaggatcacatgggaaataggttagaaatgcaaaattttggatatcttcccccttctaccccagagctactgaaaataaactatacaggaagagaatcagcaatctgtttcatctgggtgattctgatacaggagaaccactggactgtagacttgatcaagggtcatttagtgtgtggatcaacaacttcatctcccactgaaggctctgttttattacatcataagttggtatttatgataagaaaagagtatccaaagttttagttgtctatttattttagtctgtttatgaaggcagataaatcatatatctcaaatagcttctcatcatctttcttgggggcatttgaagtggtaaccttgagctgtgaaatccacttgtgttctaaaatactcaatttctgcacaatatgggataaatatcatgttaccatattgtgacatgccatttataaatgaagaccagtcacacattcctgctagatttgacaattattctccaaagtaacctctaaaaataatttgacaattatgcccccaacctctgttgctggtgctattgtttcctttaaaaatatgaacttaggttttaacaagaaaaaatacctttctaagatttatatgaacaatgcttaagatagatgatctttatagaaaggtaaatgtgttatgtttcttctaaacacatttttctacactacacaaatttaatagtgaaaatatatgaacacagtctgctttctgaaagaatattataaattattcctagacttaaatttgcatagtcgttagaggaaataaatatgctatctggcatattagagaggatatctaaaattacagataactagaagttcatttctagggcattagacattttcattatttctattattgctttattattgttgctcttaagacatgaaatgaatttttagaaatgcccctaaatgcctttaatcaaattacaaaaaagagcaccaattcttctgagttgatgctggcactgccagtgtgcactggcttagagagctgagctgaaggctggatgtcagctccacttgtccctgggcagagacctctgtgcagtgcacaagctgacacagcctcccccaagctgtccactgcttgtcaaccatgggtcacaaactgacaacctaacgtccaaatgtagcctacaggctttgtttgttttggcctagtaagtagaaatagcttcaattcgtggccagtagttttgaattagaaaattttgcagaatcatctgaattcctctggaaaactagaagacatggcaacctggaacttccattcctgactagtaacaattggccggggctaaggggcaacttccctgctagaggaacatgtgctcttcaggtcacagttcccctgccttcctttgtattcatctggcctctgtgaacatctaggtttacaatttggtatgactcaatatagtcatcacctcttccatttttctctccaggtaggtttaacaacttttaaactctgtgtccactgaatcaagtacagatttacatagcagcatctgtaacaactaattgtacctctttgtttacagccttttccctacaagacagtaaacttctgatgaccagagatcagcctattaatccatctctgtaattccagtgcttattagattgagttgcatgataaacatttgttgataagtgaaatgaactgttttttagaaaaatgtatggtggaggtagagaagcatacttcctatttcccttctgtactacgtaggtattgccgcaataatactgtctaacacactacctaaaacttagcaacttaaaatgacattttttttttctcaagatgatgggtctttgggttggtggcagttcatctgggctatgggatttagatcgtagattgggttcaagtctgccctgtgtgcttcttctgggtcataggcagaagggactacagctacctgaggcattttctttccatggtgatagcagaaattcaagggagaaagctccacaatgcaaacacatttcagctcttcttacattccatctgcaaacatccaccttggccaagcccaaagtccaggggtggaaagtaacttccacccaccttgaaaacttggcaagaatgttaatgcagacatatgaagaattgtgatcaataatttaatccagggccaaaattagggtaaggcaggtgaggtgcaaaatttaagaggtgccaaaaatctcgtaataaagatacatattttaatacttaatttttgaaaagcaaaatcaacgcaaacatccataataaacaaaatatacaaatattaaacacagaatctgaccacccatctgcatggctcacctactcacctcacctgcttcattgccctgttgggtcttatctcaatatcgatcccatctaaaacactcctctgagtggcagttaacaaactgctcttgcttgtatcttgagtctctgcattggtgtgaatatttgtatcaaaacattaagaattcaagtttctgggagttttattaatatataattaagctatccctagaaaaacagggtttagggcaagtagtttttaacacaaaacatctttaatttgtaaaaactaaattatgtaaaaataacattccactagaagccttttagaaaagtttgcattttttcttatacaatgcaaactgtctatatatttgtactagtcaactccttatattgtccaaatcctgaatttcatcatctaagcaagaccagtttggcatcagatttaagcaagatatccatgactacgaaattccctatagttggacttgaggggtagtaggagagctgatatagcaagaactttccagtccacttgaggatgtttctataaactttttcaatgtaactgacctcattacactctgcgaaggtgtaactacacgtatcccactgcctcttgggtcagtcaggcaaatgaaaagcaatcatatcactctttaaatgttttagcattttccagcttggactttgggaagtgggatccagtctgctcatgggatatgtgttgactacctcttatggaaggggccgttccatgccatgcatgctgccagacagttgtgctactcctggctgcctgggttccttgaagtccattcccagtgcaggacaacctcacggcaacattgacattgcacgttcaagaatcttaaatgattcttactgaatttcaaaccttgaggagaggacactgtggtggtatcagtaaggatagctgggacatatttaagaaggactgagatgaagtaagacctgaaagacaagcgtccacaatttctacctctaaaaggtagaaaggcatctaaccatttaaaaaatacattatcatgaacaaaacacagaaagatgtatatctctgttggcgttctagctaaataaaataatagcagtatgaaaaatttttaaagggagatagtaactggaaaaatctaaaagaatgttgttactgattcaggatatatattttcagtgtgctgttccatgtgatatcatgggtattttatttttgtgtacaatagcttcatagggactctgcagaagttattcctgagtcctatcttttaccaatatcattatgtttaatgaaatcataagtttcttatccataattctatcacagtgttgatgtgtgtgtgtgtgtgtgtgtgtcttatttcccaaaattggaaaatataatgagacaagagcttctatcattatgaatgatattgaacaatgatattgaataatgatcaatatctttcaaagctatcatttattgaacattagctatataccggatactgtgcaatatatttcatgtgaatttatgcttctcttcattacaacccagtatacatctgtctccctattttacaaattagaagacttagattgagaaagggttaaatggcatgcctacatcactgatagatgtccaagttaggattcatgttcaccttctttcttctcctccaaaactgaatccctatggggcacccctgctttgccattcagccttgagactatgtttcagctgctgtgtagtttcccttctcatcacactaataaacactacattcatgaagggttgttttacagcagactttattcttaacatttacatatatcatttcctttaatcctcatatgtcatatgttgttgttgttcaccattctacctgtaagaaaactaagtctctgagagcttaagtgtgttgcttggtcacacagctagggaatggccaaatcaaggttcaaacccagatcagtgcaactctagatgtcatgcttgtaacccttatgcaaagctgtctccagtcatgccatgcttcctctgtgatacagcaggaaactcactgaattaatagtcacagatatcaggtttttatcccagatgtggctattgccaagtcctgtttctttatctgttaaactgtgattaatagtccctgccctgcacaagtcatatcattgctgtgagacttcaaccagaaacaaggacagggaagcttgaactgcaagctcttgttaaagtactgtcagcaacttgagaggctgagactgctgtaacaatttgctttgtatctcacataagcctagaagagttcttgactctgaagcttatcaggacccagccggaaagcaaatacacataaactgctggtaaaagaaaagtgaagggcatttcttggaaatgggaaaaggctcttcctccttcccctcctgcccctacttaggggcagaaccatcccaaaatgtaatcaagaagaacagtttgaatactcaaggttttatccttcctcattaatatgttttccattatttgtacttccattatttgttcagttctattttcccctaatttgttgcttcttggagtcagcagtgagtaggaaatgccaatggctgatgattcctcaaatagccctgaagatttaatcctaagttctgatgacccaagtatgtgtggtaaagagatgactgctttcctcttgccttcaaagtggttttcagcagtgctggtctcagctctcttgaacctgcaggacagacagtggcaacactcttgtcaaggagccagagtctcagattataacatcttggtgataatatattttgcctgttgccaaagcatttcatttaaaggtttgggcacatgtaaatatatttctggctttccttttctaagttccctcctctaacctctttagtctcaatttgagtttatttccatcatagaaaaaagaatgtagaaggctaaagccccattagtaatacagtagtcagggacatctcacctatttgacaattatttattgaggacctatgtacacaggcactctgctaggtaccaggggcatggttggcactggagacatggttggctgttttctgccatttagaagcttaaactttccatttctatattgtttgaaggctgtgattatcttcctgataatctacgtgctctttttatacttctctccatcaaatttttgtatctgtctcctgattcatcaagttatcccccagaataggggcttttagggaaattccacagaaacctgaatttcctactctctcttaattgaaaacaaactctaatttctggacttactctctctgtgtctatacaaacctgtccatggccattttcccatcctgggtgtgtcatgcagccaggctgactcatctttccttgtaataaatcaactctttaaaaaccatcaccacattataacacatctgagcatcagcactctgacaatagaatataatttgatagcagaaggctctaaacaaattcctttggacaagagagatatagattatataactcacacccaaagatatttaagtcaaatcaatgtggccaggccatttaactcaccaagagagaagggttacagtcggttacttaaaagcctccctatcttttaccttatggatatgggcatatcaagactgaatataggctgggcgtggtggctcacgcctgtaattccagcactttgggaggccgaggggggtggatcacgaggtcaggagatcgagaccatcctggctaacacggtgaaaccccgtctctactaaaaatagaaaaaaattagctgggcgtggtggcgggcgcctgtagtcccagctactcgggaggctgtggcaagagaatggcgtgaacccgggaggcggagcttgcagtgagccgagatcagatcgcgccactgcactctagcctgggcgacagagtgagactccgtctcaaaaaaaaaaaaaaaaaaaaaaaaaaaaaaaaaaaaaaaaaagtctgaatatatctctttagctatgaccaccttgaaatggataatcagcattttctcctaaaattccagatttttattccaaagcatctcctggcttgttgctcggtcctgcattgccagcaagctagaagccactgttcggtaatgtttcagttgagaatgcacggaccttgagggttagtttgccctcaatcacagtgggcaggagtggcactgacatgagaatctctattttcagagttctagtccagaatttctgttacactaacctgcctccatagggcatatgtactttacaaatctttttttttaactttaaaatctggaatgcatgtgcagaatgtgcaggtttgttacacaggtatacatgtgccacggtggtttgctgcacctatcaacccatcatctaggttttaagccctgcatgcattagatatttgtcctaatgctctccttccccttgcctcccaccccccgacaggtcccggtgtgtgatattctcctccctgtgtccctgtgttctcattgctcaactctcacttatgagtgagaacatgcggtgtttggttttctgttcctgtgttagtttgctgagaatgatggcttccagcttcatccatgtccctgcaaagggcatgaactcattcttttttatggctgcatacaagtcttttcaaaataaatttatatttggaaagcagtatgtagactcctatgggaaaagtatcatttcaacttgatgatagctaagtattctgaacatgttaattaatgttttattctccagatatgtagttagatctccaatagcattagggtcaacattgtgtcattttgcataaattgcaaacacattacaatttgtgttattattactaatagttggataggcacccatgcttatttccatgataaggagaatataggcaagtgtagaaatttgcagtgaattgttcaaggatgcccaactagtatgtatgatatggggcagtattttcaatgaagatgtgcacatttgctgggtctatagatgtagataaaattattgtgaggaagtttatatgattttgtattagggctaatctagctttgaaaaagatcaatctatatattatgatcacttcttctctaacctgacacactgttcataaaatgtgatctttcatattccaaatgaaatgcatttttttccctttctctatgccttaaattgtccgtgtccttattttccttattttaatgttttctttttctgaatattttctcaagtattttcaacttgaaaaggagtatatgaacactaaaaataacttcaaacagttcagcagtatctaaaatgaaatgtaaacatcccctctattaatgtcttcctctcatatgcacatcacatctttaagtgtttctcagatatttaacaatctacacttggaatctgcttgatcaagaaaaaatgtgtggagggagaagaccccaactattttcttatctacttatattccaggactgttgtgatgattacataaaatagggtatataaaagtgatgaggaagttagaaaggccataccaatttaagttactgcattcattgtatgaaaagctttctactcagctcaagtacccccttttgtctgtatagctttggcttttgtagtgcttagtgtcatttccataaacagagctaatttacttctttatatgttgacaatcatttaaatgatttctcacttatttaaatcctataataggctgggcatggttgttcgtgcctataatcccagtgctttgggagatcgaagtgggaagattgcttgaggccaggagttcaagactatcctcggcaacatagtgagatcctgtcttacaaatatttaaaaattagctgagcacagtcacacatgcctgtagtcccagctactcaagaggctgaggtgggagaattgattgatcccaggaagtcaaggctgcagttagctatgattgcactactgcactccagcctgggcaccacagtaagactctcctgtctcaaaaaaaaaaaaaaaaaaaaaaaaaaaactcataacattgcctttaatacctctctaatattccttacatcattctacggtatttttatctgttgtgaagtcaaatatgtctctggctcaatccccaagcagtaaccaacatcccttttcaaagaagatatgcttatcaaatatttacgttttaaatgaattaataaacaggtgagttacagaaatatttcaaagtcattgtgaactttcattctcagtgcttagataacaagtcttaccaagacatacagaagtgtccatacatcctcaccccttctctatggttgccccaccgctgttagagcagtcccaaacatgagacaacaatgcacagcctcgactgatgtcttctccagggctttccgcctctgtgacccagtccaaattctcccacaggatatattgggtgattcctgctgagttcaacctgtatctgcctgatccatttgctagtggagtcctttggaccttccagaacagtggcctgtccctacccactgagtcattctaatgtagcactaaggcaagaacatgcagcttatctatttgtatcagtgactttcaaagctgcctgaacaaatggttctggctggatttatttcaaagcattgactacggcaggcagaaagcttcctgccaggcggttatatttaccacacaaatttgtcagcttaaccaaacatttcagtgtgttaggagcaggaatttgaattgattgatctaaagggctcaaacactatgaaagagatgaaggtgcatcagctgacattacagtgtctgcacgagtccaaaatgatcactaaataaatgttacttttcagaaagattgtgctgttatcttatctccctcccatactgggtttgcaaaagcaatcggagtttcatgagtgttggaatgtttaggctaaaacaccatggtgatgttagcaacaattttgaggtgccctgatatgtttaaattatatagcaaaaatactattataaactctgagcaaaattgtgggacacagggatctttgaattcttactacagctttcacatcacctccatttatatgtacctgtgttcaacttccctttcattaaaataggaattattcattttcatcgtattgctggcatactctcttcataatccaaccttaggcttgcaataaaaatcttcacaacccaaataccatgagaatacttgtggttaagcctagaaaatattaactgatcactcaagaatatatataacaattttcagtatactagaaaaatatcactagtttttttttcagtattttttggagatgaaataatcatactgtttgtaattgtcttaactattaccagctttatgtaatttgtcattttactatattctacatatgtactctaatttagtctgacttattttattctgccaatagtcatttggggaaaaattacagtagtaagacagaattttctgaacatttaagatcacattcaagcaagaaacaacatattttgcaaatgggtcttaggaataccctcagagaagcgtagggaaatatttgagaaaggtcttatggttctgcaaggatcttggaatctacaaggcagattaatagcccaattatttccacaaagctattgccaaatttcttacaactgattatttaagaagcaatttttaaaagccacattatttatattaattgaataacaatataaatggagcaaatggagttgattcgttcctcagtctcttgtaagtctattgtggtaaattcattatagagaggagttgtataaatattctaatttcaatttctctaagtcataactgaataccagcttaagttatgtctgtatgctttaaatattttttaaggtggtaaactttacgaacaggtttaggttcacagcacagttgagcagaaagtacggagttctcataacattccctattttcatacatgcacatccttcctcactatgaccatcccacgcctcaatgatgcattcgtgataatcaataaacctatattgagacatgattatcacccaaggtccataatttacactaggtttcacccttggtgttgtacatttgtgttatatgggttttggcaaagatataatgacaagtatccattatagcatcatgcatgatagtttcattgtctaaagaatcctttgtgctctccctattcatcccttcctgcatgctgtgccctggcaaccactcatctttttactgtctccgtaattttacctttttcagagtaccatgtagttcacatcatacagtatgtagccttttaaaattggcttctttcacttagtaatatgcatttaagttgctgtatgagtttagtagaccttttttttttggcaccaaataatattccactgtcaagatttaccagttgatttattcatttacctatcgaggggcatcttggttgtttccaaattttggcaattgtgaatagagtttctataaacaactatgtgtagatttttgtgggcatacattgtcagttaagttgggtaaatatcaaagagcataattgctggatcatatgtgaagagtatgtttggttttgtaaaaatctgccaaactgtccttcaaagtggttgcaccattttgcattcccaccaataatgaataagagttcctcttgctccacaacctggccagcatttgatattgtcagtgtttgggattttggctattccaataggtttgtaatggtaccacattttttgtttttatttttaattctcaaataacataacatatgatactgaatgcatgttattaatgtatacttgcttgccatctgtatatttatcttctgtgatgaggtgactgtttatgtctgttgcccattttaaaaatcaggttgcttgttattgttgagtttttaaaagctttttgcatatttgggctatcattttttttttttaaatcagttgcatgtcttacaaaggttttctcccagtcagtgacttgtcttattctctaatcttgtctttcacagaacagaggtttttaattttaacgaagtccaacttatcaatgatctctttcatggattttgcctttagtgttgtatctaaaaaatcaaaaaaacctaagtcatttaggttttctcctgtgttatcttccaggagttttatagtttagcattttaaatttagatctatgatctattttgagttaattcttgggaagagtataaggtctgtgtctagatttttttttacatgtagatatccagttgtttcagtatcgtttgttgaaaagactgtctttgctccattttattgcctttgctaatttgtcaatgatcaattgactacatttattaactatatttgaaaatagctttctatttctgagctctctgtcctgttccattgatctatttatttattcttttaccaataccatactgtcttgattactataaccttatttagttatagatttatagtagtaaatcttgaaattgaacagtgtcagtcctccagctttgttcttacccttaaatattaggtttgctattctgggtcttttgcctttccatataaactttagactaagtttgttgatagccacaaagtaacttactgaaattttgattcagattcacatggactctatagatcaagttggggagaaattacgtcttcacacaatcagtcatatcaatgaccatggaatatttctcaatttatttagtttttctttaatatctttcatcagattttaactacattttcatgcttaatggattaaaatttgtaaacatgttttaattaagaggaaatatttttctctataaagctcaaatttgattttaaaatgaccaaagttagaatggacttcaatgaaacaggcaggtacactttttccagttgagttcaatttgtcaatagcaaggccgaaaacacgcatattgctttgaatctcttgcaacttcagtgccctaggattgatgtaaatacttaattatttctgagtacagcagacaattctctcaacactaggatagactatttcctgaaacttcgatagaaagaacaatcaaatggtgaagatatgtgaaaggatatgttgttcaaattaaaaggtttgctagttcagtaaaattgaaaaaatgtaatatttatgatcatttatgatctttatggaaccttaatgacctatcatttggagttttctagccattagtttatatattcattcattagaagtgtatggaaaactcataaaatacaaccaatatagtagattataactttgctggaaaaatagacatttataaataattataatataagggaactgaaagtagagcaatcgatatttcaaaaataagtgataatttgagctagttcttaaaatattagtagaatttttttcagcagaacaaaggaactaaagagatgcaagagaagagtgtttttaacaagtatttgtagaacatctgctaaataccatccacataattaatattaataggaccattatctcctgcattttatagacatattttcttttgatcacatatctcacaaatattgtaaatgtgattttaagagaagactataaagtatgtgtgaacagaggaaggctctctcactccactgtgggttttcaggaaggaccatgagaaattagtgtccagggcaagatctgtgggaatagcaagaacaaaggccaggaggtatagagagtaccttgtgctccatgtgcgaagaactcaataggatgtgagagtggtaaatgatagaaaatgaggtttaagaggcaagcaagaacacacccacagagccttgcaaactaccttaagaacaccaagatgtcatggatagttattatcaaggaagtaatatgttcagatgagcattttacatgactgtgcctgctttagcacagattgggagaagaggcaatgttagaagctggaacaccaataaggctattgcattgattcaagatactataatctcctgaattagaacagtggtatggaaaatgaagtgcagcaggaaagcacacaaaaaaaatggagtggcacatgctctggagtgaggaagctttgtttatttctttgtcaaatcagcttgttcttttttcatattgttctttctttttaaattatagtttctatttcttctatccttttattattttgtatgatttattttatagcatcttttagtttttttataatctgcatttttttgtggtaacaatctatcaaaaatagataatctatcaaaaaatagatttagaaatctatccaaaaatgtattcaatacttgtaacctgtaattattaataatattgatctgtgaatggtgtaagttggaaatttgtacttggatatgagagagaagcctaaagtggggaaattatcctcataaagcagaataaaaaatagcttttaataattccatattttcaaaagataattttcaagggtggttaagacacaggttggtattaggatacaagagacaggaaaagaagtgaggaaatatttcaaaactctaggaatcagcagttgatgacctaaactggggcacggacaatgaaaatggagacacggaaacacatcagagacagaaagatcaggacttggtggccataggcatttaggataaagaaggatgtaaatttaaagataactcacctgagtgacagatgaggaggtgatatactcagctggagaatattgaaggaggagagacatgttgtcgggaggggtcaggaatgagttcatttgtggatactctgcttgaagtggctcaaggaagctctgaaagtggttgaagctagaagtaaggatttagagcaagcttgtccaacccacagcccgcgggccatatgcagcccaggatggctttgaatgtggcccagcacaaatttataaacgttcttaaaacactgaaattttttgtaattttgttttttagctcatcagctatcattagtgttagtgtattttttgtgtggccgaagacagttcttctaatgtggcccagggaagccaaaggactggacacctctgatttagaggtcatcaatttggtttagtttttgtgaataaataacatttcaggggggtgagggaagaaactataattgtaaataggtcaagaattgaatcgtgtgaatgaaagagagtaaaaacagagttttaaatgagttcagttggctggatttgcactgataaaacatgaggaagtaactaggtagaaactggtttgcttttcagagcattcatgtttaagccagtcccagaaaattgttcatgttaactcaaatttataagtgatggaagactacttaaaaccaactgattcactagctgtgtggtcttggatgagttattgaaccctctaaacgcaggcatatacacttctgattcaggagctacatttgtatgtttgttacatggatatattgtgtgatgctgaggtttgggcttcgatggaacccgtcacccagatagtgtgacgggtttgctcccctcccttcctccccactttttgagttcccagtgtctgtcattcccaaacttaagtttatttaaattttaagtattgaaaataaaattttgtctataattttatcaagcactagatgcagttttttaaatcatcacacatgggaggcacacaataaataatatttattcataatggttccaatgataaaatgactgccaagcagaccaagatatatctgctgtttttgctatgcatctggtttacaaaataagtcaatatactattcaaagaatttcatgggatactagtatgttttcagagtctgctggtgagcactgagtgacagaaaggttagctgggggaattaggcagtgattctgtatcataattgtagctctgaaccttcttcgaaactttgattttttatgtgtatacattcctgagccctactgacttcatgctagacactgaaattaccagaaaacaacagcaaaatgaaaaggtatagtttctactaacatggactttaagtaggcttggagatacacgcacccacgcatgcatgcacacacgcacacacacaatatagctactcaaaattttcctggagctcgaaatttccctgggtttcaaaactatagattttaaaaaatttctaggttttgtgtatattacaaaccttgtagtgttagagaatgacagattaaggagggaaaacttttatcaagtaaatatccctgaaggattttcctgtaattaaaattttttaacatttgtgataaattacataaatcactacactttacattgccagcagaaatcaggttagacttttacatctttcaacttctgggtctgtcactcatttcttttaatgtctacatttttaatgttgctttaggcctgctgtctctactttactaattgacatactttctttttctttttattctacccatttgggaaactcatttatttttcttcaatcatctttaaaaaattgaccatggttcatcacagtttattacccagtgactccaaaatcaagatgacatatttgatataaatgtgatcatgttcagccaccattgcacaacattgatagaggatcaaagcgtacccaacattatgatatttccttgtactctttactgacttcattagcaaactgagctttgtaatttggcttcctctccctctttaatccctccaacacggttactctcataaaacaagtcaaattcactttctgtgaactccaagggattgttcaaaatcaagaccttattgatggattgatgtttgaagtaagtaaataacaggattaaaaatatttttgccatatagtgatattattttatatttatatttttgtagtaagactaaagtaggtcacacgctgaattttgatggctctttagagagccgtacaatttcattgcttcctataatcaggaccaatagtacccataaacacatgcttatgttaattgagggaacttaacgatttttaaaaactctatgatacagcatttactaaatatttgaaattctatgttgtatgctaagaagttatttctaaagaaaggcccggtgtgggggcctgttgtgcggtggggagagggaggagggatagcattaggagatatacctaatgttaaatgaagagttaatgggtgcagcacaccaacatgacacatgtatacatatgtaacaaacctgcacgttgtgcacatgtaccctaaaacttaaagtataataaaaatataaaataaaaataaaatgcataggacattgtgcactaagacacaatgatagcactgattctgagatctggcaaaactttgtcatgacctattactggatgaaacagcaacgatgatctatctttatatgaaaagttcagtgctacctttctgtaccacaataatggatattggggtccttgtctgacagtttatttcagaactgagccaggaagagggtatacacttccctgatcactgctgaaggaaagcaaaggctcatgctgaaagccaccatctgcatgataccaaacaccacaaagttggctatgcctccctgcacaaatacattgatgcatttgtatggcttaagtcatcgagttagtttcaaaaatgtttgtaaaatttgtttgacttttgacttcaaactatactacaaggctacagtaaccaaaacagcatggtactggtaccagaacacagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacagcttatacaaacattaattcaagatggattaaagacttaaatgttagacctaaaaccataaaaaccctagaagaaaccctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctacttatctgacaaagggctagtatccagaatctacaatgaactcaaacaaatttacaagaaaaaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccaatgtggaattcagtgtggcgattcctcagggatctagaactagaaataccatttgacccagccatcccattactgggtatatacccaaaggactataaatcatgctgctataaagacacatgcacatgtatgtttattgcggcactattcacagtagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattttcagcaaactatcgcaaggacaaaaaaccaaacactgcatgttctcactcataggtaggaattgaacaatgagaacacatggacacaggaaggggaacatcacactctagggactgttgtggggtggggggaggggggaaggatagcatttggagatatacctaatgctaaatgacgagttgatgggtgcagcacaccaacatggcacatgtatacatatgtaacctgcacatcgtgcacttgtaccctaaaacttaaattataattataataaaattaaaaaaataaaaaaaagtgaattaagactccagtaaaaatttggagccaatttgagtagacagctctcaattccatttttaaaatatcaagggatatagatttttttaaaaatttttatctaaagatctttaagtatttttatttctttatatcttattttccataataagcatgcctacatgatttatgtggaaaaaaaaaggcccggtgtgaaaaatgttttctaggagaatgatattaaattgatatataaatatatattatgtataccttaccaagtgagcacatatttccttaatgataaatgatacttctaaagcagaaagcaagactgtgaagcaaagacctgcaaatggatgcaatttagtgaacaaaagagggatgcgactgcctgaacatgcacaggagtctgaagtggtcaggtctggggcacactgagcatgtgtcctgggaaatagtgaagcaggatgaaggtggagggcatttttgagtgggaaggtgttgtggaggccaggttaaagggaaagtatggaaatgcacagggaaaaataccttgaattcttaaccgtttggcccagggtgaacacttggtgcaaagagaattctaacacttccaggaatgttttaaacaatgctgtttttgctttggagcagttacttatattatctggcataccttgttcaatattgaaagctatttctgattatctctagttttttttttttttatccaaactctcagagcatcatcaagtgtattatagtcttagcctttgtaagaattggtaagttcacaaaacattttatttagtgcttaccttgcacaaggcttgagagattttaaaaaggtgcataaggaaaattcctaacctcaaaacatgcatattacaatcactagactttaatggatagagacagccttgtaaataaataattctcttgatatgatatgataagtacagttagagacaggcatattcagaggctacagagcatagagagaataaatagctagtttcatcaatagtaaatttcactctgctctttttaaggaacttacctaaggagacttggaaagaagacaaaaactgtcttttaatctgttatgattgtaatttaattcagaaaaatgctcattccaaaaagggaaattctgaaatagtttaccaacattatagttcagaaaaagacatttaatgatgttgaatctaaagactaacttttcaaattgtccattatttgttaataaaaaacatgaaatgatataaattccaaaggaaaagataaggcatttttattaattcatccatgagggagcctgagagaaactttgtgattgtggcttttttaatctcaattttttttaaagaatcatggattagggctatagttgggtttattgccatgtacgtcaatcgatcgtaattgatttagtagtgtttgagggactgtgggtactattttctagtttaaaaagtctctataactttctgtcacaggatctgaaatcaccagagatttcttaaatgtttaggtcattccagaagtccctacttaaaatttgcttagaatgtctactagtttcctattactgctgttttaaaaaaattaccacaaatgtagtggctgaaaacaatgtaaatatattatttcacaatcctggaggccagaagttggaaatcagtttcaatttgcagaaatcagcgcgttggcaaggctgcagtcttctaggtgctctaggggaaaatccattttttgcttttttcagtttccagaggctgcctaaattccttgattaatggcctattatgccatcttccaagccaacagcctagcatcatctttcctctctgatccctgcttctgtttctacttcttcactctctgatcttacccttttgcatctctcttttgaggatccttgtgtttacattgaggccacccagataatccaggatattctactcatctcaagatccttaacttcacagctacaaagttcctttcaccaggtaaggtaatatatgtgcagattccagggattaagatgaggatatcttttgagggtcattattcaggctatcataaaggtaatactttaaatgttgctgtgatccataaatattatctcagagaagactgtaaggacaaggttcttgaagaaacagactaagtactagaagtcaaggctagattgacaaaacaggctagaaaggacatgcttgattttttttttcttaaaaggaaaactaccacaaaagggtaaaaggaagattcctcctcctccaaactatactgtgtaattttttaaagtacaaatttctaagcaatgagaaggtcataattttatccacttttctttagctgatgctattgccatgcaccttatatatttaatgaccttgcaaatgtgaattccaaaaatagggttaaaactatggcagagaaaagtaataataatttttgtgtttttttctttctgcattgcttgttcttcagaaaggtatttggttatttcaataaatgactttagaatttaaagcttaatttttttaagttattctgaaaaggacactggaaataaactatcccacacacacatttttactgagaaagtacagtgtgtcataagtaatttatatttgtggtctaagatcatacttggtggcaaacccaaacctggtacacaggtttcctgtcttccaaatgagttctctttccactggatccattagctcaatgatttgcacttgagttaaatctcagtgcaatatacaaactacccatgggcatcttcctttcataaacccattaatatgagagccaggaaacattttctcagtacattcaataaactccactgatgtacttggctctgtggggacccataaaggaatatcatgcttgtcttccagaagtgcttctctccattgctaagaacttgaaaatacctgagatagactgctaggaattcttcccaaaaaaatccatagatcatttcccatagtaaacaagcaatcctatctaacctttttcccttgctattttgaagccaagatttaccctgaagcaaaaagttgtttgagcagggggttatggcatggtcatgaataaagagacattgcttataaactctgctaacttgaatgattcactttccaaaaatgagcagcataaggagagtacttatttatttatgctttataatatccaagcaaacaaaaataatttttgtactgtttttgaattgcgcaggcattccatacacttttgagagctaataccctgaacaatctcaatttttttctgtataccctccacccctaaaccctactttgtccatctctgctgtgcagtatcccccaggagactgacacaggctcttgggacagctggcttctggtggagggacagctggcttccagtggattgcccaatcggaggcaccaacaggagaaaatagataggacagtgaaaagcaagggttcaaaagcaaggattcttgggggcttttctccattctgtattggtctgtaccctccttgagtacagctatgttaggcgacagctcttccatggctcctactgtttgtgatctcacgatgggaatcactgtttctccctttgccccttcaggcctatcagtggtcatgactttctctgtttcaaatctctgggtgtatcccttaatccagcccactcatctgtaaccagtctgtttattaagctttgccttaattaatatgaaccacttgaattgaattttgctttgtaataggcttaagtcgttgacatgcgtctttcctgctatgtaagaggaaactcaacagcgatttgaacgtctttggagcccctgtgctctgttttctgcctattctactcctccctctggttggctcaccctatactaatggtgaggcagggaaaggtgctcagaagcagcatgcttaaatccctctgaaatgaattgacacatttccttttcccagtccagtatcccatgtttctgtgggtcttaagccctggtaagtagaatagcccagaaaatgtggataaaaaaccacacaatttattactttggctgtcctggccttgttttaaccattttatatataagtcctattgttttacttcatggcctcattctttttcatggagcaaatccaacccaaacgcctctgtagaccttctcccaaggtagagttaactgagtatggttggcctgcctagcaatactatttatttgatttgcaggtctctttcttaatgacaatgtaattactcaaatgtcaaaagttctctgccaaggcaaccaagtgtataatatgtactgtatagttttgaccaggaccttgaattcaagtgggtcattttatttctgtattcttggtaataatgcttgtgctaataggaatttgcaccattctaagactttgtcttttgaaatttttctttcctgttttgtgtctctctttctacagtgtctgtctctctcttcaagttctggttaatctatactttcttctagatttaccaccttaattttctgttgctttctcctcttctgatatattagatctctctctagatgagctttcacattcaatatgtttgcctcctgataacttcaaaaatatattcggtatatttatttagggaaaataaaaatgtaacccgtatgtaacaatagaaaatgaaatacagggacaggattttttggcaatataattgtggcactttatgcaagtaaaaattagataatgttgtatggataatggatgatgtaatatatgcctatgtagttatttaatgcatcttaacttgagattttagacgcattaaaatacacacattttactttgttcaatggtcatcagatttttgaaatttctctctttgtagttgttagagccaacagaataaagggatcttggaaaggtgtatattattcttctagcatttattaaccatctatactggtccaagaattagaatagattttggtattacgaaatttaataacgcaaagttccatcctccagctaccctctgaggagtcagagatttttaatggatcacgagatggagtttatagcatcttggtagacgttgttagggtaacagagggaaagagttaataactctgaggagggtgaccaggcacattttctactaatagtgagggtgttgaaggatgaattgcaatgcatcaggcagggactaaggaaaagtattatatagaggagagctccatgtgtgacaagacatacagacaggaaagaggcttgtcacagggcttggtggtgggtgggtgcagagggagcagctgtgtcccttattcagcatcccaccctctcttgttatcttggctctatcctttccctctgttactagttcaggaggctcggagtctcactctagctattgccctacattgccctcttcatatcacagcacagacctcaagataatgtttggaatttacctcttaaccatccactcatcagcaatggaaactagattcaaacaaccagtaaaattattctgtaaataatggccaataaaggttgtgcttacagacgcagtggaatctttttagttctcatgtaatttagctagggataccagataaatacaaaataatttgcatcttaaatggtaaatttaaatttaattagtaaaatctaaatttccaataaaatagctactttttagtgtaagcagtttttgtgatatactaaaaaatatttgctgtttatctgaaattctaatttagttaggagtcctgtatttttccacattaaatcaggcaaccctaaatttcccccttcggatgagactctgtgaacctctcacattctctctcccttagcctgtaagttgcattaaaaaacaacaacaacaaaaaaaaacggttctcctggtctcacttttcttcttcctctagtagcccatctctagttattcttgttctctagggctctgctctttgttcatttctttatgccaacatgcttttcctggacaatttaattccctttcttggtttttactgctattcacctatgacttccaaatctctcccaccatccaatatcttgcctttgacttccagacctgtctatccagtgcctactggatgttttcctctggttgtcctatgggcatctaaagcaccaaatagctgaaatgaacaaacaatctttgtctccaaattgcctctcccttgaattccttatattagcaaataacactaccaccaaccaaattaccgaagtagaaacctgggtaacgtctcagtgtcattctttcccctcacttccattgaccattgcctcaatcagccaacaatgattctttataatcctcctttacaaaatgctataaattccctagaacctacttagttgacttacttatctcaaccagattagcctctaatgcaatttccttatttgccccgccccccactctctctctctctctctctctctctctctctctctctttctgtgactctctgtgtctctctctctctttctcatcagtcctctccaacattctaaagcttctaatttgaatatatttcttaattgcttatgttttcataaagtatatttttcaggataggctgaaaagtttaaattagatgaattatattctccacaatcagatccctgccagccttcctagccttatctctgaggattaaagaagacatatgactggtttcattgtttcttgccttgtgtgtagcaggtattcaataagtatttgttgtacgaatgagagaatgatagagatcatttttacagagtgaaagctgtttgcaatgttgtcagagaagagaacattcaaagtacaatgataagagttcttacatttggaagacttgatttgacacataatatttaaaaaattacttaataaagaattatgattttatgggatttctgtatgaatgtcatacatagaaatatttagatacatataaatcttaaatgctcctaggaagatatatatttacatacctacttaaatacactgaatctgttttactattaggaatagccaataaatattgacattctgattgtttaaatcttctgaataattaatcactatttttctaacatttagaatatattaaaatacaatccacactgtaattataggtggcataattaaacctttgtcacatgtaaagatagttcagaagactgtaacatttaatttatctgttataatcattttgatttatgagaaagtggagaagcctattttcagatgatatgtatttttcagttttccaaaactcaaaattatcacataatatataaaatgatttctaagtatgtatatatatcaacattactctccagtgattttaagtaatggagatttttctaagtgtaaacctaaagacatattgtttagaatatggtataaataaatgtgtcttttaaagtttaaagactactcaaagcattgttatctactaaataagtgtgggaaatttaatttaaccttccagataatgtgtgtgaatgaaaagaaattataaatatagcatggggtggggaggtacttgccattcataaaataattccctttggtatgccatagactaagcattgggagaattcatgatgaataacacaattccatttgaagcctctgtagaattatttctatgtagttagtaacaagtggagcttggggtattattaggcaaaattacaacagcagcacaccgctgtgcagagaaagatcagggcatttcgtctaagcagcatcttcataactctggctcctaaaactaatgttgtgaagcttcagttcttttgaattgaaactctggggaataagagagggtcataattattagctaggaattgatgctaaatttgtttattcactgatttttccaccactttctatagtatgtaaatgagatttttacttagaaaaaacattctgactctgagacagatgacagctgttcaaccccaggggcagaaaaaaaacacagctttttccttggccttttctttttcgttagtgcagcttctagagcctcattgaattttcccagaattccctgtgcaggagctttcaaattctgattgattagtcatcatatcagagcttaccactttgtagctcccctgctaccaattgaacattatgaacagggcccagaaaattagcttgctcagcaccattgggattgtggcctgtttagcaatggatgtataattccctatgactctagttagtagaattggcatcagagtggtatgaatagaatgtcttcagaaaggagtctgaacatcttttgcaagttgacaatatcgccttgagatacagggagaggtgtgcgtgtgtgtgtgcgcgcacacacacacacacacgcacgcacacacacaaacatatcttcccagacctcttggcagaggagattatagactgaagtagggaatgacagaagcaagaaaaaggaactcattctggtgggagatgggggagaggtggttttcaatggttaattcttctacctctaccacttttagcctgttacagtctgcaatatccccttagaaatgactcagtgatcacattattggatctcactcttgtgaaaacctcctaaggcagagagaagtcaagttgtgcagaaagttatcacctggcactgatgattgatcttaggtgtgacattttgttcctcttttcttatccctggatctctttcctgctatgtagtctccatacacaacaaactttaacagcacattgaggcatgaattcatcaagcatcctgtgctccctcacggcatcagaacaccacttcccctctgtctcctgacagtgagctcagaaattaactcacaataaggtgctgatggctaatttgaagttaatatgtaacctctctcaaaatgatgtggatttgaagcagagatgtgaagagaaaggcaatatatgaacatgaaagaaacaaatcacctccactggtcaaatatcctggtagatgtctggagacaaaccgtagggcagaggatatatttatatttccttcaaattctaaacataggctggtcctagtgagagtaaacaaaaacacatttatcatacttatcaattgagttattattttaaaatatgccttccacaattaagttgccttgggtggatttgtgtaacatgccactaaaaataccatgaaataaacataaataagctaaaattttcttagccttaaattgctgttctgttttagaataatatgggcagataagctccacagcctccaaatcaggaattagatgtgttaacagctgtttttaaaatatttttatgttaagggaaatacacgtaagtgtacatgaaaatttcttgcttttttttttttttttactctcgctataggttttactccatgtacatatcaagatggatatgtctatgtaataaaatatatcatatatttacatatatgaatacatgtatactgggccaaaagcaatgcaaaactaaggaattaaagtctgccttatctacactttcctcttctttgctatgttagcacaaatgtacttctcatttgagggaacatggtagaggagctgccatcccatcttaatggtacttgatgatgccattgaagagaagacatactatttatttggtgcttagcatttagctttcttgatatccatcactgctttacattaccctcagagacacatcactgaatacagttttgaatggttccatgctatgcatgatttttatgggggtgcactgagctgtgcagtctgcagccactgcattccaaacaaaagaagtaatcatctagacacagagaaatgggttcattgccaacatggaacaggaaagattcaatattcatgtttcgacagaccacttaaccagtgttttcctgataacacggtgctagaacctagtagatattcaatcaatgtttgttgaatggataaatgagtgattgaatagatgcattaggtatcttcaattgggtctttctttatctagatctttaatataatgcagtctatggaagatggggttatagcaatgtatttttaaattgacaagtattcatgtttaataactttagttaaaggaatcataaaatcctcaaatttatacaaatgataaagtttttttaacttatacctagtgtgaatttttaaatcacttaataaactgtaaaagtttattaagttgtactaaataatacgatgctcattttatagatttttcaaattgcggcatgtacaaatactggttacataacttgcttacccactggccaagtaggtttttgctctccctttctcatatttctgctccctaagtaaaatgttacatccttgcatctttcatttccagagctccaactctctgcctccttatttctgattagactagcatgagatttcctttcttcccatattttgtgttccatgcattcacagagagacagatcttagcacctgaagagaccttagtgatctgcagactgacttgcttcttgtggtgagaaaggtaccatctttactatgttacagaagaaattcccaagaggcctagagtatgtaggattcacatgctggtgtgaatagagaagaggatgctagaccttcaggatacttttttcttcttttcttaaccaacacattttcactggaggcttatttatctttcatttctataggagtgataaaactgaatgttttacaatttcattcggtagatcaaagaagattcattgaatgttttctcctgtgctttgggcacactcatgtcctgttgtatgtgtggcggaggtgtgtgtgtttaaataacagatgaccctttataatgggtacagaagatagataaaaattgttagtgtattagaactttttatgccaatgcttatttttaattgaaaaaaatacagtgaagaatatattatacatgtatataatattggttttatttttatgataaagcaagaaatgtagatactaaggtgtgttcaattaaggacaggccagatacaaattttcctgcagcttgaaaatcttgtctacatatcctaagaaagcatcttctgatattgttcacgtaggtagcataatgtcctgaaagtcaagatgcctgggtcttttatctggtgctagtattgccgggtgggagattgaggcatgaaataggttgtcattaaggtccattccagctttaacaagctattaatgaaatgttgattgtcaaacagaaaatgtgcattttgttggttgacggagccacatttgcataaggctgccccaaaccactctgactgttaataaatgccagaggacttgcagcaaatcaaaacacaagtgctgataaaatgaatttataaaaaaagagtgattattttgcttgaaaagccacagggtggcctgtagaatctaatgcagggaggctctgagaatatatgagaataaatagtaacagtgttttctgagcccacgttgtaaggagaatctaaatgatccagtatgttaccctgtcattttccacttgcaatgtagacagctaatttttatttttcagttttcattttaaaacaaaaccaagagatgatgactgcagtgtaagacttactttcctgttgggaggaaattgcactgtgggcatgatgtctttaactttaacctttaaaaggtataattgacttgtagtaattttaggttaaattatattgtgctgtgagttaggtcacatacaaaacactccagacatttattacggatatgttaaaagtttgttagattttatttccagaggatttcatttaacagatttctactctatattatactcgatctcctgaacaatattagaaacagaggacggaccttgtttctcttttgaattttctgcttccttcaagccatcattgttgaccctaaagaaaaaagtccacttcatattagccttcttggtctaccacaatagaacatcacaaactagtaacctcgaccacatataattatctttttacagttctgcaggctagagatccaagatcaaggtgctggcaaggttggtcttggttggggctttcttcttggcttgcagatggctgccttctcactgtgtcttcacagggaagagagagagagctctggtgtttctttcttttcttataaggatacagtcctgttgaattaggactctactctttttttaacttttattctaagttcaggggtactcgtgcgggtttgttgcataggtaaacttgtgtcatggggggttgttgtactgattatttcatcacagctattaagactgatacccattagttgcttttcctgatcctctccctcctcccaccttccaccctctgataggccccagtgtgtgttttccctttgatgtgtctgtgtgttctcataatttagctcccacttataggtgacaacatgtggtatttggttttctgttcctgtgttagtttgctaaggataatggcttccaaatccatccatgttcgtgcaaaggatatgatctcattcatttatggctgcatagtattccgtggtatatatgtaccacatgttctttatccagtctatcattgatggacatttaggttgattccatgtgtttgctattatgaatagtgctgcaataaacacatttgtgcatgtgtctttataatataatgatttttatttctttgggtatatacgcagtagtaggattgctgggtcaaatggtatttctgctcttgggtctttaaggaatcaccacgctgtccttcacaatggctgaactaatttacactcccaccaacagtgtgtaaacattcctttttctctacaaccttgccagctcctgttattttttgacttttcactagtagccattctgattgttattgaatggtatatcattgttgttttgatttccatttctctaatgatcagtggtgagccttttatcatatgattgttggctgcatgtatatcttcttttgaaaagtgttcatgtcctttgctcacatttttatagggtcatgttttttttttgtaaatttgtttttctttatagatgctggatattagacctctgtcagatgcatcatttgcacaagttttctcccattctgtaggttgtctgtttgctctgttgatagtttcttttgctgtgtagaacttctttggtttaatttgatcctacttgtcaatttttgcttttgttgcaattgcttctggtgtctttgtcatgaaatattttcctgtatctgtgtcttgaatggtattgcctaggttgtaggaccccactcgttatccttcatttaaccttagctagctactgaaaggctctatccacaaatgcaatcatatatgaggttaagacttcaatatatgaactttgcaagatgacacaattccatccatgacaacatttaaagctcatttacaaatgtaatctctccctttcacaaatatcttaattcaaaagctgaagataacttcacattttattttccagtctgactccagttgtaaaataaaacattagcccaatggtttcttccccctgaggatattctattctgatatctaacttttaaatatatgttcacttcttaaagtagagggataatagccaccatctgttttcactatcttacatatgcaaacacagagagcttacctctgcatctatttgtgaagggtacacagttcttcaaatgaaacctgtaaaatgagatataatgttttacattattctggaatgtcctcttaagtttgtaaaccttaactcattaattcatgcgataaattgttaataaacacttactctgtgtcaatcactattctaggcattggtgtgacaatggagaacaaagtttctccctcaaggtgctcaaaatgccctagtctaggtaataaaatacatggtcacacttctcgtgcagaaaaatctccttttctgtgtttattgttttatgtcatctttttttttcttacccctcataactaagctcagtcatttttgctgggaaaaatattgagaggaaaatgaaatgaagtgtcttataatgtgctcatctgtaaactgatggatagactagaacagtggtcttcagtcctagctatccattagaattacctggggagctctaaaaatataccctacctgggccccagggattctgatttatttggtctgtgacatgtcctgcccatgaggacatttaaaaagatcccagggtgatgccaatgcacagcctgaattgagacatggaatgaggtgatcaccaagattcttcattgatctcagtgtgtgaattctttggttttctgcccagatgtaaaattatgttctagaataagttggaaaagtcattcttgttcctctgtatgtgtgtatcctaggggctattagtgatgctttcaagaaaagcatatctgggccgggcgcagtggctcatgcctgtagtcccagcactttgggaggccgaggcgggtggatcatgaggtcaggagattgagaccatcctggctaacatggtgaaaccccgtcactactaaaaatacaaaaaattagccggacgtggtggcaggcacctgtagtcccagctactcgtgaggctgacgcaggagaatggcatgaacccaggaggcagagcttgcagtgagccaagatcacaccactgcactccagcctgggcgacagagcaagactccatctcaaaaaaaaaaagaaaagaaaaaagaaaaagaaaaaaaaagcatatctgcttggctctaatttaggacaactcttttgtcttttgatttaaataaaaatcacaaagatcaaatcaaattaaatttgtataaaattcaagtagtttacatgtagcatgaagtgaggggagtgcagagaagggtgggggtggcatgatactgaactgtacagctaaagaggcgcttgtatatcactctaagtgcttccgagtttatcttaatgatgatggttttgccattgaaaaagtattaagaagtggaaaacataaagagatctatgttttggaaatatcacacgagaaagacagtggaaaattgctggaagaggggcaaaaccaaagacaaatagagttcaggagagaggcaatgctagagccttagtttaaggaaagtaaagaaaaaaaataaaaaataaagcaaacagagaagtgggcaacaccttgaacaaactgacactctgcaggtcaatggagaagagaatttcaacaagaaagaggtggtcggcagcatcaaactgcatagaggccgagtaaaaattgctacatgtattgagtaccgaacaattttctaattgctttatgtgtattaagtcacttaatttgtataagaactctggaaggtagctgttattatcaactcattttatacaggaggaaaccaaagtacaggtggtattgtgccaaagaccacacagttcgtaaatagcacagtgagagtgtgaatctgcaggactcaattccagaagccatgcccttaatgacctgcgaaatgcctgttaggacaaagaacgaggactatatccacccttcccgctttacagtctcctatccattgtatcactctgtatgcctttgcatacccatggcttatttctcaaagtgagaacatacggtatttgattttccatttttgacttatttcacttagagtaatgacttccagctctatgcaatttgctgcaaaagacatttcattcttttttatggctgagtagtattctatggtgtatatgtaccacatttttaaaaatccactccatgggtcgataggcatttaggttggttccatatctttgcaattgtgaattgtgctgtaataacatgcaggtacctttttgataggacttttggaaatgtgcttttttaaaaaatatctcatgtgtgaaggaagggtacacaataaggtggtacttgagggtgacttagcataaaagtataattatatttgaagttggaagagatggaacacacttatagtctgttaaaaaatagccaagaggaatgcaaaagatggaggtacaggagattagtcattaaggtagtttcctatgaagacggaggagaggggaaggaatcagtttgactatctcttcctgggagataggaggaaaggaagggaggtgggaaataacagcatttaggagtcagaaagctgtgaaggagcatttacccaagaccactttcattcctccctatgaaatgagtggtgcagggcctgcccagaggatgggttagccttccagtcatatacatgacactgatccaactttctcaaaaggcatggatgttgctaactcactcaggttgcagctgtctttctcagtcagagtattcttcaagttgtattcgtcaaattcagttaatattccctctcccaagtaaggagaaagtaggttccaagcaaaaacacccctcagtcaaagaatagcaaataacaaccttttgcatagcttgtgttcagagttacccatgaggagtctgagattgatttgccattcactgctacctctcagtgtactgaatgagaagagcaccaatgggtaacatatccagtcagattggcagtgatcagcctgtctgtggaaaggatgtgaactgaattaataatactttgaactaaagcataaagaactttggagggaagatgtcttcaaatgaaatcccaagtgtacactttctccacctcttacttaacaggcggagtggttgcaaagggcaacttcaacaactttccacagcagcccagttactgtcagtgttacttgaaaaggagaggggatgtgagttctacagacagcacttatcccctgagacataggcacggctttcgtgttcaatcactgtatttaattcaattatctgcccccgccacccccaactgtctgccttacaggggaggttgggaggagagtgatgcttgatgcttctgcaagtcccaaaagatatgcattctttattagggaattcaatgaaggatgagctcttactcacccagctgcttcctctgggaagtcgtcatgcggctccagctgcctgcagcaggaggatgacatggtctgtgcaatgcattgaattttattttatttttttttagattgaattcaggtagttgtttgttttaaagagggcttattttaattcatctttaaatatcatatttttgaaggtgaaaaccatcacaaagtcctgttcacctctagaaatttcagggtccggttatctagacagttatagtcaggtctaatgattttccctcttttctttctttgttttatctattcatttgttggctcgtttcaagggatgattaggactacttctatacaacaattgaggtagagaagaaatagattacagttcaactaactatgttaattttatttttagcaataattctaataaaataatgcaatttttaaaattgtgacattttcatagcaaaaaattttataacataaaataagtactaaatattatgaaaacttatattttcttaaactaataaatgctcactctgtcaataaaaatgagtcattcagtggttaaagttctcttaaataatcaaaacttgttggttggtgaagaaaattatctaatttatctcaagaaatagttaattcataaagtgaaagaaaagaataggccatatcagagaacttcaattgaagaaatctaggctaatctgattttttcattaataagtcacaaaccttctaattgtttcagaaaacaaacatactgctatttttttttttttttactaaatacaacaataatgccaggaaggtatattataagccggtattttccaaatttgagcctatacatttttctttaagaaaagaaattcccagacccagtaatatacactctctggattttgagaaatactggctaagactttcaaacattccttgaaaatatcttttagcttcagataatcacaacaaaatataaaatttatctttatatggtcaaaattattttatattctgattttggtaaaagctaagaggcaaaaaaccaaaacctgtagaacttgtggacctatgagtttatacccatagactcagtttgaaaaacactacttgatggctatttaaccaacactagaactttttgacagttcttttctttttcatacatgtgttaaattgcctctctctgagccttatatttaattcagttcctgcatcctcctctcaagttttcttcacccttgtagaatctgaacaataatgaaaggattgatgacaatgagtatcttctgaaactctttacctaagggattggcaggcctgttttcttttccattctgattggaaaaaaaaaaattgtcctttgaaaattggtctcattaggagcttatttaatcacagatatgtctctataggtgttgccaacaatatatatttattgagcatcagttaaatgtgagattggtacaattaatgttctacgcaatcaataatattttttgattagaagtagtatacatctttatgtataactcactataagtttactgaagaggacatttaaaacatgtaaatttacatttttcttggcatgttgagtatgttgatggaaagattaggatgattcacatcaaaagataattatcaatacaagtaaatgagtaatgaaaaataaacagttatagatgaataatggagagaagagtttggggaagtgaaatttaagcaggatcttgaaagaaaaatagaattaggatagaagaaatcgaggcaagaaggcattccaggcaggaaacccaaagagttagagatgggaaattttatttggaggacagaggttagaacagaaggctgaaaccagatgcttacataaagagctttctaagatagcttcaaagacactgattgctaaggactttggactcagttgctggaggtgttgagcaggggaccaaaatgaagaaagccatgcttctagatgattaaatttacagagggaggatagaggggcaggattttaaaaagtatggaacttgaaaacttaattcagggtattgcttatttttgttgtctacagtggtatactcacaagagggtatagacagagttgtttttcatttcgagccatttccccagtgacaagtaatgagggcaatgcagcagatgacaaattgaggatggttatgacactaagagtttctcttctaaggcctgcttctcccacaggactgcagagttgagccagggaagctaaacactgtatatcttctctacctttgttcattgcccttcttgcctgctccttatgtctcctgcttagggcagcatttctcagactcagcaatagtaacatttgggcctggataattctttgttctgggaggtgtactgtgcatgggagtatgtttagaatcacccctgcctctacctactagatgccactagcatcctccttaccttcccaagttgtaacagccaaacatgttttgagatattgccagatgtccccaagagcaccaaatcaccctctgtagagaaccactaggttcttatagattatcctgttgaatgttaagcatttgtgatagaagagggataatttcccttcttgatggtaggatcatgactaggctttcagctttatgaggactgtaggcatcggagaaccacaaatgtcaaacatgcagtttcagatgctttctccaatgacacatccaactttcaccctcttcttctccattattgtattgcctgataataatgtcaactctccagttaactaataatggatcatcagtatctcctggtttgcctgggagagtgctggtttacatctgttttccccatttctatcttgttagtaactccttttactctataaagtgtctggggttggaaggtaaattatatgatgattctaatatgggaaatcactagaatcatgagaaggcaacaagtgaatattaggaaagtaagaggtgaaggggcaatttgccctctagcttccccgggtaatttttcctagaggagacaccagagttaagacttgaaagcaacattaggagttaaccaggaaaaggggcaaagacatttacaagacaaagggaacattggatgctttgcagggtgagacacagaagtggacaaattgaagaggcagaccaacatgctaatataaaaatccaaaagttgtttttgcaaactttacttcaatttttaatctacctatcaaatttttatcctatctgggaaaatgggcagtgacatttttaggctataaattctaaatgtgaataacatttatcttttgtaaaagaaataggattgattgctataaattgtccaaaagagaagagggtcagttccctagctttgggtttgtgtatgtggtgatattgaaatgcacccgtcaccttcttttccttttatctgaatgtttgtaactaagacgtaactagagaagatccagcataccattacacatatagatttcaaagacttgggaagaaatcttatttcagcatctgtagctggttttattaaaagcagtttaaattcctctgcctagagcagtctggaattatagagatgggctgcagaaatttacattttaattgaggcagaagacaaaatagggcacggtgcagcattcacacattacaaggaagaataaataagatatgtatcagctgggagaaaaaaatgactggtcgtttttcattgcctcctgcacttatttttttcatatggcactgagctgagttaggcctgctaagcaaagacgatttttccagtcaaaatgtttactatttcagaaagtccttgtgttgaaatattttcacactatggaacaaatacacaaatactcaaatgggcctgcatttggttgtcaaagtgtgtatggcactgtttataatgtctcaaatgtctataaatataaataacatgtcccaatgagctatatagaaaatgatttaaagtatgaggtataacagaatgattgatagacataatctatctgttaaacactgtaatttgagctattttatagtttcatagaaatagaataaaattttatagaaatagaatttttctctatagataaatttcatcctttgattagtgtggaagtccctccaaagagtgggaggacttaggttttcaaacttgaggatttacctgtgtttggtaatcactttgagaaaccactcattggatttttcttttctattttttgttatatgtttgatcattaatagaaaattaagttgaaaattcatttcctcataagggaaaaataataaacataaaaagtgtatcatgataatggcttttaaaagtaagtctttgtattagtgtaaatatgttttgtagaaatccactgtaattaagtgtgtttatccatttatttaagccttcaacttttattatatcttctttcagctgtacgtgtatttttacattcatacatgctctttgccaatcataattattttgttagattaattatagaatttaaaaccaataaacaacacattactatagtatgattatccaattatgattccctccagagctaagtactataattggacccatagtaagaaaatgtaattctttttccccaagtatgtgcctctcaagcatgacggtcaaatagattatctacttttagccaccaaaacatatcttaattttctttattatttgactatgactttccattttgctttttctagaattttaaaatgacattttattgtctttaaaaaataataacatgcctttaccttatcactaagattacatatttcttaatcacttaatcaccacttaatgtcctattattaaagtgaaaatacatttttcttaaatatcattttttcccttggagctctctggttctaattcgtgttgttgattgttcggctctaccacgtaactgtcatttcaggatatttttcctttttactcctagtccattcttgttaggctatgcttactgtttttctctctgtctgcttcctccatgcttgggtttcctttttggtttttgtctttcatttttgatattcataagcaatgtttcagaaaggtatttgaaaaaatgtttgagtccttgtaaatatcaagcatcattattttcatcatacttacttaatagtacagctgaaagttcaaaataattttccctcagaactctgaagacattgctttattgtcctatagcattcaatactgctgatgagaaagatagtggcaatttaattctccttcctttgtagataggcaatgtttcattttggaagcttttacgatattctaggaatctttggagacctgatattatcggtaggtatgggtcttgctggccacttaaccgcataacaaccactgtattctaatgagtgccgtcaatttttcagtcacagggtatcttttaactcatttttttcttttacttttttcagccatcttatttactatgtctttttttttcccttaaaaccattattagatagatgttggcatcctggattaattctctatgtctgttaatcttttcttattgtttctatttatttatcttttggctcaatgcaaaatgagattcttcaactatttaagcttttctactagtttcttactgatttttaagcttcaagaaccctttcttcttggacttctccctaaaactctgttctggttttatagttacagcagtttcttaaatcatcaatgggactattataagcttctttcctgttccttgcattatcttaatgccttttagggttggctgttctcttgggttaccttagttcctttggcctttgttattttctcaaggtttttagtaatcattgatagttcattcatatgtatgaaataggatgttaagtaatgtctctgtcaccatggaaaattttatccccaaatttctctctgctccaaagtggggctgaccaactaggttggtgacctggctgctttcactatggagttctaggaggactagcagtatgttggaagcttacagaatgagaatgacttaagtctcattcctacctgcgaaaatcattaagtttctttagagagtagtatcataattttaggaattaggagaaatcttattggtaatgatgcttcagcagggaccagacagtagtgggcagcgaatggcccagatatttcttagacagactttcctattttcctgcctcactttctatatttactttaaatctctgagtcttagtcataaagagtagctcccacctcctaagaggctttgtcctctgaaagttttaagtcttagtttcgcctgctttgtttaaaacagaaatatgttcctcttcttcttctctcttccatatatctatccaaaaagctgctccattgaggcctagttatcttctcaacccagtcttttttcagaactgttataagtttattggtttttatttttctcttctaatttcagtaggatttttagaagaaggcaaaaaaaaatcctgtctgatattttgtagcagaagctatatatatacacacacacatatatatacacacacacgtgtagtatatatatacacatacatatgcatatatatacacacacgtgtagtatatatatacacacacacacatatacatacacacacacacacacacacacaaacagacatatatatgcgcagtggtgtgatctcagctcactgcaacctccgcctcccaggctcaagtgattttcctgcctcagcctcccaagtagctgggattacaggcgcacaccactaacacctggctattttttgtatcttcagtagagaaggcttcaccatgttggccaggctggccttgaactcctgacctcaaatgatccactggcctcggcctcccaaaatgctgggattacaggcgtgagactccgcgcctggcccagaagcaataattttaagattaaaaacaaaacccaaatatggtttcctccccctttctatctatactcacactctgggtaagaagtagcaaaagcaatcaggttttcaccagacaaggagctctgtgattctcagctctgtcccaacagcccatgcacaatggctaccaaaaacaaaaacaaacaaacaaacaaaaaaccccaacaacaaaacacagataagacaaaatgccaaaatgcaaagcactgcagatttccaagaaactctttggtttgcaggcctagtatgagcaaattttttttacaacgtaagaccatccccttgtgacttcatcatttgttgaccacacaactgctgccaaaccctaactcaaatattctccaaggtaaaacttggaaaaatacttgggttttggtccatgattaatcttcatctatttctatataggttatctcattatatcaccattaatataaagcaggtgggttacatatctgaggaaatgggcagggggacccaaatggttgagttgcaacagagcccaccactgtagttattcacttcatctgtgtatgtagcttaccacattcctgggaccacaagcatggaaacttagagcaatggtcattgacttttttctcctctattattctcagtgttgctcctgaattctctggcttaccacactgtgtttcaactcacataacacaaaaattatttccaaactgtctgcacaaatgtatttcatatacttattccttaacctaatgcatttcattctactgaaataatagttttcccttcttatcaatattgcccagcaagaaactcaagctatttaaacagcaaagctgccaatatttacaaccttttaagtcagtaaaggaatttaggtaatttgtattttagtgtttactggttggttaatgaatattgtgcttggggttttatttatttatacagcacctcattccaaaaataaataatctgaaatgtcttggatattacagaatatagtatgcaaggaattagaatctgaatattgtgtgtttagcacatttttagcaaattagcttgccaggttggaaaacatcagaggtttatctgatgtaagcatattttaaatttctgggtgtttctgtaaaaaaaaaaaatcagtctttcctcttactttatacaattattaaacagagataaaacaaagtccatgtactgcagacctttctattttatactgaaacatccaaatgattgacaggttttaaaattctatttataaaaggattgctcctctgtagacataagaaaaatcatttcaaagagagatgctctataagagaaattcttaacatatttaaaaaatgagagactcctctattgtgtaccttaatctggctcttattcagttttctattgttatacattctgttataaaatctataataaattaagactccattgttttaaaaaaacatggtaatataagcattgtagataaggcattttgctctcaaatatttgtttctattagtttattttacttctgtttatgtgttgtgcatataaaactttaatctttctattaagaaggaaaaagatgtgacttatgtatgatgaaatttgctgtaacctttatatatgttcttgaaggagccttggttgaaaaaaatcacacacatgtaattttttgtgggctatgcaccatccttatacatactaaatattgcattgcaatatttactattagctatgaattgacttgtaaatggcaaaacactccaggttttttacatggtattattttgaaaaatccaagcgatatccctttatcattactacaatgttctaactttgacaacctagaaaatagatttttttttcaaaagatacataacagagaacatcccttctatttgaaatctctttaaatgttgtggttttaaattcttataaatatttttctttaattacagtgagtggagggatagagagaatagtttaattcatacaatatccacctcccaaaataataatacttcagattatagttttttaatcttcagaattttgaccacaattttatttattaaaaaatatattttataagattgtttccttggctgggtgtggtggctcacacctgtaatcccagcactttgggaggcccaggcgggtggttcacttgaggtcaggagttcaagaccagtctggtcaacatggtgaaaccctgtctctactaaaaatataaaaattagccgggcatggtagcaggtgcctttaatcctagctactcaggagatggaggcaggagaatcacttgaacctgggaggtggtcgttgcagtgaaccgagatcacaccatggcactacagcctgggcgacaagagggagactccgtctcaaagaaaaaaaattgtttccttgctgtgattttggtgaagttagtcactgaacattggaaataaattgcaccttgcctcattttcttttcttgaaaatagaataaatatagataagatatgaatctagagaacacacacatgtactcacacaacaacacaccatttctcccttccctggcaagtcaggtttcttttacaggaatggtaaaagttataatgacataatgggaattctccatcagttaataaattagatgatgaaactaattctgactgctactaggactggagtagcagaaagcaatttcaatctatcaaagccatgtagggaccagagatgggggctatggctacagctccagtacccacatgtccactcactgcacaggtagagacagaggtctgcagccacttgtctatatcaggcagcatctgagatgtaaaaagatactgcctcgattttggttaataccactttggaatatgaaataattactggatctccagcacatgtcttctgggtaagaaggaaagacactatattctctcattttacagtgacaaaattaaagctgagatgttaccttattctttcaagcaaccatagtaagttggtggtatacgccagagtagaacccagagatgctaattcctaagcagtgatcttttctcaatactagattattctcttgtatcctagataagatagttaacatttaaaaaataagcaaagcgggcaggcgcagtggctcacgcctgtaatcccagcactttgggaggcagaggcaggcagatcacctgaggtcaggagtttgagatcagcctgaccaacatgcagaaaccccgtctctactaaaaatacaaagtcagccagttgtggtggtccatgcctgtaatcccagctacttgggaggctgaggcaggagaattgcttgtacctgggaaccgggggttatggtgaaccgagattgcaacattgcactccaccctgggcaacaagagcaaaactccatcccaaaaaaaaaaaaaaaaaaaaaaaaaagcaaagctccttttttgccacaattacaaaaatgatcaaagagattgtataaataaattatcagttttttcttgcacacaattctcttacccacatgcaatacctagtttctatccaatccccctaagcatgtattgatattttgaagatcacaactggaagaatagcttatttgtgttaaattgtgtaaaagaaacaatttttatagaaatacacatagaataaagatgaaacagaccacagtgtgccagattcatagcaaaatattattttaagccaatagaagaaataatagtaggtttaacgaacatctttacatatttcagtgtgccatgcatgagccaatcaattaatttaatccttatgaaaactcttgataagtattaattttcctagtttattgacgagggcattgagccaagacaggttacataaatcgcctaagttcatacagctagtaagcggaggagacacaattcaagcccaaggatttacattagtgcagataaaatttgtcaaagcttacctacatatggctcgattgtggacccatctcattcataacaccttatcgatgtatcagatccacactattctgttgtttctgttgcaattgtagaacctgtggcatatagcagcacagtttaaactcacaatcatgcaattggtctacctagtctaatttttttaaatttatctttttttgttttaagtaagtgtcatctatttagcagtctgcaaactttttagaagtatagatcttatttttctttgatacagcataaaatccaagttatgttggacagagaatagatattaccacacacttattggcagattgaagggcgtattaggagagtaaataaagtgtgagtaatagcagatttggttgaataaggctgtacattctggctttctctctaagtggtttattctgccaaccccaatgtctcagctcttaggctgaacttctgccctttcctctgtgaatccctcttcagtttctctctctacatgatttcacccattccctctttgtgaaaacttctaaaacttgtcatcccatcttattccctcatttaccctctcgattggtactgcaggatgcttcctgcttaaactgatcatatctaaagtgcactagttattttatctttatggtaacattcctgcttctaatctacaatgctattcagtctaacatcaccatttgtgagaatcctggatgagtggtcatttggatgaattcagcagatctttatgaacatttatggtatgccaggaactgtagtaagtgttcagtacaaaagggacaatatgttaccatttcttctatagctagcagctaaacaaatcacttattataacgcaaggtgggatattttaccatagaagtctgcaagggatgctgtgaaaattagcatttgcacttgcgcagctctcacaatttaagcaattttgaatgcaagtttaatacaacctcatgaggtgttattattatagtctacaggttctggaaaccaactgacttgcctaagtgctccccgccttgtccgccctttatgcgaatggtggaagcatgacgcttagtcattctctgtttccttccccatgggagaagaagaaagcggttttgcagatgtccttgaatcccaccaccctagtcagtatagggctgaatgcacaggagctcccccaagtgtttgctatttgataagcagaattaaatgcaatgtgttgtgaagacagattgcagctcactgtgagaattttcagctagcctgtttagaatagggtggatttgtctcatcctctagaagtgctcaagcagtttctgtagaaaccgttttggggagatgaacaggttttatgcatatgatgggatatttgtataagtgacctctgagtctccttccaactacacgtttctctggttaatttctttatccagttcttctacggctatagactgagagcttatctttccttaaaagatgccagataccacctccttaagccactgattcttaatagataaagagttgctatttatgacagttgtgcaaactcataatcaatcagtacaacacaaggtatgtgattttattgaaccctccccctgatgacttaagacatctgtggctcatgcctctaatcccagcacttaaggaggccaaggtgggtggattgcttcagggcaggagtttgagaccaccctggccaacatggcgaaatcacatctctaccaaaattacaaaattagctgggtgtggtggtacatgcctatcgtaatcccagctacatcgggaggctgaggcaggagaattgcttgaacccaggaggcagagcttgcagtgagccaagatcacaccactgcactacagcctgggtgacacagtgagactctgtctcaaatttaaaaaaaaaaaaaaaaacacatgtgaaatgagtttattacaatcttcagcatggtgcaatatctagttagaggactgagtccagtaatcagtcttttttttctaaatgattgttctagttgccataaaggtaagttaaataaagttagaaaatatctctgacaagaaaaggataattattttgtaacatctattgagacccacaaaacttgttgaaaagtggctgcaaggcatgatgagttagtcaaaggcagagggataagaaaagttcttaactggttatagccagttttattttgtgtagagatttttacgtaggatgtaactccaacttactagaacatttggcaaaggtacaataatgtgcttggcggtggaagaaagtataggaggagcacattataactctagaatattctaactcctgtataaaacacaatgaaaatattccctctcacaacaccacactggtcacctctaatattaatggaatgtctgttaccatgaacatttaaatgagaaactcgggttctattattgcctcatgtggttgtgagtattggctaaggagactgtattgtcaaaggaaatttgggatagaaaagggtgtagagttatgatcttgcatggttcaagttcagacttggacagagacaaaaagatgaattaggtgagttttttgaattcccaggaagtaatatggattggggacacatagttctgttttcctgggtgcatatttctgctgtttcagtgataaaattatagcttctactttgcgggaataagtaactaatagttctcatttttataagttctgagaattttctatgattttttttttcatgttacatatctgagggacatactctccactctctctctctctctgtaatgtggattaagataagtaaggagttttcttagaattagggcaagtttttaagcaccatagcttattttgccttgaatgatcaggcattgcaccatgagaccttcttataggtatagctaagttgagagttgcccacactgacaaaactatccagctcagttatgttaacaaaaaaaggaatctcaacttaggtaagagtagccactatgtctcaggaatagtcctattgcttaactctcttacaaaatgctaaaattaacattgcccataagattttctataaaaagcagccatctagatcctttgagtttcattgtttttctccttaccagttgaatttattgacagaatactctttttaaagaccatccttgagagtgaattaagtaacagattcttggcaaatctttctcaaaatttccaccaatttaggaatgtgaggaaagttgggggttgggggaggcagggggtaaagtggcaatttgtattccaattacttgatttcctgagaatagaaagttgccttaaattaaacaaggaagagaaaaacccatgcatcaaataaattgaggaattcatttcataccaggcttatattttatgctcagtttctggtgggatatgaacgtacgattctcatacttcagtgagtcagtgtgttatgtaaacatggccttagtggcaattactattataaaattggtgatagatgtagcttttgctttactgactgcaaattaaatttagttggaaagataattctagttaaatgttttaattagcaaccttttttgactattctatttaataacaaagatacttctggtagcccagtatgccaaatttattttatgaactcttataatggatcaaatttcacattgcaaagagatctgacaagcctgattgtcccatgatgttttaatgtttttggacattcataggcaattaagtttcttcttggagaatgggcatacgtatggttaaagacatcttgagattgatttttttctctaaatttgtcatttattcagtaatagtcatgccaataacaaataatattctcataacaaatactaacttctctaacaaacataatcctcaattgtattttaaagaaactaacagcattttaagatattaaactcctctatgcaaagagatgttaaagcagtgcctaaattaacatgaatttaataggttattaaacccagcaaactggtgttaaagtggtgcctaaattaacatgaatttaataggttatctttcaaaagatttaagaaaacaaatgcctctgttttcagctatttattgctttgtcaacatctaatatggacctagaactacataagtgactctacagccgaaaattccttagtgttttgtggcacgtgtcaggcttcttcttatccaaaggttaagtcagcagatttaaagtcagcagcaagaagcaaactcggatctgacttttatgccaaatcagctacttactagcagccccataatcttgagaagtaacttcattttgaggcagttcggttttctcttttctaaagttttgaaagtaatatttactattgcttgattgcagagaagaaagttttttgtttttttttttctaggcctcaaacacagcgattgtgtttggttaatatttcttccattttctggctcttccccttccattccctctccttactaccttgtgaaggtcagaagaagacctaggtgaacagagcatactttctaacatctcaaggctgtagccctagaatggtgtctccagcctccttaagttctcagttggaaaagcttaaatctgccaaagatatttactatcgtaaattccagctaacatctgaacataaggcacctttctttcagtctctgtgggaggagaggagcctaacttcagtaagtatcagttagcaaacccaaatggcctagtcacctggactgaaccccctttttgcccttgagtgccttttccctagcactccccagctttttgtttctgtctcctgctttttttttttcccagtgaagttgcattcagttcaagtggactctttcctctatttttcaatagttattgctgagtaaagactgttcataccactttagtgtccagctttgtttacctttgacaccattcagaagcgtttccatatttgtcatcatgttaaatgggagcttggctgtggcagggagatggacaagaagactacgtcattaggagagcatgtttagtactgcatagcgatgtgtaatagcgtaaaattatgaagtgcatacagtgcatacaccatacagtgccactcaacctttagtattttaaatcttcactttaagaagttttattttatataattatatatttttctctaattatattctaattatattgttgtttaaaagaatgattctaacaattctcaccataattgcatgtctgaggaaaagctacattaatcttttgaggccttctattttggtttaggggaattatgattgctttcaaagtaggataacaatcttttaggggactgatttttggatatatttatcaacacagcctaacttcacattcattaaatatttttgagagattgtatgcaagcagtattcttcactgataatttatttcaaattccagaaatttttcaccctaaatctaccattgtttttctcagtacttttatgttgttttgtgttgcagtcactgataattgctatcagaaccatgtataaattgatcaaatattgtatgagtaaaatatttaaaaagtaaaacaaaatgtttctaataatcatgctttgaaaaaataagttcaccccaccttgccacacactctacttgatttatttctcttctcaaacacatcacctttttctttttttttttttttttttgcctctctctgaagttagaaacacacacacatctccctctcgccctctttctctatctctttccctaccctgctgaaatctaatttgactaatgatgtcctaagctgtgaacattttgttagatagctattttgataaagacacacagcaatcaagtattaactggtccgtcaatttatctcttgatacaagtctcagactccagaaaaggagctaatgctcatccttacacgtttgtatcccttctgcctagaatattgcctaattagaaaacaaacaaaaacaaaagccaaaccattaagacattatttgttttgctgaacaaaacaaatatacaatgtatccactgagttaaacagggaaggtacaggccacatctgcatctggagaaggaaattgaggaatctcagtcctggtgacccaccttgatcttcacctaggagctgtctctgacagatatctacaagcctccatcccttcatattctacttagaattttgttctttaacacagatgtagatagatttttggacttctaaatatgtgaatagcacaaatctgggtaaaagagtttgtccaaggaagacttattcaacattttcaaagatcgtagaaggctaaaatatggtttgaaattacctagatgaagtgtaatagacacataaaaacctaagtctccattcaggattcacatatgccaaaatatgataggacagacttgacttattagcagttagtgtgagaacttgaagaattcttttaattaaatgtaaattttagatgagccattttctgccacgattgtggatttgaatctaagatgtgcattgtgcagtatggtactccaggtaagaaagagtctcatattgtttgttctacaggtaaaaacaaaacgtgaacatagaagtgccttgaaaactaattttacaaaggtcagaacaatggcatttataccaagtgcctcatagctagattttgtgtccaaacgagtattcgcagttttttgttttcaataggttcatttgctcctgtgtgtctttatgatattctttctagaacgctttctcccccttgtcacctggcaaatttcaacatcaagacccagctcagacatcacctcctcagagcaactctctgtaacctcagagccactcagccataacctcatctctcaggttcaacccttctgtgctggaaactatatatttattattctatttatcaccatataggcctgtctattccatcagacctgtgctgtccaatgcagtagccgttatctgcacatggcaattaaaattaaaattaaaattaaattaaaagttgagtttttcatttagcttgccacatttcatatgctcagtggccatatgtggctagtggctatcataatgggcagtgcgggaatagaatatttccatcactgtggaaagttctattagcaggaattgtgctatagtgagatccatacagaagactttctctccctgatctctccatcctcatcatctggggttgttcctagcatatggaagacagtaactaagtactgaacacaactgaactaagaaatagtgggcaagcttatatggaaacagcatcacactcagaatgcatcgctctagacacgagcataaaatttctgattcacgaaggtagatttctcttaatagacttactgggaaataaaacaggcttctttttagatattgagctcaggccccaaaatctttccattaaagccaagtaatcacctgccaggactccagtataatggatcccttcatggggttggaaattgcaactagaagagaataattgagattcagtcattctcgtgaccaatgtttgagcaacttttatgaaactctagagaaaattttgactacttgtcacgtcagcccctgactgtcaacaatgatccttgctttgctgagaatatctcgaatgtgtacattgtttttccctaggatcacttttactgaaactaatgtagctctaaaattttatattagtttttaggtttgtgtgtgtgtgtgtgtttgttttacaagaaaacctgtctggagtacaaaactgaattagcaattaaatcgttgtcaggaagcaagtactagccttaataaacaaagtataattgagaaaacaatgtcatatcagattttggcgtcattgactaaaagggagtgtggacaaatcacactaatttttcagacatctgtgtttccaataactgaactcagctgtatttggggctatggacacagtgagtattcaacagctattgaatgcaaagggactgaatgtaaataggtctgctttttaaaccacttctgctttgtgcagtgaaagccctaaagagctgttggaccaattaaataatttgttttttcttctggggcaacaacattttttttttgtatttttatctttgtgtccaaagacagcatgcttctaactgtaaaacagcacaagctctacagacattaaaaagtagctcagaaatgggtgtttttgtagacacagagctgtttttgtcactgaagacatcaggcaaaaatgctcttttttatacatgaagttaaataacccttgggatagaatattttacttcatttgtggagggatttgtgcaccctttcctgtttagaagggggcttctgtgcggatggagcatggccagaggaggctcagagcaaagcctgagaaagggcttcagtgactaagaaagtgaatttgggctttaataaaaacactggccttatatctgacaaaatctgttgctacactagatgatgtgggcagttgtttttctataagtgagagagcttctagctctgctaaataggaaaataagtatcttccctttcaaaaccgtaagagaaatgatattgaccaaacaattctatttaggagagagacttcatacactggaccaattattatcatccataatttatgaaattattggcttaacacctgttattttttgagctgtgttatctgaaaagatatgttgaagtcctgacccctagtggttctgtgaccttagttgaaaatagggttcttacagattttattagttaagataaggtaatactggagtaggataggcctttaatactggtgtctttataagggaatacatagccatgcagggagaaggccatgtgatgaaagaagcagagactgaagtgatacaactataggccaaggaacgccaaacatcaaccaccaccaattaagagctaggaagaggcaagggaggattctacccagggtctcagagcaagtatagccctgctgacatcttgttttcagacttctggtctctagaaccgagacaagaagtctactattttaagccacccagtttgtggtactttgcaatggcagtccttggaaactaatagaatacctgaaaggcttaatcagttcaggttcttatttctaggtaagatatttgataaatgaaatgaattgaaattgattttgtaggatcatatagtaagcggtgccccttgatgatgcttcttcagcccccttcacattatcctttattgactacgtcagccttccctcattacttgccttgaaatggcgggggttgtaaggagggattgggaaacaactccctgcaattatacgtaaaacttggtgtctgcatatgtacaattttctgaggccaaagttctataggttttttcggtctctccaaagagagtctaagacctaggaatgatcctgtttttaatgctgaggggtcaccatgtttaggatatcagcttacattctttttttttttttttttttttttttaacatccagaatccaacaggccaacaagtcagggacaggaactcagtcagagccagtcagagccagtaatgtgtcacagccagacaaaagtcagggacaggaactcagtcagagccagtaatatgtcacagccagataataacagctcatgaaaacccattgataaatgatgatgatttttcaaggtggtagttaagcacaaccggtattaaaattaaattatataaacttatacttgaatgcattatattaaaaacaaggtaagaaatgcttattactcatcacttcctaattacttttagtacttttctcttacctacattctgagggtttttttcccatcgactgcatctgtgtgataggcgtgaggatgtgttactgtgcatctcttcccaactttatgttcagtgacatcaagttggtcggtagcttgaaatcaattgtgggaaatcagatcacaaaggcaatttgcaaaacgactcccgccaacccctaagcaagatagttggtagtatttccaggctaccactgattcagacttgactgattaatcacgcttttatccctggggtttctattattttggacattacataagaatattggactagactcaaaagatggccattgaataatgttcaatagcgccttctcttataggagagttcataagtttgtctaaaagtgctttatgtctagatgtgaactttaagaatataaaggagttgtcagtcctccaattacaaaatgttcagggaataaggtgccatcacctttcttataacttagcattaccgattattattttaaaatgaatctaaataaaaacgttcataacctcatcaagaccttttctcttctgtatcccagattttccatgattgagtagcaatttatgagaacagtaagtcacttttgcatttgaaaataaaacgttttctcttggataactttctgaaaagtttcagtattatctataagctacaagagactgtttcctgtttgattaccttaaactgataaatttctctgggttatttgaaataaatcatacacgtgtttttgttttctttattgcctttcttttttcccttagaagcaataatgaattttatctggatgagatatgggaaaagtccccctttaatcttaatttttctttggttatgttttctaggattggccatgtgagtgtgaccatatgatgagaaacttatcctggtcacctaatgcaaatgtttctgaaatttttctgtagtttaatcaacctccattgtataaaaactgtgtttacaactgagcaaattactggagtagtaaaagaaacattgctagcctttaccccatgaaaaacacaataaaaaatacttactttcatggttctgtaactcaaatagaaaaggagatgagaagatttttccaaactgcaattactttattgttaacacttagtgtctagagttggaagaattaagtaatgacactaatattgttcatctagccacatgtaaatgtgctttagtttcccagcttatgcacgtcttaacactatgtttgtgcttaagccttttgcattgtgaaatacagcaaaaagttttctgggcagtgtgaatgagagctaccatgtgatagactggcccaaatgatgctgtcttctctgggagggaaaaagtaatcctcatcatcacgaaatgtcaaatttcaaaataaaatacttttaatacatacaatacagaaattataaatgcccctgacaatacagaaattcacctgacaatacagaaattataaatgccccctttagataattcagcttgccgcctcttgtggttaaggtgacactgctgcaccacctttttcttatcatagggaaagtgacccagaatatcaaggatggtgagataattcacaatagactgatgagtactatttgacattttgtagattcaaaatcaactcatttctgattaaacaccacaactctgtgcatcattccttttttttcctctcagaattttgataataagcacatgccagatatttatttatttatttattttattatactttaagttttagggtacatgtgcacaacgtgcaggtttgttacatatgtatacatgtgccagatatttaaaagaaacgtttatttttgaatgagtgttagccttgaaaagacaaatgggagaggtcgaaatgatggaaagatggatttgcacctgatatattcataggcaaggctgaatggctctccagtgaggagctgtatcagcacagggtctttataaaagctgggagtggaagtggcaagttcctttgtgtttctttttttgatcccaacatattaggaggctgcctgtcaagactgcttgaaaaagaaaggaacctctacccttaggacatatattttgttttgtaggagccaagggtacatagctttagggggaaaagttggtaatgtgctgaaaacaaacctctataaccagattctaactaagcaaaaggaatgctgtcaggggtgcagaggtggaaagtgacttgacgtcctctccagtgtctcttcttccatttcctcagcaacttggcttctcaatggtcagaccctgaatgactaattagaaggctgcaagaaatcaccatcctttaattaaataacggattattgaaggcaaatcattcgatacataattgaaaatgctgttaaactaagaggtcccttcctcttggatctgtaatacacattgaacttagtaacatggccctggggtcagtggcggagcctgtgtggatctaaggggagagattttggttgggaccacacagatgtgggaaaataggtcaaatactccctctctctcatcatctgtgtgctctctttgtaatttctcagtggtgttcatgggttttagatgttattaatcatgaaagttgtaaggtgcttggagatggtcccctttgttattttagaaagagaaagaagagagtggctgtccaaagactttctatacctatctcagtgcctgttgtagggataggagcctcagactccaatttatggtgaaggttttaggtagggaggaaaaggagacttttcctcccttttttcatgcatggcttaggaaaactggaagagacgaatctcaaaaacaagtttttcataatatcacagacataccatacacagagacgcacctctttaatattcaccttctgctaaggcatgcatgagtgattagtgttcatatttaacccattctgtgtctggcttcattttaatgtttgtgacagtcaaaggtctacaaggtgtatcaggcttttaatttttttgtatatacatgctacatacatatattttatatacaactctcatcaatatttcactcagctattcaccactacttggaaatgtcacttaacctcattgaatgccagttttctcattaacgaaatgggacaaatcatttattatgttgtataaaagtgaaattatttgccatgaagtgtttagaaatgtgtttggttccttttcagtgctggttttaagggatctttcttatggtttagggagtctgtgaaatccctgaaaatgtgtgaatgattttctgtgtatgtccaaaactactttttatatggagcttttatcagattttgaaagggccttagccctctataatttcacgtatcagttaccatttgaaggtaatccattttcagataggaaacatctgcatgttaatctttaataaattaatctctctgtgtgtatgtgtatgtgtttctctattttttcctcaaagcagcttctgaattggtaaggaattatttattcagtttatcacagttatcctgtgaaaaccacttctttgggtggcagaataatttcttaagcattgtcttttgtgtgtgattatgaaagattttaaaaatgcaagaatatacagaatcagagaccccagtgtactccccacacaacaataatacctcctaatttagaaatggggtgaggtaagatggtttctgttgcagatgaacttttatacattggcttctcaaagttgttcctcaagatctgtttttgtttgtttgtttgtttgtttgtttgttttttcttgccttccttccattatgtgtgattccctgtgccagtgcccagagatgcctgtgtgtgcaggatctggttattcctccttggatcaaatgagaagaaacacactttagagaagtttctattttatcattgctgtggtttcaatgtactctccaaagttcatatgttggaaacttaatctccaatgcaccagtgttgacaggtggggcctagtaagaagtgattaggtcatgagggctctgccctaacgaatgaataaatgttgccctcttgagactaggtttgttataacagtgaatttagccccttcttgctctcttgcttttgtgctctcttgcccttccacttttcaccataggatgacatagcatgaaagccctagccagatgggggcccctcaatcttggacttctcagtctctagaactgtaagaaataaacctctgttttgcataacttacccagtctcaggtattctgttatagtaacacgaaacaaactatgaccatagtaaaaaataattgaagcagttatctatttaactgaagaattcaattctgttgacattggaatattttaggaataactcattcccactcccatctttttcactttatattataggtaagtaagccaaccatctccaaattttcctatatggatattacgtcaggtaacacactgataaacacacaaagactgtgtttgaaatgcctacttataaagaatcttgtcgctgagcatggtggcttacacctgtaatcccaacactttgggaggccaagttgggcagattcttgaggttaggagttcaaggccagcctggccaacatgacgaaaccccatctctactgaaaaaaattagccgggcaaagtggtgcgtgcctacagtcccagctactcgggagactgagccaggagaatcgattgaaccccagaggtggagcttgcagtgagctgagatcatgccactgcactccagcctgggtgacagagtgagattctgtctcaaaaacagagaagaaaagaaagaatctttacttaatgtgtgttataattgtttgttggttatttttcatccctatcatcatttgggtttgatgaatataaatatgcatgtaatatactatacctttgcttcgcttattttttctctctggtcttccctcattaacaaagccctgtgtacctacaatgttggaacatgggttggaagtatgggatcaatgggattcctatagtatgttctatgttggcagttcattaaagaagattcaggggttgctggatgagacaatgacaaaatcaggcaagagaactcagataggattatttctgtggttgctattttagcatttttgcagtccacatatatgtgtgtcttcagtcattatgctttcatgctcattttctttatgttaatacaggaacataaaaataattttgctgacataaagatcacagaaaattcaaactggctttatgtctcatgacaaacaaatagaatttatcttctgaacctgctaaagtgagatttgtaaatgatatgagccataactgaagcatccagtcaggtgtctcctacctagattgattagagcaattattcttaagcatggcaatgctcatctcaaacccattcctctcctctgggtcaatgataagtataagacaagggtatacattcttaactagggaaaatgcaacctaataaaatgaaaaatgatggcaaaaatagaagaactagcaaaagagaaactagagatgtatttttgtgatagaaatatttcctgggaaaatgtaaacttggggtaaatatacatattctgctctaacacagagatgtggaactgaagaatcccacgtgaatgctaaactgtagatagataaggttgataacaatctgataaaatgaaactactgcatgttatactgttagttttgacttatataatgaggttggtcattcatacaagctaggcaggaaacaaaggcagatgtcaaactatcatgtaagcacagctgtttaaattaatttcatcattacctatgagctgctctgaccttgtaagttccgctgagtagagtacttaagttctgagacctgtcaataaatatgtggctgctgatccacttccaacagggcatgacatggtcataacgttttgcagcctcccgtttctacaaatggtaatgaccatggattccaaagagattgctttatagcatgtgttgtaccatcagaaatggtatattcaacagaagcttagtaatcactataggctgatttgaagtagatggcgaaccaaatctgtaagaatgccatgaagatttaaaaaacaaatgaacaaacaaaaagcagaaaacaaaactgtaaaaacccctggctgaagtttgtatgtactccaagctttatacatagaacaaaattatttgcatctggccttattggacttaaatatctagtctttgttggaaaagcattgaggttgaattataatggctatgataatttagggctgtgtggttggttacttgtagagaaacccaagatgacaatgataaattttatagtaaatttacggtaggtttagacgtgaatgtcagccaattaaatgagcaatcaaaccacaaatataattagtttcctttgaaatgccagctccatggagagccccattacttgacaaaaatagacaacttatagaagaaatccatcaaaatatattgtctggaactaaataagagctgaggtagcaactgtgtttattaaggagggaaacctaatttggaatcacagtgaacaattaaattttaagtaaaatatactgagagtcagtgacaagttacaggcttgagaataaaaactaaacttcctgtaatttttttctctgtgtgtatatatacacacacatacatataaaataatatataattacacaaactacacatttatttgttccaatatgtgaaccaacatttgggaaatttatgttcccaaaatttccattaagtagctacaagctcagaggcttaaggaccaggaaattaatatgaacattaacatgaagtgctcagtgttataaaatatagtagcaaatgatgggtgatagggccatttgggagctcaagacataaagtcattcccattcaactttgtgacctaaaaaccgcctttgggctcattcaaatgctggtgatttgaccagctgactttcagatttgggaactcagaatgaaaccattaaataatcacttaagccaaattcacctgcaaatatgctatgtaaggatgagagagattttactattccaagattgaaactatgaagcaacaccagaatttgtgcataatattactaaataatgcttctgaatcacatagacatatttttaggactgtctcctgagaaatctgactataataagaaaatatctttttgtgatttgttttgaatatctgttgaaattgctctgctaatgaatttcattcaacagacttagatcacactttcatgtttattgatagcactttgctcagttatttcgcggacttgtggaccatttttaccattgatcactagtatctattctacttaattatagttctgttggtatctcagtaatttccatttaatttgcttccatggaagtggttggaaactgaaacttttaaacatttccattactccaagatatgtttctgtctggtagaatttatctgttttcaaaaaagaatatattctctggggaaaataattagaaaccttttttgttctacgtaacgggttcttgcaatgtaaaactttacttgtaagtgaattatcaggatttcaaatatatccatattaaatattacataagtgtaaaatatcttaagctgtgtaactttttttgaaatgagccattttagtaccattggccacatttctgaagtatgccattattactcaaaaactttgtaaataaatgaatggatgaatacactatacatacagctcttaatagaaattgtaaaatatacatttagaaaaaaattctcaatacatgctttatcagtactgaaaaaaggtactaattttgatttattcagaaagcaaaagcaatagtagcactggtttttaaacaggttacaaatgaatttcttcttgcatcaataatgtcagaatcactaattaaaatagtgtatattaaaactcacaacccgtatttctaacctgagaagtttagcttatattaaagaaggaaacatatctttcaacatacctgtaaaaagtagacctgaacatttaggttaagatgatgagagtagaatactctaatcatcatcattaatcatcctcatgccgctctgtggattcctcatctcacagtaccacaatatcctaatttcacaatatttgtgagtgctgggaggaattttatatatctgagttgaccatatgttgatcctatgtattgaagcatgatgtctttcttatttatttaaaactcagcctgaaaaacataagatgatatcctataaatgtatttataagcttttattattttctgatgcttgaaacccattgtttcaataaaagatggatataacataataaaaatcaggaatgttcctcgaagtccagaatccttagtcattatattaaattttccctggcattaccattggaagcctgggatttactctacatatgatggtgtcaataagacactaaaactgtgtcactaagttggttatgctgaagtggtgtcagtggttctagatttagggtaaaaacaaaaaagagagaaagtgaaggcaagaaattgttaaaactctgaattcaggtttggaagttaggtgactttttttttaggccatatgttggagttttgtaccaatgcatgtttctctatctgtataggtcatggatggcggcataagtttgtctgttcttcatatatgttagtaacaagacagacaacatttttggcatttagtggttgtgttaaaatttcatgattagatatgttgtaaattttaaaacagcaatcacattttcagatactctgaaccagatgctcagcattaaaagtctaactttcccatatgcttcccctgcaggctaactcaattggaaaacctctgccctattggttctccaagacaatggcattgtcaccaatctaatcatgtcttgaactatattgttgaatacccagagtgatttctctaggtagatgcgatgaagcagcaggagtaactctgggaaatgcatgtgacagatgtttttaaaatcaaatccatcaaatattactactttaaattcactcaaaattgattagacccactcctgtgatcttgcctcatactggttttgtttagtttagttaatgttgcaattaatctctgcaaaaatctaattcatccccaagcttatttcatgccatgatctgtttgtgtaaatcttctgaagcaaaataccctgtctaatttgatctgttgtcatgattgaaaatactaagttgatatcactttgtttctacactgatataattaaaatgcccacgcttttctaattaatctaatctaaaattgctttggctattagatatcctaatagaatgtaatgcattgttttttttcttatctctgtcattagtcaagataattaattttgccaagtttgaaacacacccaatatttatttgcatatttagatttcaatctaagccagacttctttgtcgaatattatccattactattaaatagaattactctaaaaagccatgttaacaacgttcaaagtagaatatataagaagtaatgtgttatttgcatacatactgtttacatttaaatatatatgtacataggtgtacatattcaaattaatatatttagagttaggcctaataaatataatatatttaatacaagatattaagtaagacacattatatgtaatactatatttaggtacatacataatatatttatatacccaaataattatttataatgtttatgatatactttctgttatatttcaataaacaaattaaatactctttacattacacactgtaagtaagaaatataaaaaagtaaataaagacttagaaattcagtaaatggccagtccattttggatatattgattgtcattatggttcatgtttagtttttagaaataagaaatgtgaatattttatcataattattttagggtataagaacataaagtggtggatactcttcattttaattgcttattttcaaaattgatattaaatagtagcacttacattacaaatgcaaatttaaattgcataatatattaaatttatacaaggtattaaatatgctgatgaagctactctttaaaaacatccctaaactcattttacaaatactctgactgaaagcaaaaacaagagtatgtaaataataatgaacgtgataatgttggttgtaagatattttgataaattgttgtgtttaagtgtgattaaaagcagctaatatactcaaagatatctgcatctcacaaaaatcttttaaaatattctatttggaaaaataatcctgtttttaattgcttcattgaatattttataatgtattttattatttaaaacacttttgaaaaaatataaccccatattttttagctttgactgtattttcctcctcatatttaaattcaatactttattttatttttcaaagggatatttttactgattttgcaaagagggttacaacttcagttcagaaatatgccttgtatagcttaaagacttaaaaagtcaactttttccaaaaaccatttttaaagaaatttttattgataataaaataaatgaatgggaagacttacaacattgagataaaattgctatgtaaaagcatttttaatggagaaattcattttgtatttgcatatgtttagagaaacatgcagtttaatttgaattcatagggattctgcaactaaacgacacttaggtttctatttattaagttcatgggccctacctcaattttttttttctaccaacgtattccatctccttcccatatttttcatattaacctatatggcacaggtttatccagtccttcatccggtcacatattcatattataatgattatataagctataactttataaatacgttacaaaatgtggattgttttgatatagtgattaagaagacaaaatatatggaaaactactcagtatcgctaggcatcatggaaatgcaaattaaacaatgctgaaatacccttaggcacccaccagattatttaaattaaaaagactaataatgcaaaatgttggcaaggatatggaagagctggtgtgcacgtatattattggtggaatgtaaagatgaagttatcactttggaaaactctttgacaatttcctgtaaatatatgtcttccttataaaccagcaattctacttctaggtatatatcctagagatacaagtgcatcggtatataaaattgccaaaagaaggtattcataggagctttattcatagtagcaaaaatctggaaacaaccctagtatacatcaacaataaaataaacaattttgatgagtcaaaaatagaatactgaacagtaattaatgcacaaattgatgtacactacaatatgaataaatcttaaaaacattctgagggaacaaaattaaaatagttcctactctaaaaatatatttaagtgaagctcaagaaaaggcaaacctatccattatgatagaactcagaatagaggttattccagtgggaagattttaaccataatagggcacaaaagtttagcagagatggaaatgttttatctcttgattttgttggtgtagacatatacataaatatacacacacatacacatatgaatattaatcatgtgatacagttaagatttatagattttgccaaatgtaaattatgtcaataaataaaagaaatacagtgagttgttacttaattaaaattagagggtttttatcagcattgatgagactaaaacataaaatacataaagaccttaaaatcacaggcaacctacagaatgggagaaaatttttgcaatctctccatctgacaaaggtctaatatccagcatctataaggaacttaaacaaatttacatgaaaaaaatgccccatcaaaaagtgggcaaaggatatgaacagacacttctcaaaagaagacatctgcagccaacaaatatgtgaaaaatagttcattatcactggtcattagagaaatgcaaatcaaaaccacaatgagataccatttcataccgttagaatggcaatcattaaaaagtctgtaaataacagatgctggcaaggactcagagaaataagaacacatttacagtgttggtgggagtataaattagttcaaccattgtggaagacagtgtggtgattcctcgaggatctagaaccacaaataccatttgatccagcaatccccaaaggattataaatctataaagacacatgcacacgtatgtttattgcagcactatttacaatagtaaagacttggaaccaacccaaatgtccataattgatagactagataaagaaaatgtggcacatatataccatggaatactacacagccataaaaaatgagttcatgtcctttgcagagacgtgggtgaagctggaaaccatcatcctcagcaaactaacacagaaacagaaaaccaaatgccacatgttctcactcataactaggaattgaacaatgagaacacatggacaaaggggaacatcacacaacagggcattatcggggggtggggagtgaggggagtgagagccttaggacaaatacctaatgcatgtggggcttaaatcctagatgatgggttgataggtgcagcaaaccaccatgacacacgtatacttgtgtaacaaacttgcacattctgcacatgcatcccagaacttaaaaaaaaaaaaaaaaatctgagtctaattcttcttcagcctgactacccctgcttttctcaagaaatatgtcatatagcacacttccaatcaacactcaaaaactcttatttccttgggaataaagaagcagatttcaaattatagattattgtgcacagtgtctacttctaaaactgagttactgtatttgaagactggtgaaagtttcaacgaacacaacaataaccatagatagatacttatacatggtgaagactgtaccattacatggattatttcactgttcctcatggcaatattaatgaaatggatactattttgtaaccttagtgagccatggagctgtacctcaaacccagtcacactgcctttagaagacctgtccttaacaatatattatttttgtgctagatattctgatcgtaatgatcatatgaccaaaacagttggcccattttgaatcaatctacatttagatcattgtaagtaattagatgaatcacttgcttattggcaggtaagctattgtgatttcttaagcatatatttgaagttaaactgttctttggaacatatggataattattttttttattacattttaagttttagggtacatgtgcacaacgtgcaggttagttacatatgtatacatgtgccatgttggtgtgctgcacccagtaactcatcatttaacattaggtatatctcctaatgttatccctcccccctcccccctccccccaccccacaacaggccccggtgtgtgatgttccccttcctgtgtccatgtgttctcattgttcaattcccacctatgagtgagaacatgcagtgtttggttttttgtccttgcgatagtttgctgagaatgatgggggataattatttatgttcttccaatgtaggtacttaaagtagaatgtttttctactttaaaatgaagtgtattagctttatgaaatttaaagagaagatacaggaaggcacctatgagaaggctcacgtgttcaagtctgaagaaaaaatcattggttttaagtttggaatccctaagttacctttagagagaatggctgaattgctgcataaacatctgaagctggcaggaggaaatttggaagaccaaaattaggccatcccagaaacctactttatgatgatatctgtgtgatggagtaatgtagaggaattgacatctccatttaatttaattcccaagggagttcaagaaaatcctttatgtatcttatttaatatgtgttcttcccctacacaattaaaattagaatgcaactaagactctactaagggaaggaaaatacaaatgtaaaatgatcattctttcaattcccttagaagtttgataagtgagagaaggaatgtcaacaattatgctcagattctagactatcactagattttgcctctcgaaaattcttctgcttcctgggaaaataattgctaataagctgtttaacaaagataatcccaatctgactttaattcattcaaaaattatttatagcaagtttaaaatatgaaaagaactgaaacctttctgatctgaccagctggctaaaatcttggaacagagagttttagaatgaacataagctttatgcatttagccgaattaaacatcatttaatttgtatgactctgattaatcatagtcactcttaaatacaaatgcaattttagatttcctctagctcaagtttattgaacactttgtttctgatgtagactaaccttcagttggttgtgtttagttgctagtggctttagatgccccttatgtgagtgacagtaatatttagagggtacatgcatgtgaagggaaaatcttgaaatatttatgttctaccataaggaaatctctttttttcttcagcttagaagaggttatatccttacgtacaaacattatgtttacaatgttttttaaataaaatggtatttttttattgcaactcttcgtctacaatagagatcgatagacttactttaccatatgatgaacaaaacctaaaaaatattacttgtgaacttaaccacaagtttagacaaacaaatgcactgaactgaattttgagtaaacttatgtatagccaaggattaagaaaattccattacagtctatagataaactcttactaccattaatatatttttcaaaagcttgtgcattatgaagttcatgtctctttaaccaaaacatataaaaatatatggtgaatactttgtcaaaacttgtggaattcattaagtataagaatccacataatccaagtttactactatttaattttaatccatagctgaataatgaaagtaaatgaacagagccaaaaacatgtcacttttgagaatacatatgtcctccaaataaagtacatttatttgtattattctttgtctgtccatcttctcaagctccattaaaaaagaaaatatatggaagtgggtgaaagcttgaggactaaatgtgtagctgcaagtacattcttaattcagaacttaaaaatttctaggtagtgtttaaacctattcaaccagaaagggaaacatattccactaaaaccattgataaaaaattatatgatggttacattcaaaggcatgtcctattttgctctcaaacacagcaaaatagcaaaatagaacatgcctttgaacataagcatcatgcatttagctgaaataaacaatgcatttgcaaatttttgccttagcttttgctataactttaaatgatacatgtccttgagaattatggtcaaattttaaataaaaataaaaactgaaaacgtctgttatgttagtttccatttcattattcactagaaataatgaaactaaaatgttacctaacatatttgaaactcatgacataccaaattaaagctaaatatatattaaaattttaattattttgtttatttaattttataatgggagtgagagtactttgtcttttgagactagagaaatatgtaagaggaaatgctacagaatcaaacatttttgcatatgtgtcaagttatagaagaaattagcaaagaatatctaactatatttgttttcaaaagattttttacgtctgccctttaatgtttacagcttatcagcaactagaaaattgagtcaagcatttatggtaagctgtttttactgaagtatgtttgctggttgataaagatgtcctctgtgagaagatagaagtagctagttatcttcagccagaggaatattttgtattaacatgcggcagagtactttgaaaagtggtttattgaagttcttactcactttagttttataaaaggcaatgtgacataaatcatggtatgttttttttttctttttcttttctttttttttttttttgagacggagtctcactgttacccaggctggagtgcagtagcgccatctcggctcactgcaagctccgcctcccgggttcacgccattctcctgcctcagcctcccgcgtagctgggactacaggcgcccgccaaagttgggtgaagggtttacaaatgttaattttcttatgcttcataacatgcaaatataattttacttatatgtgatatttttgcgtaacaacttccagtaaaaattaaaattaatatgccactagtcattctaaaggaacatataatttaagcaagaaatgtctttcttttcagtctttattaaagtgggttatttttagtggtttctatctctaggtatctaattgtcattttaattaacgatagtttataaacaagtatgtccagttttagaagtttgttaatttcttcaataaccatactaaattctaagtctgtagttactgggtacaggatgcagtcttaaactgggatttatattcatgatattcaagggttattcttaggaacaatggtccataaagttatggggaaatgataaaactaggaattatcactccttctagaaaaatgtatacatgctcatagatgtaattttctaaaataaaatctaatataatagtctcagatctcctaaaattcatccattgctagcagcagtaacatcatttacttttactatgccaaaaatttgtagtattttctttttatacatactactgcaggttccgtaaagttgtttctaatgtagatttcgcctgagtttccccatgtcaatttctgcatggtggcaatgtttcagttttcattgcctgttcttaattcctaagtttagaacatttgggttgcaacagcatttatcaatgcaccaacacaatctgcattccactgacatgtacataatcttgtcttgatctttgatgttaaatgtgagttttacacgttaatacaattgcttgagaaattccttgatgggtgcagcaaaccaccatggcacgtgtatacctatgtaacaaacatgcacattctgcacatgtaccccataacttaaaagtttaataataataagaagttacaaaagattggaagctagcatcatattatttctacttaggcaacatgacaccaactcctgtatataaaacaaatttgtagaaataaatactgacattatagagtggtgtatgctacagcgtcaagctgtcagctgcgttggttttacctaaattctgaatataagaatttacccagttgctcccaaactggctttaaggaagatacattcttcactaacctcgttgcctacgtctcctctttttttgtgcaaaagtgtttacatattccattctctttatcagaaatacttatgccctactaactatacttttgattggattgcttcaatttatttttgatacttcaatttaaatatctctttctcagggatgatttttctgtacatgtcctttctctatcaaagcatgcaattcattttgttttctgaaattaaaaagaccagggtttattatgttgcatagaatatggtatgtgctcaaggagcatttcatgttgaaaattaaatgtacaaatgaatagatgaaagaacaaatgaatgctataacatagtgcatactgaagatacacctgtttgatgaataaaacatgctctttgccttcagttttagagatgctcatgacaaaaactgaaataattgcatttggactttcctacatatactatctttatatataatcttgttttataccaaaatcatgattgtctatttttcatacaatgttttttcaatgtcttttcttcatgtagtctcctacattccttaagagcattaaaacactagatttcagaaccaaggagagttccaagttgatgtcaaccaacaaaaaacttggtgcctgaattttgtaggagaaaactagtaatgtactttaatcagtggttaaaattggccgctgactggggccaatgctgtctagcacaattattttaacaattatcatttttacaaacaagatagctgagagctttcacgtaattcaatagctgactttaaaaattcaggatcatttttcccaactcaatgttacttcaacatcacttgaacctatggctctgataattgatatcaaggctgaatttctcttttttgcctatatggttcatagacatttaaaaagtcaacaccttttatttttacagaagacattggaactacccctgttacttgtgaaaagttttcagataggaaatgagactttcaaaatgaagaacaacttaagccattgtcatgagctacttttcctagggttggtaccttaagaaaactcactggtactcatatccccaatccaggcaaactttttattcccaggatttacatactcttaatagttcatcccaccagccttatcctggattctgccacctcacttatccttaagccttcccacttccttttcataaaatattaaatctataaatgaaaattccaggatatatatcacattatcttttgctgtgatatattccagtttatctgattttttagaccgggaattggcaaattaaggaccatggatcaaattcagctgaccatgcatcattttttaaaataaagttttattgaattacagctagggtcatttgtttacttattatgtatggttgcttttgtgctgcaataccaaagcagacagcatgtaacctacaaagcctaacatgtttattgtctgaccctttacaaaaaggaccttcattgactcctggatgtagatattaggaattataaacatggttttaaggaacatattagagaaaatggcatttcctggagtcacaaactaaagtgattgtagccacatgcaggtaaactaaaagtgatcagacttggtataagaaatgggaaatgatggacactgtgggaactttgaaggagcatgcttagtttcaaaactacatctacaacccagccccaggtcaatttcccttactagattgtagaccatgtattgctaacccttctaccttttaaagaaaagccagatatttatattctaatgtgacactttcaaataaaaaaaacccaaatgttttagggcaatttatgcccaaaacatacttttggcttgatttggccatagatcatcttgttataatcccagcttttattaaaaatagttcttttcatgaaaatttaaaattgcaacatattgcagagccaaggagagatcaacaaattatactttcttagatttctctgaaaatatttataatagaattcctaacacctatattaacatgttcataaaaatgtcactgttcaagtctctgagtgtttcgctcaaaattgaacctgcaccaaaagttattcagaaccagcaataatccaaacgaaaaaggtctcatactgtatttcctaacaatgtggcatgtttcacactcattagttcctagccctagtgtacatgtaaaagtcatccaattagccttggatgaacaatatctattgaggcaatgagtaaactgtaactaatactataattgcatcttctcatatgtttgttttaaaatacctctcaggtcaacatatttcccatttagaagggtatgagatctgtagggtatggtggataagtcagagtccctgtcccccttagctagggaattagatagaatttaataaagtggcttgtttttaaatgagggggaaaaatttagggaacaagagagagtgcagagcctgcggattaatggtagttccaatagctcattaccacctctagaccaatagaagaaaagcaggttccaagttatgaaacctggagtgagaagctaatggctacctgacaagaccttttactagactgatgcaaccaaccagctgtggcttagaagccagggagcagagaggaaaatatcctgaccatcctctcaccttctactgatttctcccagtgttgaacccactgacggcctgagggaaagggcacttgctgagacagtccacaaaggtcggcttcctcacacacacgtcagggtatggcgaagacagaggttggctctgaaggggcgaagagagaatacctggccccgtgttcattctttcttgtggcttgtaggtcagtgttctaacctctgaaatctgtgtggttttctgaagctgaaaacacagtaatggagagcatgaattggaagatttttctttaaagctattgaagtgaatgagctgtgagtgaatacttgagcagagagtatcacatgtgtctgttaatgactattattatatcgtgttctattatgagtctggcaagctgagaagtcaagtgagggtgacaggcacagtggaaactgtgaaataccatacctcttctagcatcctctgagaggaagtactgaacagagaattgctattctatataaacttacgtgtgtgtgtgtgtgtgcatgtgtatgtgtgcctagaaggaagaattctcatgaagaaaaggataaattgtacacttatatattggagtattccccagcactgaactcaactacttaattttgaagttcaattgattgctttaatcagaccatgctcttgcagatgtactgtaacagagagaaagaaagcacgtcactgttaattctagctgtaggctggcctaataagaaaaataacttggatgacttgatggattttgcacaattctggaaaaccttaattagtattttgggaaaagcaagcagttggttaatggctgcatttggttttatttggactttattcaaaagttctggtttcacctacaaataactacatcaaatgttgctttttgggttaaaatttgcaaaattgagtttgatagtttagttgcaattaaaatgttgggaaagctatattttgtcagctgtttccaggttatattaatattctgtttcttcatgtttacataatttatgtcagcatattaattgatctaaatatttttagtgcaaaatctatattataatgtatatgtttgaaaatatcttttcaggaaaataaatgcaattaaatattcaggatttagcatgaatataaatttgtaataacctattttaaaaagggttaacctcaaattagatattcttattttaagatgggttgagaacatatgctttagggtcataatatctgggcttgatcccacatctgccatgtattatctctgtggagttgggccggttgtgttacctttctgtgtcacttttcataccagtaaaatgaggataataatactatcttatgagatagttggaagcactaagggttaattgcaaagtagttaaaacaatggcaggaacatagcacttaataagtcttaattattatgctttcactaaaaaagatacatacatatatatgttcagtattttttatatatatatgtgcgtgtgtgtgtgtgtgtgtgtgtgtgtatcactaacggaacaccatgggaaaactaggaactctaaatttatttaaaaattattaccatattgaaatgggtgaagagatcataatgtgtcactagtatgcagattatttttctccttttgccctgttggtagaactactaaccctatgatgcagagaattgtcaaaagcatcaatacactggatacttcttgataagcctttcttttctgggtgacttagtttctgaaatttaaatgtgatgactgtaaaaaaatcctgaaaatgaaaaaaaatcaaacaataataagttttgtattattggatttttccagtacatgagagctcatcattcaggtctcttcctaagtctatgtcaatgatatccccttgaaagtttgaagtaggcaacgaagggagtattaataccacacaaataggttaacgctataaatctcgactttttggaaggctggttgttaaaaacttatcaacatgctgctatgtaatccctacatttgaagagtccaattgaattattctgtgctttgatgcactttttctagttttgtaataataaatgtaccatagtaattagtactacttaacagtatagaagtatttaccagtctataataaagctgtttatataaccacaaaaattgtttaagaaataatttcaagattcttctaagaatatacagttttgtgacaaggttgacctttagtagtcgactgtttctaaagaaatgttttcttataagaccctaaaacttagagtataataaaaaaaaaacataaaaaaaataaaaataaaaataaaaaggacaaacacatatataactcagaccaaaaaaaaaaaaaaaaaaaaaaaaaaaagattcttcttatgcagcccagattttggtaatacgtcttcaatgttaaaaatctggaccctgtgatgaaataatttgtgtaccaaaccccagcaccacgcaatttacccattttacaaacctgcacatggaccccctgaacctaaaataaaagctggaggaaaaacaaaatctggaccctgtcgccaggcaaaactatatttgagagatgcttcttcatttactagctaagtgattttcagcaacttgtttgtcctttatgatactgtgatctttaaaatggttgtttataataataatatagagtttttagaggctttaaagaaatgtctgtgaaattgaacgcagtgcctcacttcaaaagcctcacttatgtgtggattgatttgacagctgctgtatgatctgctttccaggattgtacatagaaagcatgctatcctgcctgcagatgccccaaattccacttgatcgtctagttagtggaattattttatttctattatctggaaaatttagtctaaaatgtgtatctatatgttatggttcagttatggttcagatgaataaatttcaagggatgttttgcctattagatgggtagaatcaacaactctataacttgagtgtggagaagatagacagtgggtaaaaatgtgtttagaatggagaaaattgacttgaagaaaatatactaagagcaaaatgtatcctatttgcctttagctcaggacgtttaacttttaacaagaaacacgctaaattttctcttaaaatagtttactctgaagtgttagatgaaagatatgatataaaacacatataaaagacaagaatcaacatagggacaaaacttttgggaatagggacaaatggacctgatgttcttttgagtataatcttaggcaggccaattcttcactaaggacttttgtttgcctcccttgcaatctctaaaatttcacaggatcctcctctgagcttgatttgtgaggttactgtaaatatgttacatttgcatagctctgaacagtattcaaatgctttttactctcattagctgagggaaacttcccatgagccaaagagcccatcaaagtaatgagggaagaacagaggtttcatccactgaatcacagcgaatgggaaacagaaatgtaattccacaaaggagacccaatagttcctagtaaggaagccaaggactattctctgatgactgctttcttgtggggttctagtcctttgatctacttttaagtaatagcaacattctaattaccaattcaatttaaaattcctaagccttgtaaaataggtaagtattagcaaatgttaaatttttatgagcaatgggaaaagggattgtagttgttgtttcttaatagatataaattatgtcttttatagttaatagcactaacaatttgctgtagcttagcatgttaaaaataaaacactctacctgtgtatacctctttgacctaccatcttcatagaaacaagataaacattatcattgtaaattttcccctatcaaaatgcatttttatttacataagtaatacaggaacacatgcaaattgtattaaaagttaaaatataatggagaaggctgattcttgaaaatgcttgaatttcacaaaaagatgaaaagctttaatctatgacccatgagcttgcccttaaatctggttaaaaattttggaaagttataagcaatcaaatgatgtatgaggatttactgacgagtcactggaagtagatgagaattcgtgaaaaatagctatttaaaaccagtatcctgccatttttaaaatgatatcactaagctggaagatcgaaaagatttggtaggaataaaaaaataaatttgtgctatccttaaggaaaatattaaggactgtaggttaacggggtagatttctagtgatgtaggagtatacctaaaatggaagagagatgaatgggtatcagttaacaggattgtttgccttagggtttgtaccttggcccttccctgttcaacatatttgttaaaggctgatgtaatctgacttgaggcgcagcccactagtaaacataagattcaactgtgatatggaagtctagctcccaacagtagtttaatgccaatccttattatagcatcactattccagaataagactctaatatctgactctgatgcctgattttatgatgttttacccaaaagttatatttatcatgctttgcctagcatgttggatggaaatgaaaaccatactacttgagggacatttaaagtaactgaagatgtttagactggagaatataagattaaatgggcagagaatggcagatttaatgggcaaaaactatgatacacacacacacacacacacacacacacacacacacataaaacttccatatctgagggtattaaactataaaataggtcttggtggaataaattaaaatgtggtgtaaaataaatataatttattttttatttaatctaagaaaaaatctttatactgtttatagattttcataattagaataattccctgtgaaggaatagctttttcaacacagaaaatgttccaattcagcttggaggatgacttttcagggtgattggtcatgggactcatgtgagttaataaaataatatccaagaacatttaaaaactgaagtcctcccctactccataagtctatggagaatttttattagtgtaatttttttggaagatattgatatttaattatctttattttaatgtgtacttattaaacttaatttagaaaattgggtgaaaaaagaaaatttaatgctctgtcacattggtacaatgttgtttctttcttttctaatatgtaatgatctctctttatttgtcttttatgtcttatctatgtttcctccaagtctttttagccatcacttaaaagttatgttatagagcattgtcaacttttcaactttttactaggaagcagtgattttttgattcaacattctaatggctggctttccttcattgaattttctgctttccctttagaaaatgtagtctgaattaataactcacacctaggaaatcctcattacttgctaccacaacctgtctttaaattttattattttattttatagacagggtatctctctgtcacctaggttgaagtgcagtggtgcaatcatagctctctgcatccttgaacttctgggctcaagcgagcctccttcctttgcctcccaagtagctggaactgcaggtgcgtgctgccatacctgactaaaatttttacttttatttttttttatagaaacagtcttactatgttgtccaggctggtcttgaactcctggcctcaagagatcctcctaccttgacctctcaaaatgctgggattacaagcatagccactatgcctggcctgaccccctctttctttaaaagcaaaatttgaagaagtctatgaagatctagaagggtatttccaatttctgtctaatgacatcccatctttgaaagaatttgtctcatctttctcagtcatcacagattatccaaaaaattatttgtaattattgaatcccttttattattcacttaaaaaatacaacataaatgctaatttcctgggcattcttaagctgacagagtgctgtatttctttctcatgtctcttattcctcaccataacagcctggaaaagcataccctccttaggacaattgggttctcgacttctactacactgtagtagaatagcaatgctgctactttccttggaggagtagagatatctggttcctgttttatagggacactggagtaaaatccactgtttatgatgaatgtggaaagggttgatacagctcagcaatgaataagcctcagagaatccatccttatgagagatattgtagaggcaaatctagtcaagtaacgttaatattagcatcaacaaacattaatatagttcatcacagtttataaagtttataaagagctctaaatgtcattcggagagccagtttgaaattgtgtataactatgaataattttcaggcagggaagctgatgttcaggaaatgtcagtgctctgacaaaagtagagcttcaggtcctctgtaggagaaaacccaggtaaatcaatgctttgtaaaacatttcggtatgtccatacttggacacatctgagatgtcactcatagcagcagtcatttccattttctttttttctctcttctttttctgtcaacttttcttctcactcctcctttcctttcttttactttccctcacttccagcctccaacttcttttacagctttactctcctactgatgttagcaataacttgcgtatagttttgacgcacgtcaagagcagttattttttttttctgttctaatctctgagaatctggccaaggggagacagtggcattataaagggaggaagtactggattcatatgagcgagtaaggtggtcttagagcaaagaagtgaaggcaggttagcatgaataaagataaccatggagacctgaacagtgatatatttaagaatactgacaaagaaatattagggaacatttagcagtaatcgcataatgacaggcatatggacatttttattaaagcccaggtagccagtctaaaatacactgtgtccaagttaatagcattgcagaaaacacactctcatgttgcctacatgggcacgttcaactcagacaaataatgctatcaatggtaattggaagtgctattatccatatctgaatgtgcctcaggtaccattagcagcagcactcttttcgttttgttttgatttttgctttctcaactgtagaattcacattatttttattaaaatttgtcttgcattaaaaattgtatttaataatcacgtctttctctcagtcaattaatgaagcccctgtccccccagctaaacagacttgcctcttttcaccacttaatttctaaagtgaagaaaaattatataaatagctaactgcacaaaattacatacgcataatattcaaagtattttaccagaaattatatagttataccattatcagccatattaggtagttgttaaaatccttaaatcattattctaattcaggctagtttaattcttttataacttcttaacctaatagttcttttattaattatttgcaaaattgactgtttaaacatttctcattgcagtttaatatgaaaactctgaacaaggacaatagtctcaatgttaaacagtagcctctacaatacttccactggactttttatgacatgcaaatatgccaaatgtcccacccaaccagtgttactgcagctatgattgcaacgtatgaccatgaaggaaacaattagtataccacaaataaattcagaaatgtctctccttatattcagcttatattcagctatgtggctgagaattcttggaatgaagaaaattaccttcttagaaagtttcccagttttttctttttccatttgagctatagttttaagagggagaaatgcatatgagccatattttgtctttacaactaattcacaaagaggtgaactaaaaattaccaaaatgtggattcatatgagccatattttgtctttataattaattcacaaagaagtaaactaaaaattacccaaatgtggattcatatgagccatattttgtctttacaattaattcacaaagaagtgaactaaaaattacccaaatgtggatttttagccagttataactcattagaaaatattagtagttggttgaacaaggaaacacagatatatgggggattaataattttgctatgtgggttaagaatagcctaaaataaatttctattgcttcattagaacagtgtcacctgttcatgagatcctgaaatgtgcctgaatgtaatgcaatggcatacaataaatgtttattatttgcctatcatatgtaagttattctgctgggacttttccaaggtacatttagggtagaaataatcactgggcagagtcaattataccttctccatgatcccacagcaaactggaaatgcctggtttgtagcctttaccatacttcatggaaattatctacttctatattccagttgctgtcactaggttttgaataacttgaaggcagattctatgtgtcttttttttatctttgtatagctacacaaactcagaggtgcatcatatatcatattgttttatttgattttgattgaagtaaccacaaaaccctatcctatcattttgaggggctattcagcctatgcccctcctccacttactcaacagtcccatgtggcttggtaaggctgtgtgtggagagagcctatttgtcttagatcagtcctcatcatcattcgtcatcatctaagcttgcctggtctcttaaagatagttgactcgattgtttttgtgctgagtttgagtactgaggtatttgttgaagttgggagccctgggctctagaatctagcctacctagatattttatgcagccattcacttctcagattctaccgtcttctcagagcagaagagggactctttctggtttagataaatgttaagtctttcccctagtttaaccttttaagaacttccttttcttcctcaaccctcctggaatgtctagcacaatgcactttgttttaggttataaaacaaaagacaagaatggagatggtctccaggaaacttaggctttcagccaattattatccccccattccaccccagtaaagtaggaccactaacttctggctaccttgctagaataagagagataaaagtataggagatatatgcacacattgacatctcagtacattttctaaccataattatatatctagtgcagggaaggttctgccacataatatatactcaataaagtgtgtggaatgactgaataaatgaatgggactcttcaacataaagaacagggtctattccattttcatttctattttagtattctatctagtattcaggattagcattgtacatgacaggaagcactcttctttaagctggaaatatgttcactactaatttatgaaaacttagctgttcttggacctattgctataggtctctgtgctatcttgagtaataaccagaggctatgctgtaacaaggcccccaacttagtatgtgcctttgctttctagttgaggattagtggataccacattctaactcaaaggaaagaggtttctgattgaaattttgggcatcatcctggtgggagaaatattttagaacggagcacagtgttagttgcattccctcacttcactggggcctaggcctactaacagtaactctgttgaaatgcattcttaggagaaacagtgaaatgaaatacatatacctgcacactaggaggcaggtgacctggaattttatctatcaccttcttgagcagtgttgtccacatccacaaatggggccacattacctatatattagactatgaatctctcttgaaatatttttctggctgggtggggtggctcacgcctataatcccagcgctttgagaggctgaggcagatggatcacgtgaggtcaagagttcgagaccagcctggccgacatggtgaaaccctatttctactaaaaatacaaaaattagccaggttttgtggtgggcatctgtaatcccagctacttgggaggctgaggccggagaattgcatgaacctgggaggcagaggttgcagtgagctgagattgtgccactgcactccagcctaggcaacagagcaaaactctctctcaataaaataaaataaaatattcttttctgtcttgtgatcccttagaatcttgataaaattatttcatagactagatatattgcagtcttgttgcattgtaaattagagttcctcatcttttctgattaaaatcaactttttttcactctaaaatattatgtgggaagttggaagttgctaaaagtacagatctttagagtactggagatgagggtccaattcttttctgttgtaagagtgataactgatttggatcagacagaaatgactttgctgtatatctgcaggacttagttatttggcttattcaaattttgaatacaaaataaaatttgagtgaaaaaaaggaaagggagattaatagaactaaaaaaattttcaaggaaatataagacaaaaataaatataatattagggttcatcaaaattatatacactggacaccaatctaaaattatgtttaaataatttcttcagttggctaaagtatttcaatgatactttcttgggaaggactcctaaggttttgtaacatactctttgtagcatatgtttttaattatattgaaaattaaaaatcattttatagatgtgggagtgtgtatgtgtgtgtgtgtgcattgtatgtatgcaagtttaactaattttaattttctgttaatgcatttttcaaaaaggggcattttgatgttcttggttgaactggtccagcaatataagaatgtgatattttagcaaatatgcaagctgactagcagatggtgtgattttgtgaaatatgtatattgtactcaggaggtcagccacagattttcctgttgtttgggtacagaagacaatgtcatcatctagaaataatacagaacatactttcatctttttgaatcagtttattttttcctgccatgaagatttagaatctcctcaaataaaaaaatacaaaacttgtctagaagaacgtgagaaagagaattgattctaattttctctatataaagtcttatttgggaggaaaaagaagaaaatatattaaaagcccttttacctgaaagaaagataattttctggaaaataggtagaccaagtgtatgtatttctcatttgatttctttgttgtcagctctttgcatggaatacagaagcttattgagttaacctttttcttgtgatatatgaggttgcttgtgttttgacaaacatattttgcatgcatagcatgaattttgaataaaagtctaattttaggtgcattgtctttcatgtaaaaattcttttaggatttaggcatctttggtcctatgcattgtatctgtggattcactacctatcgtcatagttcctgaaataagaaaatctcaagtttccacacttaataattttgcatttatatggaaaaaatgaataagaaaaatgcccacgtggtaaccccttggagatgaagagctagtatactctgagctactgtgagagctttagggtacagagtgcatgaggacatagggattcttttctgagcagagtttggagccctgtagctgactgctggggaaattagtttctaataaaaagaaaaacctgcagttcaagtcagactaacacttgaggtggaaatggtgactctcccagaaaactccctttggctctaaatctgagttttctcagcaacccacataaaatctttaaaagcgtaatggcatacctagttgttcacataaagactcttaatgagttgagaattctctgctttagtatgctttacattcaggttaaatagagttagtctccatgaaagttagcgctggttctgtgacaagtgactgaagactcctaaacagggtaaagtcaaaagggaatacaatgacttatagaaataagaatgttgtgggtgaggcagacttcagttggagtgtaatgaaggaactcaactggcaaaaccccaagcatgccatggttagctcttatttttactcagtctgcaactagactcctgaagccaaacatgggtggaagacaacccaagaccttgctggctggtctccctaaattatgttgattcccagcttcaagtgagacttaacggtgtttggtgatctaacaccacttgatttcccaagcactgtgagatgggtgactctttcgcaatgtttcctttctcctcattccttcactgcgtcttgcatatgttgctctcaattgatgactttgctttccatttcactgagaaaatagaagtcatcagaagagagtgtccatgtattctaaatatatccaatctatgtttgcgtcctgcatgctgtctcagcctctctatcaatgcacactggttcccattcctccttgagacgctaacagcattgttgcagcatctgtcttctgtctctcctgcatcatctatttttccctctgtgctagatcattctcaaccacatacaaatatgccataatactctcctatcttaaaagaatgcactttttgaactccctttccttttagatatcaccttattcttttagttgcttttactataaaacttctctataatgtagtcttatacagtctgtcttcactttcttttctaacaatccaacaaaactttgcttattaaggtctccaatgacctgtatggttatttctcaggccctaacttacttattagcgatatttggcatggttgtcataccctccttcatgaaacccaatcttcatttttcttttgggacacctcactggccactcctttcagtctcatttgctagtttcatctcatcctcctgatgccaaatgttggatttttcccacctcttagttctcacttctcttctctctttttgagagagaagatgatattcttcagtctcttagctttaaatactgtctctgtgttgatagctttcaaattgtttatttatatcccaaaattctgccccgagctttagagtcatatacactctgcttagatatctaatagatatctcatgtataacatgatatctattcatacattcatgtatgttccatacacatttgcctagttgtttccaaatttctcatttctcttcacagcctccttatgtcatcatacctctccagaaacatttcccatcttagtattacatcaaatgcattatttctttgttcaggcccaaagaaaataatacaaagtcactttcaacatctttctttctcctccctcacaatttacctctagtccatctacaaatcccattgactctaatttcaaaatataatcaaaatacagaaccttcactactaccatgccatgctggctcaaactaccattatgtctcccctagtctgtggcagtagcctctcagctgatctccttatttttatccctgttcttctacattctgtccttgacacaagcaaccagagtgatcctgatcaatctgtcatattaagtcacttatctgctccaactttttttttttttatggttttctctatcagaatagaggccaaagctctggaaatagtccataaggcctgaaagatctggcattggtgtgctcatctgctcttctctctcttgctcttgctgcaccagccatgctggccaacttttctgttgcttggacatttcaaacacattcctgacttgagatttgctgttctccctgcctcagatgttcttactctctaaatagcccattcacactaccctagctagtccttcccactttcctacacaattcttcacatcctctcttctcctttatgtactttttgcatcacttgttatcacttactgttttaaaaatttattgatatataatagttgtacatattttgaggatacatgtgatattttgatacatgcatgtaatatgtaatgatcaagtcagggtaattgggatatccatcacctcaaacatttatctgtgtgtgtgtgtgtgtgtgtgtgaattttgggaacattacagatcttctgtttaagatactttgaaatatacaataaagtagcctatggccataccacccgaaatgcacatgatctcatcttactattttctatctcactaaagtacaatatgtgctccctgagaatgggaatttcttttattttctgttgaatcctcagtgcctaaaacagtgctgaaagcaaagttttaaggtcaagattttagatatggtctaaagattctggatttcactatctgcagtattacctggtcaaactgatataattagactttccagtgctaagtggaaaatgaaatcaagtgtattttataaaattttaatataattgttatttgagaagaatataaaggttaatgtgaaaacttaataatatttgtctctcaaatattatgagcatattgctcaaagccgcttgcttaaagaggaacattatagcagcgtagggaaaacttggaagcagcctaaatgaacgcagcaggggctggctccattctttggtatgatcatgtaacggggtagttggcagcctttatagactgcactatcatttttattggcttcatattaatctataattagtttaaataaaccagtcattgtagtgtatatttgatccagtttttctcctttagaaacagtaatggacatccttatacacacttccatacatatttgcatacttgttgtcatattatccttagagcatttagtatttcactattacaaataatacttcagtgaatatccatgctcattcatcattgtcaccaactctacttatttttatagactgtattcctcgatgttggacacttggtaagagggaatacacatttcgagggctctttatacatcttacagaattgctttagagagtatcaatttatctttctttcagatttatattatagtgcctgattcatttcaagcttaaaaacacttggtattaggtttacaaaaaatttaagaagatattaaagattctaaaaatcttttcccaagtagattaggatgtgtacctacacaatttatggtatagtcagttctactataatgcttgttttgaaaacttggacttcttccaagattgatctattagggcacaatttgagtatcttgcaaaatttgcactttcttatatgtgattttatctgcaagcaacactaggtgaatagagaaaactgcacccagctgaaccaacaagtgaaggaatacaaaattcaaatacctaccagttacattaattcacctcttgtttatgagccacacctatgtatatctgattttgcaactttctatctgatttcagataacgttccttctgctacttcactgtaacattgtgatgttttggaacatgtgtgtctcaatacagtaaaactgacttcatgtgatttcaacatatatcataggttacgtctacactgggtattatttctgtgcatttgttaacagcttagataggtagcataggtagctgaatgctattcaatatgcacccctaatcctatctgctttttaattgtgcgtggagaaggcaaatgagaaagcagaaattgaaatggaaaaggaagtgttcagagtagttggtgtaagcaatattggaacacatctgtttgcaaaatatgctttagaggcttggagatgtgttctttcaggcattgctttccatcctgggtacaattgaatccttcagccccttagaaagataaagattagtctgaagctgatatacattttcaaggtagcagggacatgagtatttttcaagcaggtagtagagcaggatccatatcaatccttaaaactctgcaaacatagaattattttcatcagtttcaggcaagagagctgacttctctttacacagagtaaaccattacggggacatcaggaaagaccctttcctcaaagaggcattgtcaactcagtcaatgatgcctaaagagttccatcccacagctagagattaaactgcaagtgaagccatcctggatttcgtttctttgtgttctaatttagattcaggtgcaaatggtgtcaagtccacctaggaaaatttggaggataaatgaactggcaatgtgtagttgaagaagatagcttaaagggaaacaactggaagtaaacatagtcacagaaaatgacatatattgcctacttaacaggaagacagtggtctgacctcttaataaggcacaatgtccacaagtgagggtagacattgaaagaaacagaacctgagatgattttattgttcatggtcatttgtacagcctcgctctgttatccatttgcatctttgcctcttggtcccgcaagagcctctctcataaactttgagtagaagatcataaaaaattgttacttaaaaaaattgaagtcctaaaatttaccagctctgaaggaatataccatactgatatagaaagttcaatgaataggtagcaacagaaataagctttgataaacaaagaaaaccaaatgatgctatctgaaagcccggtctttgaaatcaggtggacttggcctcattctcacattccatttatgggttcacaacgtggaggatgtcactcagctgtcacgagactcacttcttctgtaaaagcacaactgatgaaaacacttgaaaggatttttttttaaatattgaatgagataaaatactgtgaaaatgttctataatgtttgacattggaaagggtaggaaatgaaggttaacagaagagtaaaaataagcaaatgaaaaaacgtaagaacattatgtcaaagctctacctttggaaatagatctcaccctagagatggacagatgatacagtctcaaatgcaaaaccaacaggtacatttgagattattaccaatatttagcgctgttatcttttgatttattcatgtattcatttagccctcaacaaatactgagtaactatttataagacattaagctaggttccagagataaagcaagagaccagtccctaaacttacttgtacagtaaattagaacagggaattctgtttgatatttgataccttagaattctgactattactggcaataataatacatatgtaataattactattgtgttagattgggctgctgtaataaaatatcataaacggagtggcttaaacaacagacgtttatttcccagagacagcactattcttatcatcgcctaccctcaggacctaatctaaacctacttacctcacaaaaggcatacctccaaataccattactttggaagttagggcttcaacacgcaaagtttaggagtacatattcagcccctaacacctatacactatcattaaggtagaagctccgcagaactttctctctcttatcctcaaaatcatctcctttagatagctattagtatcctcactttacagatgaaagctgagacccagaataggtgaattcattgcccccaaattccatgaccactaagtgtttataaatcagaatgaattaattggccaaaaattccatagccactaagtggcaggagcagatattgagacacaggcttgtctgtgattactcagcctgggctcttttaacactgtgccttttaataccattagagtagtattcacagaatatcattcagataggatgacagaggatggtcaattggtgaagccaggactattccttggattagtagaaatgcattaaaaaaaaaaaactcaaacatgtaagggaaggacacttgacattagaaaagatgaaatttctggagacacaattgtgtgtcacctaatcagctgtcacatcagggaaaaaatatcttggagaaatgttgaggtcgccaaacccagggagctttttaactgattcatttcatcttgcatgcatcccaatagttttagaagctgctggatagatttattacacaaagtctgtgtctctagctttcagcaatgtgggatttctttttctcagagcccactgatcaaaccctgcattcacacgtttactgatgtgtcatattttaacatccaggtctctgcacaatgccaagattatgcagttctatggagttaacttagaaattttgtcctcacacagtattctatagttgttaattttccatgcaaatgaaaacatttatataatttctgctgtttttatgtggtctcataaaatgtgaattacaaaactccatctttgaatttcctgtgctgctccactttcattctctgtaaggaatatttgccagaggaaggtctatgttgtactttcgtagccaactagaatgttaaaaggattggagaggagatttactgcatatttgtgattattgttttttgggagtgagctgaggtcccaaaccacctattccaagcccatgctgtggcagaggttggaaagaggcttcttgactctacttgtcctctagccaagagggaggctctccctagcatgacccttaggcctcacctccacatctctctgtctctggcataggttattggtcattatgtcacctctttcttggtaggaccccagagaatttcacatcctaatcacaagggatataaaaactgtcaagttctatggatccttttcacttttccttcatgttttaatgtagttgttcctcttctgtaatagcaatgatcacaccatataggtattaaaaatatgttccttctttttcctactggaatgtccattccttgagggcatatctattgtctgtgcagctgcagtgcccaacacaatgcctaacatgtgggtgctcagtgggtgtttgctaaattaatttaaactgtattgcccttagtaatggcagtcggagtagaaacagcaaaataaataggtattacagaggctgaatgtcaaagcttgacactgattaaatgcagggtgtgaaaaaaagaaaaagtcaagtgtgaaaaatatagataacaaactgagtgacatggatagaatgcagaaattcttctgataaaataaaaatagtagctaaaatttattgaacagttactatgtgctaggcactgtgctatgtgctttgcatgtattctctctttaaatcccaacccaataacctgttttactaatgagagactaatcaaaatgccaagtaattgataatgccaggatttggagtaagccctatttctctgtattctgtaaaaccagaatttctcaaagtgtgatttaggagctacataaaccgaaaagcatatggaagtggtggttaaaatgtgtattcctgagtttcatctcaaacctgtcactgaatcagaagctctgggtgtgaatccaaggattctgcatgtttaaaacacgccaagcaagtctgttgtcagctaaatctttagaagtagtggatttaattagatttagtaaacttttatgaagcttctataagattgcagaatttggcccaggcgtgggagttataggaatacacataattcctttccccaagaactattgaattaataggaaaaaacaaaccatcatagcacactgtaataagtacttgagtagctttgggatctggcaaactaatcaaggaacgagtaactctggacatgagcaaatttgaagtgagaaaggagacagagtctgaaaaacccaccagggagctgcaaatgtggaaccactgagacaggtcaggattgaatataatggtcatccatgtagagataaaagttgaagggtgcaggcagtaagaatgccaaggataagatttgaaaataagaggatcaatagattgcaaaaaatttcttccattgtgtaggttgcctgttcactctgattatagcttcttttgctgtgcagaagctctttagtttaattagatcccatgtattaatcttggattttgttgcaattgcttttggtgttttagtcataaagtctttgcccgtgcctaggttttcttttagggtttttattgttttaggtcttacgtttaagtctttaatccgacttgaattaatttttgtataagatgtaaggaaggggtccagtttcagttttctgcatatggctagccagttttcccaaaaccacttattaaataggggatcatttccccattgcttgtttttgtcagatttgtcaaagatcagatggttgtagatgtggtgttatttctgaagcctctgttttaaagttccatctgtttatatatctgttttggtaccagtaccatgctgttttggttactgtagccttgtagtatagtttgaagtcaggtagcatgatgcctccagctttgttcttttttcttaggattgtcttggctatccaggttttttttggttccataagaaattaaaagtagtttttttctaattctttgaagaaagccaatggtagcttgatgggaatagtattaaatctgtaattactttgggcagtatggccatttttatgatattgagtctttctatccatgagcatggactatttttccatttgtttgtatcctgtctgatttccttcagcagtggttggtagttctccttgaagaggtccttcacatcctttgtaagttgtattcctagttgtattttattctctttgtagcatttgtgaatcggagtttgttcatgatttggctgtctactatttgtgtataggaatgcttgtgatttttccacattgattttgtatcctgagactttcccgaagttgcttatcagctttaggggttttggggctgagatgagattttctaaatatataatcatgtcatctgcaaacagagataatttgactcctctcttcctacttatataccctttatttctttttcttgccagattgtcctgaccagaacttccaatactgtgttgaacgggagtggtgagagagggcctccttgtcttgtgctggttttcaaagagaatgcttccagcttttgcccattcagtatgatattggctgtgggtttgtcataaatagatcttattattttgagatatgttccatcaatacctagtttattgagtgtttttagcatgaaggggtgttgaattttatcaaaggccttttcagcatctattgagataatcatgtggtttttgttattggttctgtttatgtgatggattatgcttattgatttgcatatgttgaaccagccttgcatcccaggtatgaattcaacttgatcatggtggataagctttttgatgtgctgctggattcagtttgccagtattttattgaggattttcacatcgatgttcgtcaggcatattggcctgaaattttctctttttgttgtatctctgccaggttttggtatcaggatgatgctggcctcataaaatgagttagggaggagtccctctttttctattgtttggaatagtttcagagagctaatatccagaatctacaaagaacttaagcaaatttacaagaaaaaaaaaccctctcaaaaagtgggcgaagtatatgaacagacacttttcaaaagaagacatttatgcagccaacaaacacatgaagaaaagcccatcatctctggtcattacagaaatgcaaatcaaaactaaaatgagatactatctcatgccagttagaatggtgatcattaaaaagtcaggaaacaacatatgctggagaagatgtggagaaatagggacacttttacactgttggtgggagtgtaaattagttcaaccattgttgaagacagtgtggggattcttcaaggatctagaattagaaataccatttgacccagcaacccagcaattccattactgggcatatacccaaaggattataaatcattcttctataaagacatatgcacacgtatgtttattgcagcagtattcacaatagcaaagacttggaaccaacccaaatgtccatcaatgttagactggataaaaaaaatgtggcacatatacaccatggaatactatgcctccgtaaaaaagaatgagttcatgccctttacaaggacatggatgaagctggaaaccatcattctcaccaaactaacccaagaacagaaaaccaaacagcgcatgttctcctaagtgggagttgaacaaagagaacacatgaacacagggaggggaatatcacacagtggggcctgctgggggttggggggcaaggggagagataacattaggagaaatacctaatgtagatgacatgttgatgggtgcagcaaaccaccatggcacatgtatacctatgtaacaaaccacattctgcacatatatcccagaacttaaaatataatgaaaaattaaataattaaaaacaagaggaccaggaagaaatccttggagattacttctcatctgacattttattctccaaagcctagttccctgaataagcaaaccaccataagcaattaaattgcccttttaaacggccaagaacttcagatcactttatgagttttctttgccaaaggagagttttggaagtcatttggttaacatgttacatttcaaagatgactttaagagggaaatgtgacatcactgaatggcaaagttgtgttttagatagtttcttcctaaagtgtatgctttaacaatctcattactctgagttagatacttttgcactatgaaatcctagtaaactattaattctgtggataaataaaaacctagccctgctatcctcacacaccacactcactattctgtgatgccatttaactcttccattaaagtactgttactgtgcctgtgaatgccaagaaaaaagaaggatcaatttaaattgcctaaaaatgctagaatgtatttccctagatctaatgggtaatggcactgacagcttcaaatatgtttcataaagagttcgatattactgttcttgcctactaatatccggattattgaagaattaataaggaggtattacctttgagaacaagaaacatatcttctcctttcaaagggacaataacaagatagtctgctgggaagcatcttcaaaacatgaaagaagagaatttggagtcagtgccattttgccttccatgtttgcttgatgtataaagcaaaggcaagatagtctcttttttggtttggaaaaaagagaaaaatgaatatttccttgttcaggaatcatgaagtgactgcacaggccattgaaatgctttgataacttgcatagtatgtatttttaaatgtagtttggtagaagagaaatgccactgattgaaattcaggaagcttgagttctagtattgctgctgatatatatgaactgtgtgatgccgtagaaataagccatttacccttaactttttagtacataaaatataaggcatggactagatatctaagactctttatagctcccagttgattaatcaaattagcatttactcagggctcattactttaggatataaagtaataaatacttaagtagggttctcttctcaaagtacttacagcctacatttctgccccacctgaaattcaggcttactaagaaagaaaaaataaccagacagaaaacaactccttaagtaactcataacttgacttctaaattaataaatttatttttcttttcacaatgcagaaaatttgtaccagctttaaaaatatgcatgcaatagtagaaagagtattcatatttcaggttacatttttgttaaaggcatgtcaacgagtgcaaaaacattcaagggcataagtatggctatagaatatagatgtttatagctatatatatgtatgcatgattcacaaagtcttgtgttgattaatgtgactgcttatgtttgacatatgaacagatataaaatgtatatacagaaacaaacaaggtaaatatgaatgataagtatgaaaatataccagggatattttagaagcttctgagaagcacatgttttttaatcagaatcaatggatggattataagctttctaacaagctttcctttaattgatgaataatatggtaagtacaattatgcaaatactttagagaatgagaaggtatagaaaggattctgtaaaactggaagaattacataaaacatttcctcaagcttttctttccaaccctttccaatgagattttaagcataagaggatttcagtctgaaatgcaaggacaaaaatgtaagattacagcaattcttagttagccttacttttggcccttgtagttcatggatatagaggagaggaagaagtgtttccttgaggcttgaagagtattagtcacaggagaagatgtttagggttacaaattattttgtgtctgagttgactgccttatcccaaatgacaaaggtggccatctatagcttaatacacacatgtgcacatacatacaggcacacacacacatacatatgctgcatatgtttatttacaatatgcaaggtcctctaaagtgcaagaccgatggcagggatttaagagtagaaatcttaatagtcaatgaaaatccctagacttcttttgatttgccctgctgttaaacatgcactagatttcgctattttgtaaaagtctaatgtatgcctttgtcatttcccattaatacattccattttaaagttcgatgagagttcttcccgactaaaataaactttttgaaatagaaatgttttattccgaattaccactatgaattacacatgaattttataatcattcctccttggcttttaaatattcagcaaatggtcaaagactgttttcatcgactgggcaggaaaccattcaagtttgtagatggctcatgtggtgagattttatgaatctaacctgtccgtttcacacatacaaatgctttttccatgatttttgaaatcctcacttataaagcagtgaaattactatgaactctcgtgttatcttcaggtagataactaaacactcttttggccaaaatataggaatgaaaagacaaatagagtctcaaagctggaatataatcgatgctggaattagactttcaccaagtaatcctaaaaatacatcatagtaagtgttgatttgaaagaaatactgtcatttctcaataaggtgttgaactaattacccttaaactgcctttgagtcactttctgtgattttcatgagatggtaatgttggtatatattgttttaagcaatgcattaatgcttgccaaatattaagtgaaaaaataaaaagcaaagtgaaaattttatctattctttcaagatcaaccttatgtgaattgttcaagctgaatagcattgaactacccatacatacttccatgttagactcagaattttaaaactggaaaaaaaaaagcctgcagataatttactttttttagcagcagaaaatgttctgatagaactttatattaatgtggaaggtcagtatatagaagagatcaacataacactaatttgctggaaagtgttaaaaagttgggaaaggcaatacaagaaccactccacctacagtaacacttgaaggaattccacataacttgaaaacacagattacagttcaaacttctcaatttacaaagtaagaaactgaagtcaagaaaagttcagtgacttgacacagtaatgtttgagtttgcaaacatgagaagttacagaaggtattctggaccttctagatcttcaaaataggaaaccgaaatccaggacagttcagtgacttactctaaagagtccgtgactctctctacaacacagccagagctgggagtcagagctcctgtctttcatttttttaatgcagtggcttttcccaggtcttcctgtgtttgttctcctttcaccgaatttgaggtagaaaacattctgttgttcttttctccacatgatctccctgaagggtttatatgcttgtcaccagcaactacagtttctctgaattgttttcaagccccagtggacaaatatgataaaaagaaaaggaaggtaaatatgtttatcaactatttataactcatgtgctgtttacacaagctcttacaatttccaatgaattctcctactccttaaggctatcctggtgagccatccctgcaggtaggatatatatatatatatatatatatatatatatatatatatatatatatatataattttatatatatatatataattttatatatatataattttatatatataataatatgaaatacatattatacataaaataatatatactttatatattatataaaatatgttatatattttatgtattatatattttacatatatatatatatatatatatatatatatatataccatttttgctattgaggaatcttttttttattaaactgagaagtcatatatacttgcgtgtctggaaatacatctgtaataactgaccctacccttcgttgccttcaattgtaaaatcatatttgttaatggatttcactttgcaagtctcaagcttttacacagacatattgctttttttcagctcatcacaaagcctatagagataggaacctattgctttaattacagcagagagataatctttacctctctgaggcatagtccaggtaacagacgcctggagtctgcttaccactaaagactttgtgaccttgggcaatgtacttaacctctctacgccttatttttctcttgtgaaaaatgaacatgggactaatacataattgaatacatgaatggatagatctactattttcttttgtgttttccttcgagatgtgtgtgtgtgtgtgtgtgtgtgtgtgtatagtttatgtatttaaaattgtttttaatgttataataatatgccagccactcttagcttgctcatttataattaggaaaatgacatttccccacactattaaaggcatatttttaaaatctttgtttaaatagcctttttcttttgagttatgttttgagaatactgagtctctatttgttgatgttttaagcctttattttaggttcaggggtacatgtgcaggtttgttatgtaggtaaactgcatcacaggagtttgttttacaggttatttcatcacccaggttataaggacagtacccaataggtatttttttttttctgatcttctcccttctcccaccctccactcagaaaaaggcccaagcgtctgtggttccgttttttctgtccatgtgttcttgttgtttagctcccgcttataagtgagaacatgtggtatttggttttctgtttctgcgttagtttgctaaggatgatggccttcgactccatccacgttgctttagaggacatgatctcattattttatggctgtgtaatactccatggtttgtgtgtgtgtgtgtgtgtgtgtgtgtgtgtgtgtgtatacatatatacacacacatatatatgcatatgtgtatatgtatgtgtgtgtatatatatacgtatatacatacatgtataaaaaatgtgatatatgataaagaaaatgtgatatatatatacacattcttttatatatgtatatatgatatatatatatacctattcttttggatatatactcaatgatgggattgctaagtcaaacggcaattctcttttcagctctttgaggaatcttcataatggctgaactaatttacatttccaccagcagggtataaggattttcttctctccacaacctcaccagcacctgttattttttgactttttaataatagtcattctgattagtgtgagatggtatctcattgcggttttgatttgcatttctctaatgattagtgatattgagcattttttcatattcttgttgactgtatgtatgtcttcttttgaacagtgtcttttcaagtcctttgcctagtttttaatggggttgtttagtattttttttgtaaatttaagttcattatagattctggatattatgcctttgtcagatattatgcctttgtcaaatattttatcccattctgtaggctgtctgttcattctcttgatagtttcttttcatgcagaggctctttagtttaattaggttccatttctcaatttttgtttctattgcaattgtttttggcttcttcatcctgaaatctttgccaggtcctatgtttagaatggtatttcctagcctatcttccaaggtttttaaatagttttaggtttaatatttaagtctttaatccatcttgagttgatttttgtatatagcttcaggaaggggtccagtttcaatcttctgcatatggctaggcagttattccaggaccatttattaaatagggagtcttttcccctttgcttgtcatgttgttttgtagtagtagtaactggtggtaagtatgcagcattatttctgggctctctattctattttatttgtctaagtgtctgcttttgtaccagtaccatgctgctgtggttactgtagccttgtagtatagttagaaattgggtaatgtgatgcctccagcttcgttctttctgcttaggattaccttggctatttaggctctttttcttttttggttccatgtaaattttaaaatagtttttttttctaagtctgtgaaaaatatgattagtagtttgatagaaatagcattgagtctataaattgctttgcgcaatgtactagtcagggttctctagagggacgaaatgaataggtcagacgtatatatgaaagggagttaattaaaaataactgactcacatgatcactaggtgaagtcccacaataggccatctgcaaattgaggagcaaggaaaccagcagtggctcattccgagtccagaaacctcaaaagtagggaaaccaactttgtagccttcagtctgtggccaaaggcctgagagcgcctggcaaattactggtgtaagttcaagagtgaaaaagctgaaaaacttagagtctgatgttcaagggcaggaagcatccagcacaggagaaagatgaaggccagaagactcagcaagtcagcttcttccaccttcttctgcctgctttatctagccacgctggcagcagagtggatggtgcccacccccattgtggatgggtcttcctgagggtgggtcttcctctcccagtacactgactcaaatgttaatttcttctgttaacacccagaaacacccagatacacccggaaacaatattttttgcatccttcaatccaatcaagttgacacttatccatcgtgggcaatatggccattttaatgatactgattcttcctatccgtgaccatggaatgttttccatttttttgtgtcatatttaatttctttcagcagcgatttgtaattcttgttgtagagatctttcaccttcctggttaggtgtattcctaggaattttattctttttgtggcaattctgaatgggattgtgttcctaatttgactctcggcctggatgttgttggtatataggaatactactgatttttgtacattgattttgtatcttgaaactttgctgaagttgtttatcagatcaaggagcttttggacagagacgttggggttctctaaatatagaatcatgttatccacaaatagggacagcttgaattcttctcttcctatttggatacattttattttatccttctacccgattgctccagccaggacctccagtactatgttgaataggaatggcttggaaattttttaaatgcaaaaaggaaaagagatatatctatacttgcataaccattgaacactttcaccttggcatgtttacttccagaggcagttttccaaaaaaacaaaaactttcagaccaggtatagtggcttatgcctgtaatttcagcactttaggaggctgaggcaggaggactgcttgagcccagaagttcaagacaaacttgtgcaacatagtagatgccatctctaaaacaaaataaatacatttgccaagcatggtggcgtgcgcctgtaatctcagctactcaggagagtgacatgggaggagcacttgagcctgggaggtcgaggctgcagtgagccatgattataccattgcactccagcctgggcaatggagagacattgtgtctaaataaataaatacatacatgttcatgtttttattcaagggcataattgatgaagtccctgctgaaaaagaacatctctcatagcagatttaccttctcattcctcctctcatttgcccacctttggatctttagtatctaaagtatttgtttcaccctgttcaggtttataatgatggaattcttttcagtaaccattatttccattgtgtttacttttatttctatatataaccatattcaaaacataccaccaattattttactacaatgcctaactgggtggctgatgttcttaattgcttagattttgttgttaggtttattctagaaagtgctgtatttcctgagcacttttcataattgacaaagtggatttgtatataaaagattctgtataatattcttgggtaacattactccattgtattctgatattggatattatcatatggaaatctgattccctttcacttcttgtagatgtgttttgattttggtttttctttctggatgttcaaataatttactcttcatcttatatcttatatatctttacgcctcatcttgtatcttaaataagatatatctctatcttttgagatttatgtactcagtttcccggaaacacagtctttcaatctgaaaatttattttcccagaaaagtatcctattctttaactttgaatatatattctgtcccatttgtgggcttatggcatcaggaatgccagttattttaatactgcatcatctttctttgtactctttttttttgtacaaactcagccctaattactttaattccttcacccttctcatttacattcactctgatgatatcgagtctgatacatgttggtaatttgatatttggtggcatctattatgagacttgtactttctaatttatgtattagttatataatgatgttgttttggtccttgattcatttccttaggtccactaactcccttttcatttaattctgttgttttatcctccagtctttgacctctagctctattgaatttattttcattttaaatgaatccattgtgtgaagcaacttgaaaaatttctttgtgtctctaccctatattttcttctggattaagttctttgtttcttaaattaaatctctctcttctcttcctccctccccatcccccctttttctttcactcttttgcattattgttggctgtattatgtttctatatttactatgcctgtcttttatcttgatcatgtgggagtggcactgtccagacattctacttgctctaatgtagtataggttacttctagacttacttgtcatccttcttgggatcccttaagctccagtttgaagtctggatgtttcacgttttgtgtacttttaaataaccaggcatggtaggggaatgagtttagttgaagcagcattcaaactcatttaggatacctagctttgctggctagtactgtctcctactcttgtttgtgggagaaggggctgttctcaagtttccaattagctgttcatttcattgatggtccataagccttaccttactcaaaccaacctccatcccctgtgtgtctcctcaacagtaattgcaacttcttctcaatcagaaaaggaaatgccaggcacgatggctcatgcctaatcccagcactttgggaggctgaggtgcgaagatcacttgaggtcaggagtttgagaccagcttggccaatgtggcaaaaccgtgtctccactaaaaatacaaaaattagtagagcgtgatggtgtgcacctgtaatcccagctactcggaaggctgaggcaggagaagcacttgaacctgggaggtggaggttgtagtgagccgagatcgaaccactgcactccagcctgggcaacagagcaagactccatctcaaacaaaatcaaaaacaaacaaacaaacaaaacaaaacaacagaaaagaaaaggaaaacttggggctattcataattttgcattcattgatgttcggcggtgttagtgagaattcttagactttcccccaaatttcaggaaaatttctggggtttaagggaagataagaaagtaaatcctttttctgttttactccagaaacacttgttttgattttgttgtttttatttgctattgctatgctttcttttcattctttgactgctgtgggtgatttttatgtgtcgatgtatatactaggatttactttttatttcattaggaattaagagagggaaattcagttatgtgttataatctaccattccctcatagaaaatctactaataagaaatgggaaaaacaaattttctattatgttttagtgtacttctgtaatgcagttaaaaagacagagaaatagttctcatgcatgacagaaacatttattctacgcttttagaatagccacatcttttcctctcaaataccaacagggaatactagaaaatatttgactgaggaaaaataatagctctcaaatttctgtcagtatgcattgtttgggaacaggataatttattttggatatttattatttgtggcatcaaacaacacacatgatttaacacttaaatcttgttttccttaacatggtctcatttagttcacagctaaaacagaaaattcgacaaagaaagacgtttatcaattgtatatgtatggatatatatttgtgtgagtctatgtgtgtgcaggacactttattctgtgtgatcatatattttatatagaagaagagtggtccctcagtatttgtgggggataggatctaggtctaggatctcctgcagataccataatctgtgaatgctcaaattcctgatatataatgttgtaatatttgcatataacctacgtcaatcctcccatatattttaaatcatctctagattactcatacttaatgcagtgtaaatgctgtgtaaatagttattaagctgcatttacatattttattttttatagttgtattgttatttttttatctgcagtcggttgaatccttgactgtagaacccacagatatatatgaaggaccagctatataaaatcttaattctcattagagaatgtataaaattatctcatatgagaatatatatataaatataaatatgtgtgtatatgtaggctcacacacacacgcaagcttaattgttggagagttgccaataactatcaaaagccatcaatagcacatgaattatttccagccactatattaacaaaagcgtagcaataatgtcagtaagtatatagaatttggacccagagataatcctcccattattattatcacaggcttgaacctcacaaaattgtgctctcagtttgatcctaggctccacaattagagagatggaaagcttagtctggatttagaaagaagcaactctgattacaggaagagctggaactaaggaagggcaatgggattatttgtctggctaaagaaaattgtgtggagagatctagaatcgtttcctagcatatatgaaggacactaaatgttcttcattcccacagcacatacagctgaatttttagatagaagtgtttctcagcaaattgtgctcacgagaagtatactattagggtttgaaaataaaattcaaaggtctaacattttatttctctaggattattaaaatattgtcattgccaatgatagcagaatagcttactatttgtcctaatattctataggtgcaattggtatgaactttagaataaaagaatccccttatatcttaaatgttgttccccgcttagattttccaaagcgattactcatctgcagccagaagatgactgattgccaagggatttgccgttgaggactgaactacacttatgcctggtcatctataaatatttatgaagcacctatcccatgcttggccttggggacacaaagataaataagacaatccatgttcttaaggcgttagtagcttagtgaattcatatccagattgatgccacaatgggatgaattgctgtagaaccaactgcttttctgtcatgtggttttcagtaataatatatttactttcatttgagaaaacatgtataaaagtaaatatcccacttgggcttacacctgtgtcaggaaaaaagttaatacatattccagaaattgtcagagcacccaagcacattcccctcatcatggaaataatcactgccagatgagattgaaacatcttttggaatagaaaatgcttagaatgaaatccataccttgaaatccatttttctagtacagtagaagggccattcattattaatagaatgtaacttaagtatgcttttatttccaacgtgtaatacattctactctcttaaggctagaaaccaacttaacctaaatgtttagacagtatagtcaggtatgtgtgagagacactcgtatggagaatcaaatgcaaatctcaacaaccaatcctatgagagagtacagatatgtaggtaggagaaagtaaactagagagaaatattaagcagacttcaagtcacttgtcacgtaagaaaaggccgggagagaagctctgaataggacagaagatgcatcatcacagcaccttccttaaaaaagaggggaaggaaggagtatgcatttaaagatcaagttagccaaatacaagttactttggcaacaaaagttggtgcaggaagaatagaaactatcgggttgcatttctcatctcacacttgacaagtctcttagaaataccgttacctagaatgagaattttgttaaggtatgtttaacatggaagcttgtatttataaagaatatttttcctcttaggtgtattagtccattctcacactgctataaaggtactacctgagactgagtaacttataaagaaaagaatgtttaattgactcagttctgcatggctggggaagcctttggaatctcacaatcacggcgaaaggcaaaggggaagttagatacatgtcttcacaaagcggcaggagacaggaagtgccacagtttaaaaccatcagctctcctgagaactcactatcatgagaacagcatgggggaactgcccctatgatccagtcatctcccaccagatccctttctcaacacacggggattacaattcgagatgagatttgggtgggcacacagagctaaaccacaccaatatgttatctccaaacctgcattcaatgccagatggcttccttcgtagtaatctgaatgtggttgcatgtgaaacaatggctccttaaagtgaaattatctgtttatactattttgatactgcacttgaaataacccatttgttttggatttagaggtagcccaatttggcagcaaactcatcctagacatttggtgtgattagtcttttcaaatatatgcattccagagaagattaatggccttattatgtccagtatttcaacaaaaatgaacaaatgaagtccaaaggcacatggctccagggaaactagctggctttccactgttctcagggcagaatcacagccactcaaagattatggttatttttttttctcctaataaaatctgttcatcaatctggttttttactcagtttgtgttgttcagtcaccagagtggtttgtgctgcctattgttaatttaaaccaactgcatggttttaaaaatgcattctttgtcatttcaaagagctgtggtaattctttggaatatagtgttttcaaagttcagataatgcagagaatactatatatattacagtgatattttaaaattgacccatatttattacatacctaagtaactggaaaagaatagctgaatagctaagtaacttctaaaagtaaaaaaaaaaaaaaaaaaaaaaaagcaagtcttcacctatatggggtgttgctgaaaatacttatgggcatttattatgcgaaataaaacccataatactatttaagctgttgatgatgactttgtttggagctcaaatcacagaagaaatttcattgtacagaattcaaatgggtagtcatggcatagaaacgtttaaaaagaaaaacagataaatttaaagaaaacttttacccaaatttaaggtttgcctgtacaactcttaacaattgcagtctggaagtctcccttatgtattatacctttctaaatatgataaacacttttaaaaaacagaattatattttttctacatttctatcacttattagttttggttgggattccttgtctcagccccccataaaaatgattctttatgtatatactagaagtacttgcaaaggtcctaggaaacccagatctgatggaaatgtggacaatttatttctggccatggattttattttattccagagaaggaaagtacaactgaaatcaatatcttgcctgaaattcttgaaacattgtacatgtgtatgaagcttttctctgaaatggactaatactatgtaaatggaacaatttgataaacttaaaaattcatggtacttttattagtcattaggaaattgctgccaaccaaaaagcctaaagtagtgaaatgagtccttccacagaagtgggagaaagcgtaatgtgcaaagggatttaaaaaacaaacaaacatatgcttcaggctccatctttaagaaccttaatctggttggtaaatagtgatatatgtgaaagataacttatataataagtagtgtaaaagttgaccacagagatagaccactgcaagaagcagaagaaagctactctcagcttcatggaacgttatggaaaagggatatgtgagctgcttcttggagaataaatagaacatataacatctgaggaatgcaattccagacagaaatccatggccagaaatgtgctgaagaaatatatccatggccattgatgaatcatattcactctttagtcagtttttctatctgtaaaataaaacaattatattaaatcatcctaaagagccattttaactattatatcctgttttaatagcaagtagaattagtttaagtagattaaatgatttctacagaaaaggaatgagaaaaaataagatttgagcagggaagtttttaacctctgagttattaaatataaagttacaagcttggtctttattctgtggacattgaaagctcattgacaacattttgagaacagaagtggtataatgaaagttttctcataattttttaaaatggtacttcccattaccctttaattagagatgactttatcaatttgtgttgagaatataggactccagagctgtgaatagtataacatgattatactttgatcctaaattctaggaagcaatcccaaaatgggacaaatagatcccagatcctagtctgatcatcactgagaaaaaaacagagatcaaaaaagggaaaattgggtaaactttatttgtctgctgccttgcagaatagtgtaatcatcaaaaatatattcagttacatattgatttcatgttagcctgatagagccacttccactgagaagtcacatactagtgtcaagataaagcacatgcacaaataaatacagtgcagaagaaaccaagtcttaaaataaataccacagggtttccaaaaggagagaaaatttttcaagaaaaaatcaggacatccttcttggagaagtagcctcatgaaggataggtagggtgtctgtattagtccattctcatgctgctgataaatacatacctgagactgggcaatttataaaggaaagaggtttaattgactcacagttcagcatggctggggaggcctcaggaaacttacagtcttggtggaaggggaggcaaacatgtctttgttcacatggtggcagcaaggagaagtgtggagccaaagggggaaaagcctcttataaaaccatcagatcttgtgagaactcgctcactatcatgagaacagcacgagggtaactgtctccatgattaaattacctcctactggttccctcccatgacatgtgaagattatgggaactataattcaagatgagatttgggtggagacgtagccaaactgtatcagtgtatatattatagagtgaaacagtaaacatttcagggtgagaaaatagaatttacaaagacttagaattagaaaagggtcatttgtttcattgagccatggggtatatgtaagtcacgtgtggatgataagtttaacaagtaagcagtaatttggtcatgtattatttaaaagaaaggcagaagagctttaacctaattcctaatccaacccaagcctgtatgtttagacctttttaagaccctctcccatgttatgtaagtattttaattccttttgctcagcgaacttggaagatatgctttaatatttctgaaaagtattctaaaataatcaatacccgttattttctctaaatagtcatggtacctcattcttcactctttattttttcttatcattaattgacttttttatgacaagaaaataatattattttgtagatatatcatttccatggcattatccgaacttcttctactcatcttctaccaatattgccacagcaaaggatgaaaatatgcattttgttgcttgagttttttattggcatcagtagcaaatctttgttgagcatgtactaaggatgaggcattgtactaggcattgagatatggagaaaaatccttagcccttgtctttatgatatagtccactgatgactgataacactgcctaatagacagtatatttcagaaaacatgagacttagactcattttttttttttaagacagagccttgctctgtcacccaggctggagagcagtggcacaatagcggctcactgcaaactctacctcccagattcaagcgattctcatgcctcagcctcccaaatacctgggattacaggcatgtgccaccacacctggcttatttttatttgttgctgttgttgttgttgttgttgctgctgtttagtagagatggggtttcactatgttggccaggctggtcttgaactcctggcctctagggatctgcccacctctgcttcccaaagtgtggctgagccacagtacctggttagacttagactcatttctgattcacaatattgctgtttggtacttcaactccccatttaagtgagaaaagttattttttcccttgcctgctgtctgatatactgtgaaagttagagaatctgaatagaaataaagatatcaagatagccagagaagacaaggtgtccagtgtgatgacggaagcctaagaaatatgagaaaattacaaaatatagattagaactcacatatacgtttgtaatcaggaaataattgttgaggcatccctgtggtacttaacaatattacaactataataatacggctaaatcagattattttccccttggttaatcagaaatcactctattttattaatcaatgtaagagaaggttttagggattcactacgtgatcagctttgctttatttagttccattgagagataataaacaggaaaatgagtcctacaaccccaagttggaaaaacagtgaatctgtgtgaaactgttagaaaacagcaatcacttaaactcaatcatttgttttttgagaaattctgttatgtagagcacactatttttgacattgagaatatagaaaactactctaattggagaataaggaaataacaaaattgaaaaaaagcaagaggctacatacatacacataaacagacataccacatttatgtattttagtatagttacatacaataattatgtttgctaccagtgatgtattgtaatatatttttgcatttattttatttatcatgcaattatgcactgttatttgcaaacattaactgtcattattctcaattcttatctcgaggttatagatgaggatagtaacagaggcactcgcagtgagagaaggacttgagatttaaatccagcccaatctggctccattatttgggctcttgaaacttctcttttctcttcttcaatataaatttggtgttctcttctctccctttctcttctccctctatattcctaatcctttctattcctactctctctttctctctctgtgtgtgtgtttgtatacatacgtaaacgtatatatttaaattttagtctcaacccagtcaattgatttcaagttctaatggatgtgacccaaattttgaaaaactctaatgtagacataatgatttcagaaacagaaaggatggatagattcaggtaacttttatggtaccaggaaagaagaacttaaataataaagggaaaggagggttagaaaggtgattttatttaatgactctaattgcttatcacaattatctctcaggctctggaagtattattgcagtatctttctgccagaagtttcaagtggcaaaagagacagttatagcaaatcactttagtacataggcagggaatcagactgtctggcttcataatttacaagctgtgtaatttggggaaagttatttaaacaccttgtacttcaatctctccatttgtaaagtggggataatagaacctgcttcaggtagtgggagagataataataaatataaagggcttaggataataaactctgcattgtcagctctcaataaatgtttggcattgggtattaaatgaacccttgaccaaagtctttgggaaaacagacagcagaatggaactgtttccatatattcaactaatacttctgctcagaggtattcaagtaatatttctgatatcttttggtttattgtcagtgaatttgactaaggaatcaaaaaagccttatactaatatcatcaataattaataaataattttagccaagttgtttagaggtccaaatattatttagttactaatcagggaaataataaagaaagagagagatcattcagtaggaaaaatcaggacttaaatcctgagagtttttaccagctcttttatttttctagaaggcaatggccatcaaagattggacattagctttggtgtcaggagaaagtttttctgatggctgttagaaagagcaaaatacagcagctacttaggcaaaaaattagcactcatcactcactgagcataacaaaaatgacaaaaacacagtctacctttggtaatggctactaaaaatacctatccattttctatgtgaaacagatcacggctgctacttcactgtgaatttaatctggcttctcagtcaatataatatttaaatctgatgtcactcttaagtttccccacagaagagaataaacattaatttttagaatttctttctcctaggcaaggttttgtgggctaagcctgagccaagtcattagcaaagatgtgttatatttataattttcattcaattgcaaatttccatcatagagtaactagtgttacgataattaagaaatggaattaaattagtatatcacatgccatgctgtgaaaattataatacagtatagtaatacactacagtagataattgctaagacaataagaatgtggccacagtaaagatgatataggcattgtgtagttccctatcaccatagccagtttcaacagaaaatgagtccatcacattaatcctaatgaaactctagaattacaggacaactgagctttcttatcttatcctctgggttgtctcagttccaccagcttccctttctttactttatcagaatagtttccaaagacttatgtacttttcagtgtgtaagtcaattgggtacataacacatggatattcagaatgtttattatgtatgttttttttttccaaaaagtgtttccttttttctttccttgtggcagaacaccactaactgcaactgtttaactgcatttgggggaacaaaagatttgttttataatagttcctgtataataagctaagagcttagggaatgatttgaattataaatattttctatcccagagcagtgttttaaactcagtgaagacctcagcagcatgcaagttcacatccccacccactcactcacttttttttttctgtctttgcagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtggtaattattttgtttcatatttgttttataatcccattcattgttttctatttttttcacttgtttttatttcttgaaaaaaaaaaaggttcctgttggagattttttgtgatgtgttaaaaaagttattcaaataaagcaaatgattttctagacataagaatatttgaactgagaaagagtgatcaaagaattcagccccctggttttacagacaagactttaaaacatacaaacaaacaaaaataaatgaaatacagacagcctaagtatttctgagtagtttcacagtttcactgctggtttatcaaagagagtttagaacctagttctagacttaagccaagaatcccttacttctttgacttttacccattttaatacagttttataagatatgatacttatgattatggaagtcttcacttggtaatacagacagcttttttttcctaccctgccctgtaggaccagcttatcctacatgagccattgagaaaggcagtggtgatgtggtaatgaggacagtgggtgctggtggcattggtggctgcagtcataggccatgaagaaccagagtacacattgctttgtaatttccaatactggaatgaattgaagctaagaggaataacttctatggtttactataagttttagttcattttctatccctattgtgggagataatagggatagtggtactctattcactgagttgttggcctggtacacatggagtgctcaataccttccattattgtagcttttgctgttactggcagaatgcttgtctcatttggaaatgctctatgaaatctcacttataggtataggttagcattggaggttctgattttaggtatatgaatatatgagagcgatgtaaagttcttttcaaataacaaagaacttgcagctacagaagagggttttaggcctacttatgtttgagatgcagacatgacactttcaaagagctgtaatctagccaggtctcctgggcagaatgagactagagcatagtcatcctatgagtccagacacaagctctctccatcgtattacaatggcctttgttgcaaagtgcctcttccacaatcagtcgactttcagaaactttcataatatctgtgtgcatgcatgttggcctactataaaggttcttaaggaatacatccataaaggacattttatcacttttattaccacttattatttttcacttttagttgcatttgtttaattggttagaaatagagtaagaaagataaaattttaacttttaaatgccacagtgatccattatttcctttaaaggcgatgttatttccactaccactgaattaaaaatgatctgccaatgggcactttaaaaagtgttgtatacgcctaaaatatatgctacttacacttaaaggacatttttcagtgcccttaaggacgtattgtaaaaggcaacatttatttttttctacattttgaatataatctttctcccagcatgactcattacagccaaccaatttaaattcttcttttataggtgaaagaaaatgtaaggtattgcccgatttgcattaaattgtgcttaaaaatatttcctcaacagctccagaaatttgagagccattttctgtcacacacttaacattgagcacaaatagtaagttatatgaaaattcttaattagaagttagccagttttatcaaagaattttacatcagctaggaattgattacaagacactaaaaacaattaagaattccccatgaggtaatatttatctcttaatgacttcaggggaggtgatttaacacgtttcacttacttaactaattcttacactaatatcgaagataaactgaattagtataattaaatgctatctctagatcattttatcatccatccttgaaaaagatggtggctcaatttctaaataaaaggagttaatgttgctgtatttaatctataaaggtgaaacatttcagccatacaataagaaccacatgggtgtaaaatattcaccatactcccctctccaaaccccaaaagcttatatgtcaaagccatcacaatatttaaagaatttttagatatttttctgggcaaacgcttccagaaaatatccaactttgatttcttgtcctttagaattcacaaataccagtatttataccctttcttttttttcctgagcagctactaaacctgaacttccttcaataacaagtaaaagaatgagatttcttttcatggtaatctttgttgcttctataattaataaaatacttgtctgttgactgctcatttaggtattgaggatggtgcatatttttgtcagcatattatttaatgcagatctaggttaaactgatgcctgtgaattcagaaaagaaaattgggaaggtatgacttttcccaggtggcataggacacgtctgcgaggctgagacccctcatggcctctcctcttgtttcttctgtgctgttttatcaaactttggtctcatctaagttcattttgtcaccttgcattttttgctttctaaaatactttacctgctttttcttttccctagggaggaagcaacttacggatacttggggtggtgaagtcagatgaaggcttttatcaatgtgtggctgaaaatgaggctggaaatgcccagaccagtgcacagctcattgtccctaagcctggtaagacaatgggaaccttgctttggtacctggaatgaaaattattcatagtctgttggtaaaatccatattgtttttcctacccctcaagggcaatatggcaatatgaaatcatttagttaattaaggtgtatacttgtgtattgatgacattttccctctagaaaattgtgtgtgtacatgtgtgtatatatatatatatatatatatatatatatatatatatatatatgtgcatgtgtgtatgtgtgtgtttgtgtatatatatatatatataaaatctccaatgagataaagtcatcatgaataatagggcctctgcttttcaaggcaataaccactaaattattaccttctccctcttttgtggcctgcctttcttcccagcattccatttaaatataaaatatataatatataccttgcatatatgttaggtgtatattttagttatatatgtgcatatatacgtacacacatatctataaatatatatacataaggactgtacatattttcttatatgtaatcttgaatcaatggaagttaattagtgtattagtctgttctccactgctatagagaaatatctgagactgggtaatttataaagaaaagaggtttaattggctcatggttccacaggctgtataggaagcatgatgctggccatctgctgggcttctggggaggcctcaggaaacttgagattatggcggaaggcgaaggggcagcaagtgcatcttatgtggctggtgcaggagaaacagagaaagagggggaagtgctacacacttttaaacaaccagatctcatgagaactcagtcactatcaggagaacactaccagcagggaaatctgcccctgtgatctaatcacccccaaccaggccccacctccaacactggggattgcaattagacatgagagtttggtggggacacagattcagaccatatcaaaaggatcttgaaaaattactctttttaattataattgcaaaaaatgtcattttgttttatagtcttttggaagcttaatatattgctgaattacagaattctagtataagtccgggcacagtggctcatgcctgtaattccagctttttgggaggccaaggggtgaggatggcttgagaccaggaatttgagaccaatctggacaacatggcaagactttgtctctactgaaaataaaaaaaatatatatttaaaaacaggcagccacctgtagtccagctacttgggaggctgaagcagaacaatcgtttgagcccagggtgttgaggctgcagtgagctatgatcacactactgcactacaacctgggcaacagagcaagactctgtcacaaaaaacacaacaaaacaaaaactagaataaattgatactagacctgtcatgtaacagctctataacaacacaatttcttgggaggagagacaaaaataaaaacaaaagaaccatcctgctgctctgaaatgattaaagaagtttaaaacagggacaagacagttgttaatacagatccaaatacttcaaaatgttaatatctcccataaagagttatctatcatgttacatacatttcaactcttttggaccagttttcttccttttgacatggctcgcttttgtgttaatcttttcctgaagtaagtttaatagaaagtaggaaaagcatataagacatagtctttctctggcttttatcatttaaaatgtgcctattaagtccttatattgtatgcaccccagccagttagctgaagattcacagcagtgctcacaaagatgactttctcctatttccttgattgaaataaaaataaaataactatagaacaacaataccagatgagtcaagaagctaaaggaactatgtaggaattaaaaggagcaattaactctggctcaagatcaccagtttctctgatggacttcttttccctccatttgatgtgcttaagtgtcagtgtaacttcattggtgtgactaagtatattattttctgctgaactagtaatgcataagtaggagaaaaggaacctttaaaatcagggtctctaatgtgagccacactttttttcttttaattttattattattatactttaagttttagggtacatgtgcataatgtgccggttagttacatatgtatacatgtgccatgctggtgtgctgcacccattaactcgtcatttagcattagatgtatctcctaatgctatccctctccctccccccaccccacaaactgtaccatatcattagtaacaaaagtatgggtgcctttaagctgatattggctgctacgccagtcacagaacaggagaattgtaggtgagtttgatttttcagctaaggccataaagctgatgacaatgcaagataagtgacttcgtgtttctaaaggaggtgtaagatgtatcctcctagcacttggcactgaccaaagaagtccagtgagcatccctgtacctgctcacagggagggaggattctttgaagtgctagaattcataggatgagaggttgtcatggtattttctctcctgtaccagccaagttatacagactccaagaaaaccttttagactgtgtgtgtgtgtgtgtgtgtgtgtgtatgtgtatgtgtgtgtgtgttgctggggactgattgcaaaaatgggaaatgggcaactttattctgctatttcatggtctatacaaacctgcccccagtgtctgaggaagctgagagaccaaagaaagaggctgacaaatctagtttcttagaaatacttaatagggacttatgaacaggagccatatctgtgtctctggcagtgctgagacaacatggtggcatggggatgccactagcccccagaccgagggcttatataccatggggagaagtggttttgaagggaagtgtgagatgatggaagtacagtaacaccaaagttttctgacctaatggcaggatttatggtaagtacctgctgttacacaaggaaaattgataaacaggaaatcttagaggccttcccagaagaggggttaatcagaagccaacaaacatggtggattagcttccaagatggagttgctttcgcctccacactggctggaaaccacctggagctgtccacaatgcagggaagagaaaggagaggacaacattaagaagaagctctatttcgacccttgagaagaacaagggtgtcagttccacttgaagaaggcaaggctgaaggtttcttgaaaggacttttcccaagaggtcctgtctgctgaggctgtgccaaccaagacactagagtgatggcgcctggatggagctgagctaggagggtggcgcaggtcagccagagagtgctttgccaactccagcaggggtccagtgactgcatttctaaggtggggattttctgaagaactcacagaactgctccacaaaaacaaaaaaaaaaaaaaagaagcttgcagaaaccttccatgagtgtggacttttgaaaggacaagctgagaaaaacagtctttgtctctttattccaaatccatcctcccctctctgaccctgaggaagccctaaatagaagggagaagcgacctgagagactgaaacacagatgataggcagtcctactgcccccttccctatttacaatctacacttgctttgagagatggaaagaaattttaaattattagttgaatattttaatttagatctcattgaggtgtttgtgtgttgtggggttggggggggttgttattgtgtggagttctgtttgttttgtttttgaatacctgaagataaagcttttttttttttttgagacagaatctcactctgtctcccatgctggagtgcaatggcacaatcctggctcactgcaacctccgcctcccaggttcaagtgattctcctgtctcagcctcctgagtagctgggattacaggcatccaccaccaagcccagctaattttatttgtttatttatttattggtattttttaatagagacagggtttcaccagattagccaggctggtctcgaactcctgacctcaggtgatccacctgtctcggcctcacaaagtgctgggattacaggcctgagccactgcacccagccaataagggcttttaaatacttacctcaccccagggccagaggatggacccaagttacaatcagggttgggaagacagagctgacagtgtgtgtttgaagacggatgacagcagaaaaataaaaagctatttccttctaatttccaatagttgagcttattcagtcaacccattatagatgttcaatttcacttctcccaggaactctacaggtagcctttaattcatggtatcttgcattccacttgggccctgatttgtttaggtctatgtgaccataaagtgtcaaggctctcctgagcagaaatggcgtttaactcctcactagagcccaggaaaatcttgaaaattcatttattttccatctagatggtagagtgttgtcagtggcatctactctcttggtcgttgtttattgtatttggcattggattcaaaagaaagtaaaagaaaatgaagataaaaatccgaaagcgtgacaggacaccattgtgactgtcttatatttcccccttacacatgatggattgctttttcctggctatttaatcaggtcttcaaagaatgccactccaattcctcagagatgcagcacaggccgcgtgcacagatggtagagaggccagctataaattaagcaatgaggctgaccatggtgggaagaacatagccctctctgtttaagttttgacaataaacggtcaccatatattttgaagtacattgtgggcgtgcattacccagctgttcagctttagcctgtccacaggggcttgtggctgagagttactcttggcaaccataacaatctgcttctcgctggagtacagacaatgacctatttgagccagtgtctgtagttgtcggatatttacataagcctaatgaagtttcaacatagtcttttatatatagttacctattccctctttagcagttagtgacttaggaaataaaatgaacataatctgctgaattaaattgagtgaatgacttgtttttctctccagaaaatgctagggaaaaatatttgaaatgtatgcattttcaaatgtgaaatgtatacacggtttcctctagataaagatcaagattaaaatcaagaagatcaatggtgtttttaaaaatcgttacactacaggaggttctatcaataatggtacataagtaacataatgccatacacacagtgctatctatgcaattatttattttctgtctctctctatagaacacatgcacaaatagaggatggattcctgcacacatgagactttgcatatattacattaaaaatatggagccatattatgtaagcagtgtgatggaaagttaattcagtttagttgatttatatgatgtgtattgtttattaatctctccttagatctggggacagagttttattgttgtttgttttaattaatttttgaaggggagggcaggatgttggctaagaagtctcctttctaaataagacattattactgcaagtatactattcagtgaatagtctagcaaaaaatgggttaagaatcaatgtgttaggactgggtgcagtggctcacgcctgtaatcccagcaccttgggaggacaaggtgggcagatcacctgaggtcaggagtttgagaccaaactggccaacatggagaaaccccatctctactaaaaatacaaaattagttgggcatggtgacacatgcctgtaatcccagctacttgggaggctgaggccaggacaatcagttgaacccggagggcagagattacagtgagccaagatcaagctactgaactccagcctgggcagcagagtgagactccatctcaagaagaaaaaaaaagagtcaatgtgttctgtgttacaagaataagaagtttcagtagccagagttgcaaacaggtaagcaataagttaggatcccattggcatactggatggtgataaattaattactcccatgttaccatccaataaattgtagtgcaggtaggcagtaattaaattaaggaccctgtttggtagctgagtggagaagttagcaattatctggagctggggagcaggagatggggagcaaggcaggaacaaataataagatgaatttaagatattagttatctctgagtttcttatcctggttctagatgttgcatggcattccgttttctgacagtgtctgcagcggaaggttgttggaagtacctgactgctgagcagggaagtggagggccgtggaactgggaatgcacctacgataggggcatacgtagtctgggatgtgtttaatatagtggcataaatgcgtgaagacagaataaagttgccatgggaagaaataatgtattcattatattctaccatgcacaaaatggctgtgggaaaaatccatataatcataacaagaataaatgctattatagatatttcccaaaatgttggtttgcttgggcaagatatagggtctatgtcttatgttaatattgcatatttggctgtgtggtggagtagacagagcacagactttggagtcaatttaagtacaaatcacagctctatcatatattagctgtgtgacattaggccagacacttaactccaagccttaatattatatcctgcaaaatgtggatagtactatctatgccatcaatttgatgggagaattaaatcagaataatgtaagcaagacacatatcacatctaccacatagtaactgctcaataaatgtaatctgcacatttgatcttccttcatctaagatatacacctgcttttaagcaagcatggtttcttttattcatttgtcaaatatttttgtaggcctactatctgctattggggaaagtaaattgaaaatagaaaaagagataaatttcccactttaaaaaataatcacgtttttattggaagaggaagacaaataaaaaaaaataaaaataggcccggcgcggtggctcaggcctgtaatcacagcactttgggaggccaaggcaggcagatcactaggtcaggagatcgagaccatcctggctaacacggtgaaacctcatctctactaaaaatacaaaaagttagccgggcgtggtggcgggtgcctatagtcccagctacttgggaggctgaggcaggagaatggtatgaaacctggggggcggagcttgcagtgagccgagatagcaccactgcactccagcctgggtgacagagcgagactccgtctcaaaataataatgataataataatgaagaataaaaaaataaatgctggttttatttttttccctctaacattggttaaaaaaaatagtttcactgtagtaggggaaatatattggttagacgtttagaaaaatgagaagcattatcaattatctgtcctcccctggaaaaggttactgattacaaatgatgttgaattttaaacattttattaagtcagtatatcatatagcttggaattcagaagagtcaatcatgaacatcaagacgtaaaaccagaagtattttatatctgttttcatgagttgttccttatcaatataagaagaatacctagaaatccaaatggacaaaaggaatatactaataaaattgtatatatattataatataattacattataattatagtgtttcctactacatgttgattctgacatactaacttcactgagattcagtgtgaagcaatgaacattgaataattagttcaattattaagatctattagaatttactttttcagtgtaatagcacctaagcaactacgtatgagagattgaatctaaagggctgtacttcttactttgatattaactactggtggagaattaagttaaattttgtctcttatatgagaaaagttactatgatttaactgtttcattgtgtttagtgtaggatcaaattgtccctggagttctgtaactaatctagaagagccaatttcatgtgccatactacaatgttaaccgacccaagcaggtaaatgggtccttatagtttcctcacacaaacagagatgctcgttaacactacaaaattcctctttaaagttccatcattggtccaaatgcataaaagtgcaacttaatatttttgaaacatattgcagtgatattatagctcataagcttccctagaacgttttcctttataagccttggtaattaattgtagctaagaagatacagagccaagttttttcaaagtggctttgttaacttcagcatatctgatggtacatttattcaataaattgtaaaattatttttgcttataaagttaaaaataagagaatagtaatgtatttttttttattttctacttcaaagtctccctcccgttagagaaatgttgacacccatgctaacattttccctgagtgattcattgataatctaagtttggcataaagcagtcatttgatctttgaccatataatactcacctagtgtatgagatgtgtccacatctcatttctacactcttatccagtttacttgtagagatttaaaaatgtattggaatatagtgtatatttatgaagagattcttaggcaatattgcctaacctttccaagtctctatttcttcagctgtaaaattcagtagataattgtctcaaagatttagtgcaataaatgtttgtaaaagggatttgtgggctgtaaattgccacacaaatgttagctattatgaagtcttttgttggttttgtttagtctcaagaaaaatagcaggcatttattgggatggataaaatgatagctttcttctagcatatttttctaccctacaagaaaataattagtaaacacatattttaatgacaatgtccattcaaaatttaggtttttagcctagtggacaaggttaagggaaaagtcctttttcaaaatgactgctagttgaaagatttgcagcacggtttgcagtatcagtttaataatgacttgctcatgccagttttatgtaggcagaggtttctcagcaaataaaggcttgtcattcaccttgtccttcattcagcacgtgcttcaggtaggaagccagctcagtgctaatcaagaggatatggctgtatggcagactttgaaattagaaatgaattctgcagtaatatgaatgtactgagaccagtgataataataaatccatacaatatggaaaacttgatagattcataaatattgatcacatcatacttcagtggtaaatataccagagtgttatcccattttttttttttttttttagctctctagagtagaaaaagcggaagagaagaatgctggtttttatattgaatccaaatgattttgactttgaatttgttatatttttatctttcacctgtatatcaccatttgatgaaagatgtgcgagtgcacacaaaacatacatacatatagattatatagtatgtagatgctgtgcttatatgtatacacagaaagagatatatattccttttgattagagaagtcttatttcctggggaaaagaagaaggttaatgagatgaactgtaacccccaccagtgcaactgcaactggtctcaaggctgcaattggtactatttccctcctgctacccgctgtaaattcctcttactctcagctagcatctctgctagtttctgtggcttacccaaattcctgtccctttactggtcatatatgctgtactagccaatacatgatcaaaattggggaagggagtatcaacagatactccagtagatcatcagaatgccaatcatattttccttctttcccaactcctcttaatgacctgggcaattattttgccaggatagtatcctgccttgcctgctggtattttggcacaagacgtatgatacaacaaggcagcagcaatagctcaaatttcaatgatagaagcattcctcctttgtgaattaggacttctgagtctacaagcctagagtcatagggatggtaaacagagattctccaaatgggtcactgggagtcatggtaagcagtttcatacctactttaatctcttgtgtttgtttagtctacctattgaggacatggtaccatatactggccattgatctagacatatactagaccctagaaaaaggtatcccttttgcttagggtatggtctccagcctggctccttaattccacctctgaaggctttactttggctgtatcaagtcagcagctgttgttgatatgtgataggattagtagatcccgtggcaatgcatttatgcctatacctctttttctgtagagtaagttatttgattcttttcaatataatgagggattccatgttggtctcaaatactttgtgagtctgagatggtggtgccggtagaagccctgagaataggaaaagcaacccatttccagaatatgtgtttatttcagtcaagatgaatttctaaccttttcagaagagaagtcatccaagtaaatatgtcacccagagactagttggttttcttaaggaatagtgatttgttgggagctcagcatgtgtctctgttgctaggagattgggcatacagcagtggtggcagcttctggtgagtagcagaaaccatgtaggattagagcccatgccagtgagcaatgcataggctccattcttgcctctgtagccttatcatttgtgcacctttatgccaccattggatgctggctgatgtcaacaggctgaattgttccatctacataattgcttagtgactcttccataaattatacaatctggtgtttacaggggattcaaagatttttttttaacttggtgttcattcctgtgggcctatcaacatgtcttttccccaaacctttttgttcctgatctttccatcattggccaatcagccaagctatttgaccttgttcacatgtatatatatatatatagtcctaccttgagccatttataatttcatataaagtaggtggtgtggtatactcaacattctaccttgggaaaggttctctttaccactttcttttggggctatccctcactgagctgcagtgtagcagccatccaatttggggtgtacccacatacccacagaccaagctgaccacctggtcataagtgtgagttaaaggggaaggtagttgtacaatagtgattgaaaacatggaggtctgggcccctcctgttatgtcctctggtcccgtttttccctgatgccaaatgtaattcaccccatgaactgatgatggtcctgtctgaccttataacttggtgcatctcagagaagccagggtatgatgagcagttctggtcagtggactctcccatggttatttttctcttactttgtgagtagggaaactgctgcacagaaaagttaactaacttgtccaaggtcacacagctagcaaaacatctgacttttcagcctactttctcagccattgtgttataatgggtctgtctacccaggctttgtccacacatggaggcttctcagataaatgggtgatatttcaggtttatttgagtctaatcagactagttttagaattactaataaaggttaaacactggaaattaatttttaaagtctaggattctgccactcaaatgatctctgttcaactttccaatatgatagggcccattgctaagtgtgggttaaatgtgtgaaccgtcttgaggtgaatatcacataattgttgctatccagaaatccatagtttaacaaagagtaaattcgatataactaatcttaattatcaaatgcaattaaagcatagtgatttgcaatgctatattcattattcaatatttatcgagtacccagaaatatataaggaatcacaaattagagtgttgtgatatgcacttgcagtcccagctacttgggagattgagatgggaggagcacttgatctcggaagtttgagactgcagtgaaatatgatggggccactgcactccagcctgggcaacagagcaagaccctgtctcataagcaagtaagtaaatacataaataaattttacctagatattgattttttaacaaagaatcacaaatgagagatgttagatacaattcaaagaaacattaagtctttaaagttagtcttaatactcctcaaacataacacagccagtgcctgacatactattttttgggtttgaccctatcttacgaggatggtagtgtcatttgccacacagaatgacaaagcttctattgtattgaaaagctccttcacttattgttctattttgtttaagtgaaaaggtctaggttacaatctaggttaaaaaaaagagaaataatatttttttatttaaagtatctattcagagttctttagcttataatgtagttccatcaaacaataattaatcagcctaaatagtataggcaatgcacagctgtctttgttattttgtgttgacaaatatataccaagaatctataggtgaccctaactttccctgaaacattgacaaaataaattttttcatctagatgatcgtctatgatgaatgtgagaaaattcacttgaaattaaaatgccccatcctcaaattaaaacacacgtcattataaagcaagaaaagtccaacagaaaagccagtttcccatatttcttggtattcttcaggtccagttcctatttaagttgacctacctgctaatcagaactgatgtgttcagttctggcagacatcgcctgagttgtatgaaaatgtaccaaagcagaacaaactgttttgaacaaggaagactgattctttctttaagtgattttctcctaacagtatggcacttagttgtaaggaaaagggaataaaagtactatgtagcttatttcatattcctcccttgccttgtcttcttgatttcataaatggaaaaaagaatggagaagagaattggtagcctatacataagtcttttgatctcatgaattccatgtccaatttttgacacgtagaccacctgctttcttgttatacttgagccttacttctcattatttaatgtgaggctttgagcccaattttgataaaatattttagatcttctttaatacgcttgcttatatagaaacagatgacccttggggaaattcaactgataaaaatggtaaatatctttttgcttttctagatcaagaaaaataacaacactaaaacctcatactaatgatgtagttactttgcacatgaaacatcctagaaaaagttatttctactttctgaatgcacgtgttaagtggatgcttaagcccttagtctaatagggaagtttggcatagaacaaatttattttgaatcccaggaatatttaagtgcaagatataggggtaagaaaaaggagatagcacaaaggagaacttaaacaactctttcaatgggaagaggaattcattgctgaagatgtgacatctgagttgaaatggactttgaagtagggatgtggtttggccaagctgccaagaagggcaaagaaattgctggtagaagaaacattacatacaacacatgggagcatagagcagaagcaaaagtatgtattcagtgaattatgtgtggttctgtaaggctgtagagatatgcaggggctggatcacagagtatcttttagaatatacaaagaaaattggactttttgtctagactatgtgggatagggatggctaaatgtaaaagataggcttgcttctatttctgttttttaaagataactttggaagctgtgtgagttggcagtggtagaaagagggactagaaatattgaaactagttggaaagctgtatcatcagtaggctaagcaagagagaatgaggtcattgacctcaactgtgcaagaagagtgagttaatgtattagaaggtcctgacagattggagattgagatgaatatgtgcaggtggattaggaattggggctgtttcctaaattcttgacttaactgaatggatggtaaagccatcacttaagaaagaggaagaatgacttaagtccatctccacagaaagagcctggattctgagtcctttgaaggcccatgtcttgatcatctttgtatttccagcaggagtaaagggcctgacaatgacagactctcaatgactcattaggaagcctaaaaggcaaatactttgttttactgattaattgataatgccaggtataaactatgatattgtaaaaggtgaagcaaaggaagtaaatatcccaaagactccaaaacatgcaattgagaaatttataatcaaaataggcaaaactagtaggcttactgaaaagcatattttgctttgtgtgttagatcagagcaggaggacagatgaatgcagaatattttgtagtatctccagagggaaataattatggcctaaactgagtggcaactctgctcatggagagaatgattaattcaaagaattatatggaagaggaaacggttagcagtttgcatttgaattgaaaaggagcttttgatgctgactgggaattctgtaagttattggcattgctgatggtaatgaaaagcttaagggagagtgtgacagggccttatcatgcatctttagttccttgatagggtataagtgagtcattctcctactgatgggatgattcctccttgctggacatattttacccagctttgagaaaggaactcattgcactgccatcttggaataatgagttaaagggttatgcattaacataagataaccactgagcactatcgctgccaggactggaatatattgatttgattaatccttaaatatcagaaggtaaaaactatcactttttccccccctcccctctttatttcctctgtctgtggcagacacagattagaactgagaaataaattagaaggactaactttggctttctgccacctagaaatagactaaatagtttaatatggatttatgtaatgagttcacaaattgattttgcagagtaagcttgctttaggaaataaacacctgtgtactatggtttgaatggcctacttctatgtgcactcatgttgataaaaatgaattttcttaaaaaaatctatcttatggtcacttcatcattccaatatttttgaaatccacaaatcaaaaaccaaacaatgatttagaatctctagatatcacctagggaaagcagtctctattgggtatcagtgataatgtcttatctttgagtgacaggattaaaaagaaaaaaaaaaagacctcctccactctctgtgaaacctccacttctccttttcccttgtttaagaacgtcacatgtgcctcatttaaacattaattatttagcttgaactgtacacagctaatgtgtaaaataaaatttcttgcaagtttgaagatgaatccagaggtaccgcttgtaagcaggcccccgctttttctatctcgggtggccaaattatgtgtaattgtaattggtgatggatggtgactgttgtgtcagccaatcattctaggaatggctactaagatttgtaattataatgtcccttattcctatttaaattaaacagtcttcacataactattctttcccttgaaacatggaaatttgggtgtgggaattggggacagttaagggtcagggttttacctcttaaaagctacacttttgcacagtctgtcccatttctctaaggcaccgtagatgggggaggccagcgatcaagaatggtaatttacaatctaagagtgcttaatctaaaatctgtccttgtcaaaggagaatgcgttggtccccatgcagcagtaatggaaattttatttcagcataagcttcaatgggggctttcactgtattctttaaactaccctcgtccttatcaatttatgccatgtacaggttttgtgggtttttaacatcattctactttaaaagagaaaacattaaatataataaataaatccacatttggaaacctataaactcaccttgcaagcataataacaaaaattgttatatggttatggctgaatctagctttattattaatcatttttcctggggattaaaacttaatttttcaaagagatccttttctctaacacactagtttctcttttagggtaacacttttataataaaaaattattttccttaattttcactgtcatatacaaagagcttttcctgttaagaaaatagatagttaagaaatataatactccagggcaaaaattggaccagattaattaaaataaatatatgaagactttataattgtttttgttcagtaacaaattagtaagtaccatgctaaatgaagacaatagcaatgacattatacattgtaaattagtaactatgggtattttgttttaaatctatttactagctcttgtttactaaaaacctctaagtatgtctctttcttatagtttccacgtggtatgtataaatctgttttattttccttcagaaaacacacatgctaactttattatatcttcttttctggcctgggattagttaactaggatttatatttatcttctatgttctacctcattaatatctatctcctatgttctacctccactccctcattcctagactccagtttgtgcctccttttgtggatcctgaaattctacatctcactgaattttatatatgcctaccactgtaacactggcccactttgttcttcatgctagattctactagagagcaattctaaggtcattttttttttacctttgctatttctcccacaaatttttccaagtcattattggccagaacaaacaaaaaaacaacataatcatcaaaacatctattattctctgctatctgtttcaatacaattttctgttcccaaagctcagattctttgtttttcgattgttccaaataggagtgacaattggtgtgctagagatggcatactgatgaccatgaatgagatatacatagaagattctatatattgttgccaaaagaaatgtgaggtatccaggtatccttgggaaagactcaattggctataagtaaaatttttgatgtctaaggcctcaggtatggcttggatgattagcaacatgaaagaacactggcaatattaaaagtgcacactgtatgttgtcagtttcccctacattttatacagctgtcaagaatactaaaagaatttgtgagacccctttttgttgactatttgttagattcatctaaggaacagttaacattctgaaaaatattactgagtcaaaggtcttcctgtaactgcaacattacttgcacattagtttttagaaagagtacattttaacactcttggctattcaaaataaatttcaagacctacaaatacaaaaaaaatatgatggcatacttctctttagagagcatcatgtgaaaaaatctagctctttgtttacatgtgcatagagacctgattaaaatttgggggttgtcatatcaaatttccttactatgtttccagatattcaaagttttggggataaaatgaacagctataaggaacaacaaaaataattgtttacagccttcttttgtagcagagacatgtgaatatcaaaggataaacatgaatgcggtggatttttactgtatcaacttagtcaaactgtaacaacctttctccgaatttccctctctttgtggttctgagttagtgtgggccagaaaaggcaaatagatgtaagggagtagtgtcttagtccactttctgttacttgtaacttgaaactgggtaatttatttttaaaaaggaattcaattcttacatttatggaggctgagaagtgcaacgtttaggagctggctctggtaaaggctttctttctggtgaaggctctttacagagtcccgaggtggctcagggcatcacatggcaaggaggctaagtgtgctagctcaggtgtttcttcctgttcttgcaaagccaccagccttactcctataataacccattaatccattaacctattattccattaatctataaatgagttaataaattgatgatggctctgtcctcatgacccaatcatctctcaaaggaccctcccttgcaaaactgccatattggagattaaacttcagcatgagttttggaggaaataaatattaaatacactgcaagtacctatacttttttattttttatttttgggaggtttgtgcaggatatgagttgctgctctctggtggctcacttgttgggacagggcaatacctcagccagttgctcctccaggccctgccagatcttctgtttcagcttttctaactggttcccagctttgaagacagagcaagggctcacaagccaagcactgtgggtggacagcctctttaagtaggaaaaggcaaggagatgaattcatctttagagcctgcaaaaaggaatacagctttgcctagaggacatgcgagacctctaacccaaagactatacaataacaaacatatgtaatttgaagacactgagtttgcagtgatttgttatagcagctgtaggaaacaaaatttgaattcaagattcttccactaattttgcatctacattctgatcattttggaaaattcttacagaaattggacaatgttgaacaaatagtgatttttaaaattatatctaggactatcattgccaagggactttgtcttgatatttcacaagaagaattttggaactatgaaaataggggatcccatagttcttactacaagcatagaatgcccaccaaacaatttaaagccaagcctattatccaggtacccagagaatccagcctccagaacagaaggaaacagtccccactgaaagaacacaaaagccaggaagccacaaggaattgccctcaggttctgaaggacaagagattgtgcattcaatagcttttgcaggaattaataagtgaaggccaagggttataataaacatctaaaggaagaatttagcacaaacaagaccacatagaagaagaaaaatgtatgcaagaaaaccagtatgaaccacacctagaaacctagtcagggattttttttttccatctaaaataattaaggatctttaccagttccttagcacagagaaatgtcaggaaccagtgccttgtcctcattattctttatgtgtaagaaactggagtaaacaatgccaaattattattccaatttgtaggttaaataagctccccaaatcacctagtcaccgtcttaaatttttaccttaaaaatcctacagggtattattataatggatttcctgaattgctgaaatattacttaatcaaagggagaagccattaaaacatagaacatgctatgttacagggctgacttctgtttacttgtgcacattttttttttaaataggaatataaagctaacttctcaggtgggaagatggtagaatcatcactgccatctccaaaactacacttttgtgatgctggcttgaacttagaccatacaaagttactcattttcagatgtttgtcaaaatgatcctccttcaaaaaaaattcagttattatggtctcagtaattgtgaaatgcaaacagaatcatttaagaaggataaaattgaatattttgtttcttacataaaatccagacctctgtcatttcagctttggtggagtattttctcttcttcttcttcttcttcttcttcttcttctccttctccttcttctccttctccttctccctctccctctccctctccctctccctctccttctccttctccttctccctctcctcctcctcctcctcctcctcctcctcctcctcctcctcctcctcctcctcctcctcctcctcctcctcctcctcctcctcttcctcttctcttcctcttctcttcttcttcttttcttcttcttcttttcttctttccttcccttcttcttcttccgttcttcttcttcttcttcctttcttcttcttcttcttcttcttcctttcttcttcttcttcttcttcctttcttcttcttcttcttcttcttcctttcttcttcttcttcttcttcttcttcctttcttcttcttcttcttcttcttcctttcttcttcttcttcttcttcctttcttcttcttcttcttcttcttcctttcttcttcttcttcttcttcctttcttcttcttcttcttcttcctttcttcttcttctttcttcttcttcctttcttcttcttcttctttcttcttccttcttcttcttcttctttcttcttcttccttcttcttcttcttctttcttcttcttccttcttcttcttcttcttcttcttcttctttcttcttcttgttttagggtacatgtgcataatgtgcaggttagttacatatgtatacatgtgccatgctagtgcgctgcacccactaactcgtcatctagcattaggtatatctcccaatgctatccctcccccctccccccaccccacaacagtccccagagtgtggtattccccttcctgtgtccatgtgttcttattgttcagttcccacctatgagtgagaatatgtgatgtttggttttttgttcttgcaatagtttactgacaatgatgatttccaatttcatccatgtccctacaaaggacatgaactcatcattttttatgggggcatagtattccatggtgtatatgtgccacattttcttaatccagtctatcattgttggacatttgcgttggttccaagtctttgctgttgtgaatagtgccgcaataaacatacgtgtgcatgtgtctttatagcagcatgatttatagtcctttgggtatatacccagcaatgggatggctgggtcaaatggtatttctagtcctagatccatgaagaatcgccacactgacttccaccatggttgaactagtttacagtcccaccaacagtgtaaaagtgttcctatttctccacatcctctccagcacctgttgtttcctgactttttaatgattgccattctaactgctgtgagatggtatctcattgtggttttgatttgcatttctctgatggccagtgatggtgagcaccttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctcttgagtttagttagatcccatttgtcaattttggcttttgttgccattgtttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaaggggttcagtttcagctttctacatatggctagccagttttcccagcaccatttattatatagggaatcctttccccattgcttgtttttctcaggtttgtcaaagatcagatagttgtagatatgcgacgttatttctgaggcctctgttctgttccattgatctatatctctgttttggtaccagtaccatgctgttttggttactgtagccttgtagtatagtttgtagtcaggtagcgtgatgcctccagctttgttcttttggcttaggattgacttagcgatgcgggctcttttttggttccatatgaactttaaagtagttttttccaattctgtgaagaaagtcattggtagcttgatgggcatggcattgaatctataaatttccttgggcagtatggccattttcacgatattgattcctcctacgcatgagcatggaatgttcttccatttgtttgtatcctctttgattttgttgagcagtggtttgtagttctccttgaagaggtccttcacatcccttgtaagttgtattcctaggtatttcattccctttgaagcaattgtgaatgggagttcactcatgatttggctctctgtttgtctattattggtgtataagaatgcttgtgattttttcacattgagtttgtatcctgagactttgctgaagttgcttatcagcttaaggagatttggggctgagacaatggggttttctagatatacaatcatgtcgtctgcaaatagagacactaaaataagagcagaactgaaggaaatagagacacaaaaaacccttcaaaaattaatgaatccagtagctgtttttttgaaaggatcaacagaattgatagaccgctagcaagactaataaagaaaaaaagagagaagaatcaaatagacgcaataaaaaatggtagagtattttcttaaaccattgctacctggagtttctccataatgatgccctttttattcccagcaatgattttctattattttgtgttacatttaagttagctttcttattaacaaagttaatgatcatatagttctcattgtgaatattaaaaaagattagccagaaacgagcattaacccaaaacacttgattgataagtttgtgatacttgataatatgaatatgctctaataagtaactctatgcagttgtgtattacttaaaataaatatgaccagacattcttcatggtaatgtgactagcttagttattagttttataaatcaatgcaatgattgtactcacttttttgttgttgttgttgttgcttgttttgagacagagtctcgctctgcctcccaggctggagtgcagtggtgtgatctctgctcactgcaacctctgcctcctgagctcaagtgattctcctgcctcagcctaccaagcagctgggattacaggtgcctgccaccacacccggctaatttttgtaattttagtagagacagggtttcaccttgttggccaggctggctttgaattcctgacctcaaatgatcttcccacctcggcctcccaaaatgctgggattacaggtgtgagccactgcacccggccgtactcatgtatttttaagtaattttttcctctttcatgccttgtgtctacttctgcctcattgtctatggaaaaagaaggcatttatgcttttgcaggcctctttcttcatgaaaaagttactaattttataactgctttggaataaagatgaatgtaatccaggatggacttattttttcctcctaactaaaaaaaaaaccaaaaaacaaaaaacaaaaaacaaaaaacttaaaccttctttatgggcacctaaaagtactgtggcccttgacacagtgcctactgtgctgattggacaagtcatccctattatatagccatatcgtggttatactttaagaaaattgggcctaactttctaagtgctttgaagtcatgtgatgcataaagcagtgaattgtttcattatctcaattttcttatgatgtaataaattgtttttagtttaaaatcatttttatgtcacaggtatattgtataaggtgtcagttaattttttaatcaatagaattgttatttttcattaacttgtgttactgccacaaaggaattgaatattttataccaatttccagtacaaatagcatctaacatttaagctttgagaatctttggctctactttctccccactcccctcgctatttggcacactattttgtcctcaagttcatgttctgacacatacatgtgtgtctactagttgctaaaattttaggaaagttattttctaatgaaagtcattatccctaacttacttgcattgtcgcttggtatattaaaatgtcttttgtttcttaaaggaagaaatacaagaaaatgttcttaatagcaactgtatttctttaaaggcaaatagttatctacattaagtagcaaatacaactctaacagtccatgaggccagtacattctctcactttctgatagtgaaaaatatcttttctgggtgctagaggttgtctcaatactatgggctatgcagaaaaatgtggaagaactagcattttgaggggtgacataaagaatgtattggtggctcacgcctgtaattccagcactttgggaggccgaggcgggcggatcacgaggtcaggagattgagaccatcctggctaacaaggtgaaattccgtctctactaacgatacaaaaaaattagccaggtgtggtggcgggcacctgtggtcccagccactcggcaggctgaggcaggagaatggcatgaacccgggaggcagagcttgcagtgagccgagatcacaccactgcactccagcctgggtgacagagcgaaactccgtcccccaacaaaaaaaaaaaaaaaaaaaaaaaaaaaaaaaaaaaagaatgtatcgtgtttcttgatgctaaaactatcctaagcagttcaattgagttacaaagcttaataatttttcaaagttcaactagaatgtcttaggacgtaggacaatttgggggaagtatttccaccttaaaggaggaaatggtggtggcatggtctacagttattttatacccttgttctatagaagcatgtgtcctggggttcctgagtgtctccatactgttaacagctcctctggcaactacattgtaacagagtgtcaggagttggtgcagaattccagcatcagttccaaatgctgaaccagtaatcgatttcccaaggaaatcaatcccagcaaaagttgagccccaactctctatagcatgtgaataaaacagaaaacggctatcttagagaatacatggtaagctgaagaacgtaaattagacttccaataaatttgatgctttgtgtacttagaactcatataggcattatagatccaagcagtttcagctagcttttcatctctctcaaaccctgggcgaatgataaacatcaaagagaataacatgaaaagaaatatttactttgaccgttctaccaaatatatatatatataaatatatgaaaatatatatactaatatatataaatatatatgtaaattatatataaatatatatgtatatatacacacacacacgcacaattcaagcataataatatgctttagactgagtggcttatgcacaacataaatttatttctcatggttctggtgaccggctgagtttccctagtctgagattagggtgccagcatgatggttgggtttctggtgaggacccttttctgggctgcagactgatggcttcttgtatcctcgtacggtgcaaagagagagagataattccctgggatctcttttataagagcacaaattctatttataagggctccatcttcatgatctaataacctcccaaaagcctcacctcctaatatgatcactttggaggttaggatttcaacatctgaattttggggaatatgaatgttacgttcagtccattgcatacactgtacatatatctatctatctatctatctatctatctatctatctatcaatctatctatatatatatatatatctacataaatatgtctttaaatttgatatatttatctttaaaatattgaattctgaataccattggctagcaaaactatgggactgaaaataatctgctgatttctcatcttggcctttgagatcattaagaaccctgtgaactatctttatatgacaattatttttaattctaggaaattcaatacagtagtagaatgctatagaataacatgttcattttttgtgttcattttcgtcacataaattgacttcttaggcttcaaaatttggagagttttaatgttaatcctaacatcaaaggtaccttaaattttttaaatattatccattattagagtagctggtaggtttataaagaatttagtgtgctctgagatctgtatttttaacaagcaactcaggtgactcttaagcagatttgggaaccgaagtcgtaagcaagtgaactatgtaaatattgtaccctcttgtctttctttctattttgcctgtcactctctcctgcagagataataatgcataataaattaatagaggaatcaatgactagtctatggttagacatggactttataaagcaagcactccatcatttattaaagcatataaaatatatatcataacatatgttttaactttattgcaacaatccattttatgaataaaaatctcctaggtagatattttgacacagtcaagaaggaaactgaatctatgactgttctatgagcctgttagaattgatgaaattcaagatctaacatgcatgaaagcattttagatgtggagttagctgatattatttgggtggcttttctctcacatgtttattttgctattttgcttatagtcatcagtctacttgtccatctacccttgctgtaagaggtcttatttttccttccatataccaatccagtccccatcacagaccctgatgtatcatagaccccgaaacaacttgttaaggaaatgaatttctattcaaacatgtacacacacacacacaatctaggcaattttaatgctagcaactgaatcacaagaatggaataaaagatacattctatctctgatatgaacaactgcattactatttaaaaaaaagtgggccaggtgtaatgacttatgcttataatcccagcactttgggaggccaaggcaggcagatcacaggcagatgacttgagaccaggagtttgaggccagcctggccaacatggtgaaaccccatctctactgaaaatataaaaattagctgggcgtgggggtgcatgcctgtaatcccagtgggtggctgaggcaggagaatcacttgaactctggaggcggaggttgcagtgagctaagatcacaccactgcactccagcctgggcgacagagcgagactctgtctcaaaaaactaatattaatataaaataaataataaaatgtgcttacatagacttaatattgatgataaaaattttgaataacacgttactattgcatagcacatcttattgctcgaaatgagacctaggtatatgacatttgtcaacatacatcaaaagattgttgatttgggaaaatgatcataaggctgataagttttctcagttcaatacatttgagctcatgacatgttttgaactctgaccccctaaaaaggaagcgttaggcatgctaatgggataaatcagccaaatcccatctatctgaccttattaatgtaactctaggatttagattctgaccttccataattattgacacctatttaatttatcttctcatcaatagtgaagcctagtgcagctgctatggcacatgtaaatacatcactgttgccagcacaggctgattggcattcatgcttgagtgtcttttttattttctccttggctgctgggagtagcctgagcagcgcagacactaaagagcttcatctattaggcatgacagatttgtattcagcgataaacgcctgaccttgctctactctctcatccattcccatcatcccctcgccagatgaaagagtctgcttaactcctgtttcctggctgtttccttggcaacaataactgagtcagtctgacagaataactaatagaataccttggtagtgagattaaagtgctttaaaaaaagtcgtcacccacagaattataaatgagaaatgtttaaaatcggaattttaagatgataccaatcagtgacattatgatttccttattaacccatttcattttgtggtaatatttacagacttttcccaaggtattttaggccgggaccagagtatttaagcttttaggatccatttgtgttatatgatgaaaacagattggttttgtaataaaacttgtattgctttagatgttgaattagtgggtagaagatatgtacagacagtgtcccaactgggaagaaggactttgtaatgaaatatgtactatctatttttctcattcctcttctgaaggagatgtacctttttaaggcattataactagaagatcataaagctacaagtatcatctccctttaggattctgtcacttttagcccaattcttactatctgaaagattcatcagcattcttgtttcatattgttttttgacaacacatcacgaggttgtcaaaagtctcagaatccctgtggaattcttaaatttggactgcaaattatagcataagctgaaagctaaacttctgaatttttcagtgaaactttgatggaattttatagaataattttagattactttatatcttcataagaatgcatgcagctaatagatacaatatagagagatggagcagagagaccatttgggtaaagcattttctactctgaatgtctccagtgattgcatcatgatttattagttttgccttgggctcaaataaattttaaatgatttctaaatatctattttttctattattctaattatatttttctaatctcatttaatattttctgaggccacctaatatttggatgtgcttaactgggtctaataaataatagaggacagaaataatgtaataacattaatttagataatctactctagaactctatattaaatgaaagcttatcatttatgattatgtcttgctattactacacattttgagagtgcaattaacttctattatcacaatgataattacagttggcaacagaagtcaacaaagcctatttatctgttttgcaattttaaaaatttagacatttccactcacatttagtacctctgattagaatggacattttctgctttgcagtctttttatagaggtttaatataaatttattccaattgttattgccagtgctcatttcaggaaacctgcttaaccacagaatgaagtctgaaggaggtgagcacatcaaaatgtagagatgactgttcaccagtcttcagatgactggatggtctgtttctgtccccatggatatcagaagaagcagttgtctttgctaatagatttgagagggaaaaatctttcaaatagtgtgtttgacttgctctaagaacatgaaacaaaactatattagcatccaattgctgctgtaacatattaccaataatttagtagcttaaaccaacataaatgtattattttaaattctaaaggctagaagtctaaattcagtctaaccagctaaagtgaaagcatcaatgaatttcttggctcatggccccttccttatattccttcaaactcctgctcctcctcctatcctgattcagaccctcctgaatcaactcataagacctttgttattgcattgagcttatttagataaaccaggataacctcctcattttaaaaatccttaatttatttatatccgtaatgtctttttttaccatgtaaattaacaatttctagggattgggatatggatatctttttttttttttttttggagggtatggggtttttttcatcctaccacaaaaacacttattcttctaaaatgtgtgcatacagagtaggcagtcggtaactattcctcaaaggtataaatgagcatgaatacacagaaatgtgcaagaaataatatggaaaaacaccagtggccaggcacagtggctgaaggctgtaatcccattgatttcagaggtcaggagttgggagacatgacaagaccctgagatatacctaatgctaaatgacaagttaatgggtgcagcacaccagcgtggcacatgtatacatatgtaactaaccagcacattatgcacatgtaccctaaaacttaaagtatagtaataataaataaataaataaattttaaaaaataattagccaggtatggtcctgcaagtctatagtcctagctactcaggagtctgaggcaggaagatcgcttgagcctgagggcccaaggttacagcgagctatgattgcacccctgcactttagcctagatgacagtgaggccttgtagctaaaaaagaataaaaaagaagagaaaattaacaagagcttgtaaaaataagaagtgtaactttcaataaatcatttaagagtaacctaacaactgcgtggtcagatctctagttgagtaaaatagagaaaaggggatgaaaagtagagtttgaatttgcagttgaatggttagttgtgctggcctctagattttgtttgtgtgattccatgggagactcaaaattaaggagtggagaagatataagctaagaaaaataaggcaattaaagacatcaaaataaatataatggaggggctatgctttagattgaagtttatagcctcatagtgaattctagatcttctttagctttattctactagataccgctagggagagagaagcaaaatagaaggaaaagaagcattaagcagagagtctaagcaattgtttaaaaatcagcttgcagtttgtgatatgataattattattatgatcctcgtctgtgatagcattaccataattactatgctaaaaatatcataactactttataatgaagtaaaatgtattaatatttagagtggtacattttacacaaaatacattctcaaagggtttacaaagctagataatgtagttaaaaatacacatcaaaagaaagaaagaagaaaggaagaaaagatgaaacaaaaagtggaggtggacttcactgtacttgaagataagtctttagggtgtgatattaaggttgaagggactaaaacctagtgagacaaaaagttgtattactgtgcccatgcaataataaattgcttaatacatttaattttctatccaactgattaatgagctaatgtagacaatcttttgttcacattcatatatcttctgtttttagttttctccatctttaaagcattgaaaggtgtaaattgagtcagttgttgttgatttatgaagaaatgggctgatcacttcccggttgcccttctatgtctgggacacctaggccattatcctgctaacactacatcctgttgccacctatatggtttttctctactaatcttaaaatatcataaaggcatttatttataaaattatgtgcctaacttctatatgctggacctgatgtcattttaaaataatatatgtcttgaagtagcttaaacttgattggggaagatagatgagtatagcaataaattagaccagattgaagcatacatatttgattttcatacatcttttaaggctcaaaacgtatctggtctttattataatgctgtactagtcagctagggcttccatcgaaaatagcatggactgggtaactttaacaacagacacttatttgctcacagttctggaggttagaagtccatgattaatatgcaggcaaattcatttactggtaagggctctcttcctcttctgcagaaggccaccttcttactgtgtcttcgcatgactttcttttgtttgcatactgaaacagagagagagagatttgatgtctcttcctcatgttataaggataccagtcttattggattagagtctcactgttgtgccctcacttaaccttaattacctccttaaaagccctgtctctaaatacagtcacattgggggttagagcttcaacgtatcaattttgaggctacacaactcagtcagctgaaggcatcagctgatgccttctcagattacatcagtaccctaaaatgcccctgttctctgacttcctacagagtacattgtctaaatttcacaactagaaattgattttagaattgttatttgaatattttgacttatatcatctcaaaattgttagctcagtgtagaatggtactatgtttcattttcagaatagagttttttttttaattctgaaacaattccaagcaatgaaaagttgcaagaatactacaaaagttgtaaaaatagtagaaagaattcttatgttctctttttacagagaccttactaagattttgccgattatcccaataatatccttgaaagtaaagggtaagatccaggatcattcattgtacatagttttcctattttctagtttctttcaatctgtaacactttttccatttttctttgaccttcatgaccttgagacttttgaagattacaagccagtcacttcatagaatgtccatcaacatgaatttatccagtgtttcgtgatgattagacctaagttatgcattttgagttgggctagcacagaactgatgctgttgttctcattgcatcacattgggtggcatatgacatcaatttgtcccatgattgatggtgataacttagacatttattaatatggttactgccagatttccctactttaaagttactttgcccccctttataatttgttttctggctgggaacagtgctcacacatgtaatccaatcactttgggaggctatggcatgagaattgtttgagcctagtagtttgagaccagcctcagtcacatacgggagaccccatccctacaaaacgtttttaaaaataagcccagctgtggtggtatgtgcctgtggtcccagctagtctggaggctgagacagagaggattgcttgagcccacgaattcaaggctgcagttagctgtgatggcgccatgctccagcctgtgtgacatagcaagacctcttctcaataataataataatagtaatagtaatttgtattctgtagagaggtattttgatgcagaataacggcctattcctcatgttccttttctccattagttttaatagccacttatgtttcttgcctaaatcagttattactaataagttgccaaatggtaagtttcaactcctatagttccttccatttgtattggtttgtctcctgaaagaagaacattttcttccccctatgtatttatttattcatttatattcatgtggactcatgatctttattttattcaatgggttattacctgttattatcattccttattttgatattcgaattgtcccagattcaagcagtaggagtccttctagcttcctactatgccctttgacatgttttaattacattgtaatctgaatctttcctgaaatactttacccacaaagctctaaatgatgcaagcacatggagatccccagaatatagtttcaattctgccgttgctagtttcttcctagctgtgcagtttcaacaagtaaaacctgagccttaatttcctattctgtgaaatggaatgggaattaacttgcccagttctttaataataataatagctaatatttgttgagcactatatatttgtcctctaatgattgacaacaggtagggattaatctgtttttatctgaataactagtaagttcctaaaggaggtttgaaccccaaaaaaggggcttcagggtcatagcaagaagataataaaggtaaattctattactattacatgttatttatattgtaatgagagttgttctaaataagagttgtcaacattgttgccttggagtctgaactagcagaggattcacctaatttcagctagaagttagaggtatatgagtttcactcacttaagagacttttcttttcttttctttctttctttttttttttttttttgtttgagacagagtcttgctttgttgcacaggctggagtgcagtggcacaatcttagctcactgcaacctccacctcccaggttccagcaattctcctgcatcagcctcccaagtagctgggattataggcaggcaccaccacgcctggttaatttttgtattattagtagagacaggggttttgccatgttgagcaggctggtctgcaactcctgacctcaagtgatccacctacctcagactcccaaactgctgggattacagtgtgagccactgtgcccagccacttaggagactttccatttcccttatacccttagcatgaaatgagaaaagagtaaggggagtttttgtgatttactctgagtatcaggagagacatatataaatttacttgttctaagataatagttctaattaaagaagaatttttagcaacctcttagtttcaaacactataatgttcacagcaaataaatagaaaggagaaagaaactgtttcagtgttgaagtaaagtcagagaaaagagagagacagaaaaaggagaacgaggacaataggtacaagggagggagggaaagaagaaagggaagaaagggagtagagtcagagaaaagaaagatagaagaagcaggacaaaagggacaaaggaagggaggtggggaagaaaggagaaagggaagaaagaaagggaaagccggagggagggagagaaagaaacaccgagctacctgtgtagcagaggtctcggggatcggatgtctagttgtgctggtcccatctcttgataagccctgagcactcatatatcttgtgtagtaaataacctaattctaatagcttccaaggaaagcttgcaaaaaaaatgggcagaggaatggagagagcctgttttaagatagagagagggctaccatccttgcatgtggcatctgaaagataaccacacagagcatattttggagattcaatttttatgtaatgggtgtcgttactatccagaccatgggggaggaagacatgcaccctttaatcctgtagcaccttcaccttcatcttgttccacacaattaacatttatttggatggctgtcttttttgctttcctaataacagtgtaattttactttacatgtgagatatagcataacaaatcgaataggaaataattataatcatgaaatactctcacagaggcatctccttccagctagttccaggtggcccaaggtcgattgtgaacactcaggatggatggcgtgtctgtcctttctctggaggtgtcttgggcacacagacctatatgtgcacttggcattgtgcttgttcacaatgttaaagttgtgatgttagcaagtcagagatgagtaggggcctgcagaaagagctagttagattaatccttaaggagtgagccatgaaatatttcatgggctgaaatgagaggcatgaccagtactaaatcagcagaccttgggaccctttaacagcggtgctaacccaaaatatttttaggcctgaaaaaaatgggcaaagtgatctttacataaattattctctgggctgctagtcacacaccagcatgctgggaacaataagctcacaggggtatttgttcaaaatatttgatttcccataaggctacttagccaagaaaacgtagaggacaatttacttttcactgacatgtttgttgtcctttcttctacagccattctcccaggatgaggataaaatatggagtcttgattctgagacacagtttgtctttactagagatgccatcaaggttctggtgattccctaggacaagtggcagtgcttcctgactaccactgggctgtgtgtgtgtgtgtgtgtgtgtatttgtgtgtgtgtgcgtgtgcgtgtgagtgttgacattgatttctctcctcttggcatgtagaagtcccaagtgccccactgacccattacctgagcctgtaattacttcaggagtagggaatgaaaagggcatatctcctctgctttcagggaatgacagactcgggaaaataagcaggccctgcattaaggcaaatctctcaggagagcttaaagactcaagtcttgactcggatgcatttttacatcagtagaggccatgctcattaccagtgaagactgctgaagttgtggagttggcatatgaccctgaaactgcttcaccataaagacagattttaatgcccatatgtgacatgcaggcacaaaaatgtaatcgctataattagccagcatccctttttcatagtgctactatttcgtgactacttgcctacttcattttgttaaagataaaatgttcgtcctatttttaaaaagtaagttgtttcttcacaagccatttttagggatacattcatttttaaaggtattttatagggagataagtgatcattccgtgtgtttttattcttttgattgtctaggatctagattttgcaattttgtgaatctgtttccaaactctgcaagggtgtctatattataagttatataaaagccctctgcctaattttttgatgtatatgtatttccagcctaatatccaagctgtattgatgtgggtgagtgagcattgctccctcagacagtctgcttagctgatttttgaagttaattatggtgcagtgaaatctaaaggtcagaccacatctattttcctggtttgttcaatgctatgggcatacgggcaccagataaatcccttaactgctgacctaactaataactttcctgtacactttaacctatttcctgttccaggttttcagactctttattgtgctgtagggtcttcttcagaatgggttattacagagcacatcacccaaaggctaccatgaagacccccttaggaatttcaaatcataatgtgtaaggtagcctttctgcaatacacccccaagttatcagtgtatttcaccgattgcctggattatttcattttatccttgccacttaaggagaaaattaaatttcagagagaattttgaaaaacatgaaatgcttagggttagttgctaagggatggttagctcacagttttgaaaattgtcttgttatttatacgttcatacatttaccccattcatttatgaattcattcattcagtgatttcttattgagcactaccctaggatatatcaccatgcaaaattccgtggtatacaaaaactcaagaatcatagaacctgacataattacatgatcataacacgaactacaaatccaggcccagcttctatcagtgagagacagaaccagggtacatactctgtgcagtgcatggtagcagaaacttgaggaggttcaaaagaataggggaacacaaagcaatgggaacccagggtagtaactaaagcagcatgttttgtatttgtttagggtgtttttaattttaagttttatttttttcttgaagcctatgctggagttcagtggcatgatcatgactcagtgcagccttgacacttgagcctgggctcaagtgatcccttttgcctcagcttccaagtagctagaacttatggtgccttctttaaaataactcataatgttcatccatgattaaaataatgtgctatgactctcaatgaaaatttaaagccaatagttgtcatttgtatttgcttatctaatcctaaatcagctgtccccagaacacttctgttgtactttcatgaaacgcttgatccttttaggattattgttcctctaatttaaagttctatttcttaatattcttagaacagtattaaatttattaagacattaggttctgaatggattcttctgccacagtttgaatctaaatattctcagtaggaaaaggttaagcatgtgagtgtccttattcattatttgcctttatattaactggaccaatacatgggggtttagaagaagaatctagaaacacagctggactagggagaggtgagtgaggcactttcttggggtatacaatttaaggggattccaaagcactctgtaatcaagataatattttaacacaataatttttaaaaattaaaattaatgctaaaatgccaaaattcacaaacaacataccaaaatcttaaattcagacagaattggtaatactgattttcctcttgctgcaggcttcagtgtggtgcagcatggcagtgatctagaacagatggctcttgcattctataacagttatagagctttaactctgggctacatcatttctcagaatcttttaagacctagtgatatggtttggctctgcgtccccacccaaatcttgtcctgaatactcacgtgttgtgggagggagcctgtaggagtggaagataattgaatcatggggcaggtcttttctgtgctgttctcttgagagtgaataagtctcacaagatctgatggttttaaaaatgggagtttccctgcacaagctctctctctttgcctactgccatccatgtaagatgtgacttgctcctccttgccttccaccatgattgggaggcctccccagccatgtggaactgtaagtccattaaaacttcttcttcttcttctcagtctcaggtttgtctttatcacagtgtgaaaatggacaaatacacctagctatttgattttctggtaattcaaaaaaaatgcaattgtttatcactggaacagttttacaaataggcaatgagcttgagtatgtctggattatctttaaaggtcaaactatagccaggaaattaatatggattaattaaccaatgagtaagctgcagagtttggccttgaactttcccttctgacttctggttcagtgatcttgttaagtcatcatactacttgggtcccgaatgctcaagaggtagaagtaggttatttatcatttagatctcctgtctgtgcagtctcctagagaggttctatgcaaattcaatttcacccttaacacaaaatgaatacaccacatgggagcagacagagaagaaaagtaagttaattcccatctgtgattatgtaaatgcattctagttttcatgcatgcatttaatgggttggcaatcataattttaatactactggaaatggtactatttggagatttgtaaattaaatgtgttcatgtattaattggcatccttagatttctagatcttggaaaaacagggtgagaagatgctgtgactaaaaggttctatgcatggaagaaatgtgttctttctggtgctatttcttgacacagaatttccttagcaggcagtttagatttccttaataaagaaagccaagcatcttcttgggatacctgaataatattctgaaagtggcagactactcttgttggcaactgaaaatgtacaagggccacaagggctgttagattcaagcccatttatttcccgagcttatctgtctcggaaagatcttagtcacagagtgtttagccccaaatttacaaacattgtttttctctcatggcccttgctttataatggggctctagtacaaggaaatgatgtgtatttttatttatttgtattttgttaagtaatcagatttcagactacacaagtaggatctaacacaaaagagttaaatacatgtatttgcagaacacaaattgtttttgaaaggattgtgattttattcatacactggcttcattaacaccatgacgagctgttcacattataagctaagttacctgatttcatttatgctttgctgtcccctcccacgtgcatatcccatttttagaaggtgctttctgtgcctgggaagtagaatgcattttttgcagcgaataggttattttcttatcagtctctgacaatttgtagtctcataccctcactttctgccatcatgcctgcctggaagaatcattctagtgtgaccaacttttgaatgtcctctttagtatatttgtgagtgatgcctgaggcattttgtctgttcgccttctttcacacctccctgtgacccaagatgagagagtaatctgacaagcagaggcggcaggctgtttgaaaccctagcttggctttactcgatctctgtcattttgtattttatttgactgtggcagtttcatgggtatatcagagccccccagttatcagttaggggaagctaataaaatccctgacacatcagattgttttctctttctttctattgaactctttggcaattgggcttgatgggttaagactcaaaggaggcgtcttatttcccattgctgcctaacctagattcttagctaaggacagctagcttcttagcacattttgccatctgccaaatgcagagtggaatgtcctgttcccagctttctgccatgtgcttggttcttgctcgcatttgggactcatttgcttacttgcctgcctggtactgggaaggtatatatggtgcttccttgcaagctgaaactctgggcatgttattctctccaggtccagaattcatgtttcttcaactcaagaacctgttcagcgggtgctgacttggatgtgtgtgttatggcttggccacatggtactcaagatgtaataagaggagataattcactctgagacttctaattaaggttcaacaattgaagatctaacaacagattttaagtcctcattttgttactggaaagggatcctgatctagaccccaagagagggttgttggatctagaacaataaagaactcaggaaaagtccacagagtaaagtgaaagcaagtttattgagaatgtaaaggaataaaagaatgactatgccatagacataggggagtgtttccaaaagcatgagaaagaatgtgcccaccttaggcacaatacttgtttcaatataaggtaacaaaagcaaaaaatcatggggtagatgtgctctactacaagaatgcctgataaaagattgttaatcttcgtgtaattactgttttccacaagaatctgtattattatctttttaaagcgaaacttattcttaaaataggaatgcttttgttcttaagacatagggacatcaggacatttcatgaatctgttaagtcctgggtctggtaaattctggatctgtttggtaaacattattaacgtgttttcttaaccataaacatcctctaagaatgcctaacttcctgagaatgcagcccagtagatctcagcctcattttacccagcccctattcaagatggagtcactctggctccaacgcctctgacaatttaaatgtagaagaaaaagtctaagattgagtagagatcaaagttgtgtcaagaacagaaggaaacagtgagacatgttgcagaataaccacaaagagtcattttacctactgcatgtcttatgtgatagaagtagatccttctattacccttctactgtcttttatgttcttaaattgggcccatttttctggcctttcaaaagagaatttctgtttgacagtgaactctaaattgaaaaactttaaatgactatcctatagaagagaattgtgtctgatgctctcttacgtttataatctttacttcaaactttgatccaaaaaaaaaaaaaaggaaggaaaaaaaaaaaaagaggaagacgtggttcctaacctcaaacagcttatactaaagtttgtttttctccctcaatcagaacttagaaagagtctccagggagatgacctgattaagaaattaaactgttcataggtgaccatgtgttacttaccacagatagcatattcatatttaaagagaggctttctgcctcgtgatgctgtaaagttttaaatggtggtttctgtttgccatcgtataatagctagacttagaggacaataatctaggtgagagtaagggctatgattttcctgtgctttatttaagctcaaaatacatttacttatccattgttttctattacgttttatttctgggttttatcttttttccttgtttgtttatatttatctcactgttctctttcacttcttttttctctttactaccctcaaatagataatcactggaagagcaatgcatccgagaaaaataaattaactttaatccaagagtaaaactcaacgtatttttcagaaatttagaaactgccagtttatatcagtggctttttgtgtgtttgctttcttttatatattttctattatgaaacataagacttatatggaagaatgcacgtaaagacatacacagaaaaacacacacacacaatggaggcagctccatcaattctcacttaattcctttgagtcaagaaacagaacattgacagctcccaaagaaactccttcaagacctttctaattgcttgcctatgtttcacaccaaaggaagacactgtcctgaattgtattgaaacttctttctaagtgatatatggtctaggaagaatgtatccacacatttctacagctacttagtaccaatagattttgtgaaaggattagttataaataatcaatgttgattttgttagtataatgtaatttaattattttctagtttgaacttttaaaatcctatttgttgtcatatattacaaattttgcgtatgtacataaaaataaatttctttgatagattgaaaagaaaaaccaaaaaacttgtttctaacttttatgagagttgtacttcccaagcacccatccagaaacactctaattcagtagttgttgaattatatatgaatggaatcccaccatgtatattattttgtgtctagcctttttttctgggcattcttttgggagagtcgtccatgttgcatagctatagtttgctcaatgaattgctattgagtgtttcatggtatcagtataccataatttacttatgcgttctaccaatgatgggtgtttggattgtatctgatttgtggctgttttgctagaatgaacatgcttggacatggctttcctatgcagcaagcacatgcctttctgttggtgtacatctaagtgtggaactgcacattttcaaactcattagataatgtccatctagttgccaaagtggttatatcaatttatattttcacctagtacttataagagttgcaattactctatattctcataaacactgtcattttaattttagccattttatgggcaggtatagaatctcattgtagctttaatatgtacttccctgatgactaatgagggtagtcagctttttgtatatttgttgaccgtttgggtgtcttttgtgaaatgcctactcaggtctcttgtctatttttagattgataggttttccatgtgtattgaatctactgatcagtttatagagacagtacaattttaatagtattttaatattttataatatttaataattcaatcttccaatactggatatctggtatggtgattctttgcaattttgactaagtgttctaaaacttcaatatttattaaatcctctttattattttttaaaaatattttatagttttctgtgtgcaagccttgccaatcttgtattagatttatgttagaatttctggtctctgtctctgtgtgtgtgtgtctgtccgtctctgtctttctctttctttctcctcttccttcattccttccctccctccctccctccctccttccttccttccttctttccttctttccttagctggttcttccagtagagcagtggttcttaaccccaggcaattttcgtctgctgggaagatttggtaatgagaagacatttttgactgtcattaactgagaaaacactgctgatatctagtaagtagaggccagagatgcctttaaaaacttatttttaaatgttgtccttttttttccttccagtagttctcaatggaaaggtggttctgagttttctggtctaccattacaggaagcagaattcttgttttatttgtctgtgcatttgttaatttatttctaggtaggaatctaagaaaatcagcattgaaaactctgaaagtattttttttttctgggaaatagtgcatattcaactgtaaactattgaaaatgatgacgtatttaacaagatatgctcatttcatagaagtcctaatttgaatgaaaaccattttttctttaatttctataatcatagcttgaagaatgtctaactcatacttatgcagaagagatgtccacttgctctcactatccctgagttagaaacgaaatatttaaatgattaaaaagtaattctggaataaagtgagatgacttgttgctcctcagtttttcagctgaataaacacagcttcataaattgtgacattaatatcatcaatagttaaatgtgttgacagataggcaaagcctgtagttggcatttctctcttctcagtgttatgtgggtatattaaacgactgttccatatcatagaagtagattggaggttaagcaaaataagataatttagcaatcagcaagttttaaatttttaagaacatccaaacccaaccaagaaaacaaaagagggcttttgccactttggtctaagtttaagagtaagatctaaatccagcagagacgtctaagtctaaagagaccaccaacttaaatttacaagaaaaaaacaaacaaccctatcaaaaattgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattgtcagtaagctatcgcaaggacaaaaaaccaaacatcgcatgttctcgctcataggtaggaattgaacaatgagaacacatggacacaggaaggggaacatcacactctggggactgttgtggggtggggggaggggggagggatagcattaggagatatacctaatgctaaatgacaagttactgggtgtagcacaccaacatggcacatgtatacatatgtaactaacctgcacattgtgcacatgtaccctaaaacttaaagtataataataataaaataaaataaaaaaagacaaaaaaaagaaagaaagattaaaaaaaaaaaagagagaccaccaactttgggtttgaattctctttcctgcttgttagttgcagcagctcagaaaaatgtccactctgatatccctgcttccctcataaacaaggatttttacaattttaggttatcagtctgcctttcaacaatacaaagacttgtttaaattgctttaaaagaggaagaaaaaaaattatctcatcatgtttagatcctcagtcttgattctgagcatttatgctaatgggatacatatatgtccatcttgtacattttccctggaaacctccaatcctgttggaattaattgaataactgcatatgcaatagaacctctaagtataatgaatctgaaaagaaatgagaacttggagattcagccaagcacaagtcatgttagatattttagttgttttgcaatttgcagtttcaattgctgaaaattctcttgaatgcttcattgtctcactgatctaccaggaaatgagagttgtgttaagagggaaaaaaagagaagaaaacacccatttcatcgtggcctgaatgttgatctgagtggatactggagactgttttcacgattgcttttgagctgcattgagtgactctaggcatgcatttagaagccactacaggggtaaaaaaaaacaaatcaaaaccaaaaagccttctaaataagtaaaatcttgtcttatatttaggagatgttataccaaaaatgaatttaatgcattttaggacataaaaacaccgctaacattgaatgaagaaaaatacttagcctttatattaatagcccatttttctatagcagtctcttcttataatactaaaaaaaaagtcaataactatgaaaattaagtgaatatatactctgctaagtactttttattcactttataccccataaaatcctcacaacactatcatgagaaaggttctattgtacagttgacacaaataaatagaatttaaagtggtgaagaaactcgccactcactcatataataaatggcagcttctggatttgaacccagatctgcctttattaagtgcagtgctgctgcattgagtgtgggtgactttacagtgatcaaattatgggtgtatgaataatgtaatggatttatgagagtaatccataagctataacatttcagctgccctcagataagctgtatgtaaggaccttgagacatgttttttagactcttaaagggcctccttaaaaggatgggaagaaaatctattttacttcccaccatagattccatattggcaggattcttggggtagaattggatattattcacactcaaaagatcactgggcagtgaaacataataaggccacagaatatggtgaagtactctgtactaccttgaaacatttttagctttcagcatccaattgtgtaattgcaatgtgtgttgtcattagtacttataagcctttttgcttaattttaaaattggaattaaaatactgacttacattttgaaaattccctaaaaacatcatcctctttcctttggattcttgctcatgactgattcatagaatcaataatatgcagggccagtattgtgagagattttcttttaaatgagtttctagggctccagtgattcaaaaaatcccattaaagtatattttaaaaattaaactgaatccaccaaataacacatccatgaatgcttatttgaaaacaatgtaaaagagaaggttaaagaagttgatgtatattttattgtttttaaaatatttatatgggatgaaaattcagtgaatcagaatcttttattcagaggctgctcggtaaataaactatagaacacgtaagatttatttttatgtagttggatataatttattaattcgatttcaatacagtgagagacttagagtgatttaatgattgacatgataatttataagacttatatttaccctcattcgtgtcccttctggaaatctcataatcttacctgtatatattgattttcattagttcagatatttttcctttaaaaaaacagattctatttttctttatttgcttttatttgtttactttggcttttttggtaacagctttattaagatataattcatatagtataaatcctattattctttagtcacatggaaataaaagttgaccttataccagatcaacaggtattgtaattagaaaagtttagaatgtagattactttcagaattattaaagcaaaagcttttatttttgtcaaaaacctgcttttttttttaagaaatagtatatgcatttcttgtcttaacaaactaatggtaaatcccaggtgttaaacggactcaatcccattaaatagccatattttctttcatttttaactgataaatttcagaaccatactgcttcactttctgtcattttattatgtaatcttaactaagccttgccaatgatgttttaattatacctttactatattagagtcatatttattctattgctctaaatttctgaattttctgaagctttcattctctctaaatttcaagcagaattttacagttctgaagatttaaattgtgaacatgaagatagactataaattactgattgaaaaaagacaagtcaaatagccctctggaaattggtatcccatagccctttgcaatcgtaacttgtgcataatgcactcatgtttatgtaaatgacatcctaccaaacagtcatttataataccagttagcatttgtattgaatcctggcagtgctttatttctaaattgtacccatttttaatgaacaccccccccaccccaagtaatgtcttaaaaagtaatgtcaggtgcaaattatttttaaatagttaggttttgtttctgtataagatatttaactttgaaaagaaaagtgacagcctgccaagtgcataatgcactctcctgagtatcagtacttgcatattttaagagaaatcacataaaaaagtaatagagtatctcagtataaagcaaactcaaaaagtgtttttctttcatgttagcttcagcatattttaaaatctggtgggccattgagaaaacagttgcgatgttatttttaaaatgtggaagccacaatttttttttaaatcaggcatgttgtgtagtgtacataccaagcccatgagcccacaaaaaggaacagaaaaatatattctctttgcaaagtagagtggtgggttattgacatgcagatcagccacgttggactgaattgctcctacacagaataactgaggacttcaaatcactttgaaaagaccaggccagggctatagatttctgtgggccctggctccttgattacatttatggttggattcacaaatttataaaaataagccagttcgtttatttggggacaaatggaatacagatgaagaaatttttatacacttgatgaaagaaatgtgtccaagtgcaattattattttgaacgttgaaagcaaggcccactgccatcaatgctaacacatgaactgttgcattctctgcgttgaaagctaagcccttgtttgaaatgaactcttaaggtttttccctttcttcaagaaggccttccaattttcaggtttttctccttaaaaaaatacttaatatttattagctaaccaatgatttggagaaaatagacttttcaagaggaaagggaaaaaatcacactcatggattattggtggtaatttgttgtatggcatagcagttcactggttgtatgccaatgatggttttctgaggtgtgggagatgaactaaaatctttcttaacagaaagagaattagcattacaagaaatacacacaaaataaaagacatttccatgatgatatctaatatattttcatggagacttgagtatctatgtcatctttgaaaattagttttgcttgttttacctagcatattaaagttggggtgtgtgtgtgtgtggttagtggcagatacgggtgggggcagggtagtatagaaactagtagtgacttaattgaatgaaatgactagaagatagctttctaaatcccatttcaaaactggaccatccaatttcactcttagatttgattcccccatcccagtgctagaattcggccagtagttgtaaaaaatacaagcactgtggtggttgcattttcttaatgaaggtaacatttgagttaccaaacagtttacctaactgttttgtacataaaagtaagagatattcttttatgataaaaatctattttaggattctcattcatttaatgtgtacatttggttatttggcattaaaagtaaactcaacttgaacaaaaatttttttgtatttgctaaaagataattatgagatgttttaatgggaagattaaaaattttctttaagacgaatatttttcttactatactgtattctgtggcaactttatgattttttttaccaataatctcgagaatatatgcaatggaccagggacaaatccttacccaggatgtgggagcggggttgaggggggtgctgtggggaatggttcaaagtagattagataaatttatgggtctgccaaatcctcataatgggttgaacgatcgtgacacacaatgttacattttgctgacctgttacttagtaaaatgtcaaaatggagccagatttgcaacacatgatgttaatggtggagagtgtccaggttcttggccacttgaacaaagaattggacaaaacgcacaaacaaagcaagaaaggcacaaagggatttcttgaaaatgaaagtacactccacagtgtgggagctagcccgagcataggagctcaaaaagctccgttacagaatttttgggagtttaaataccccctagaggattccattgtttatttgggatacgccttatgtaaatggagaggaagaagtaaagtgacaaagtcatctagttggcctgcgccctatggagaggatatttcctgtcatagctgaatcagccttatgttccgtgtctccagaccctgttttcctgcttcaatggaatgacttcaactttagttacatggttttgttttcctgatgtttgcaaagttacctctgtcttaactaggataggttcatctttttttgatttgttacacagttgcagctattcattattgcatctttcaaataaacatgaaagtactcttgggtttcagatcaggaattattaaaaatgatttgtagcaaaggaggttgctttaaatccagttcaatatcatacacttcttctacttcattctttgtaaaaattaatctttctaaagttttccttcgatttcaattgaatatttctcaccttttcttgatatataatatatattgctaaccttttaaaaaacagtacacatttatctcacccatttccctaattcctatgtctagactaaagggcagatcctccatattaagttagttttgaaaaagtaaaataaatttattttctcttgtgaccaaaatagtttagattttcaaccagcccatcaagtgaactttcaaataaccaaattcacattgaactattttttagatggaaagttataatcaatgaaaatccagtaaaatgcatatataagtctttcaaatgtcaaaagagaatacctgaactaagctttggaatactaagcatttaaaacattctccattgaaggcatccatcctttattaaaatttgcttatgtgagatcatttaatccatttctacattgggagttattttggctggattgcattggtcaatattacctttataatactgcactgtaagaaagtttacttgctccgtatgaaatttccaatatttgatggtttttgacctacaaaagcagcaagtttcacttgcttcaaactaaaactgcttttcttaagctcctttgaggattaaaggagaataggacagaaggaagcttcagaatccagaccaaattttactactcatcctccaccctttcttttgtcatcttctcccaaacttttatttgcttccaatctttgtgttgctgaatgtttggggctctttagttgttgaatttgtattgctgtttcaaaatcaatggttttccatctgctgcttatatgcagacaactatgagagaatcatggaacctttgcactaaacctgaagattgaattaagggcattcagatttaaccgctttttcaattaaaaaattcctctacagcagaggtcagcaaacttttttttgtaaagaccaggaagtaaatatttcaggctttgcaggccacgtgatctctgttgcacctcctggactctacagttttcaggcaaatgcagccacagaaatcatgtaaatatatagacatgcctgtgttccaataaaacattatttatggacactgaaatttgaatttcacattcttgtcacgtcatgaactgttcttcttcctttgatttttcccccattcatttaaaaatgtaaacattcttcttgtcttatgggccacacaaaacaggcagccagatggatttggtcttcaggtcatctttaccagcctctacgtcacagcatcactgacatgggtcatctgacgtcatcataaacacctctgttgatggggagttgattacacacaagtcagcaaattcccaatgcttcatttgcatttatcagaaatgtagtagaaccatattatgtgtgttattttttatcaaacaaaagacaaagaaggcccccaataatatttttgcagtgacatgattattattacttttttctaaaccagctcttataggcaatattatcttccaaaccactgtgtataattttcgattatctgcactgcaattgtaatatatattttgactactaccttcgtcaaataatactgcatcatagtgtttcgtatataaagcatgtagttttataactagaatttcagatgtcacgcataaagaaacctcatttgagtgattattccatgtcattcttggcttttacgaaattttagacatgtaggttgctttcacttgtttcactgacgattgcccttgtgcatattgttaaatttccaacacttatattcattcctttgggaagaattccagaagtggaattactaattctgagtatataatcatcataatctttgttgaatttactaaaatattatggtccctgtataagtggggacaatatacattaagtcctttatgtgggacaggcaatgcgctaaacactttaaatacattattacatcgaaaccccacaatagttatgtaaaaatataggtcattatccctgcttgtagaggtagaaacatgactgacattaacagttcaaattagaacttaggtctatctgactccaaagcctgtcgggaggcattttatcacctcttaccatttataaatttgcaatgctaatacacccgtaaggtagaatgctactttaattttttttccttctctctctttatcaggtgaaattcaacttaagttttaagtcttattttaacattaaatctgccacaaattattcctcaaacccaacaaggcagaatctactggtcattcctctgtgctcccacctattagaagtaaaggcttattccagtgtattatttttagcatcttgaggaaggtactgtggtacatttatgctgtgtccccctgaggtatcacaaagctttgtacaaagtcagagaccaatgcatgtccacccagtattactacagtgggtcaagatctgcttctggaagcttcgtttcattggcgtacattctttatctctgctataagtccagtaaatcaaatactttggtcttgtccttattttatcatctttgttctcttttctggtatttatctcacctctcaccaccctactgccctgaaaatatcatttttgtgtacttagcctccctcagaatgtgttcctggctcaactctctcaccagcagatagcatgaggctgaccaaggcctccatcctcacatattagactctgtctacttaggaaaactagagactgaaaatgagatcagggccactcttgtagaaattagaaaccttagcaaaccacaaatggcacagattttaactggcagattatttcttattaaaacattttaaaatagttctagttgtaagttgactcagatctggaaaggtatgtgataaagctattttcattgggggttctaagtctaaacatgtggctctgtggagaattaatctgctctgctgtcattgtcttagcatcattatcatcatgattatcacattgttgtagtttccagtcacctcttaggcactaattgaacagtaaggttgcatcaccgctgttggtgctgcttaggtagtattttcacctctttacacattgtggatcattttcttactgactttctctggcctctatattctacacatcttggataggatgtgatttgtaaaaaggaatatacaaattatgcccccaaaatgtagaaatttaacaatctgatgttatataaaaactgttgataattcaactttgtcctagaaaaattatattcaagttatagtctcattaccctgaaattttttattgagttttgtcataaatataaacagtgtacaagtcatggtatatatccagctgtatttcaaccatgaatatgttcttcaaattctagaaatctctatgcgtaaatatcaataatttttatatgaggtgtttattacaattctgaaattaaaatatattgtgtctgaaacttcatggtttgttaatcatgtatgtattatgtggggaagatatttgtataaaatactattcatttgcttcaattagtatagaataaaaacatttatagaattgcgttttaaatttagaatataaccttagagaatgttatttttatttggcataggtttttttcatatattagacaatttgtaattggataagacaatcttcagttgaataaaatactatagctgtattctttaccacatataggaatcaactcttacttaataacaggaagctgtatgtttgctaatgagaagattacataatgcaatttaagtttatgttctgcttacctttatgctgaacaaaactgtttgaatttacaaaaaaatcagaggaaaaattgctctgctaataagcccagtaaagatgatgaataatgaatgttggaatgttattatagaataaagccacaagctatgatatatcttgctgctaaattattttaaatgctgtctgataattatatacttgttttaagtctacatctgtacatgttaaaattgaaatcagagtttctaatcaatactaatttttccttcttggttgggtgggaggagaatgttcatgatagagaatatgttttacagttagaatgttaaaagaaaatcatatttaaattaatagatgtttgtttagggcaagtgttactccagggcagggattactgaggaaattttagaaaaacattgaagtaagactatgatgattaatggaattattaccctgatgtattctgtggaaagaattaagggggaaaatacattttatcattaaggaaacaaaatatgaattgcatatttaacacttcattaaatatgtagattgctgtgaaatctggtgagaaagttaaggatagtgagatgccataaagccatcatccaacacacgttcatttgttctatccatgataaagtgagaaaaattagaaaagagccggagagccagagttagacagacatgaaaaatgggacattggaaacaaaagcaaatcgctggggatacgtatttccaaaggtaaactagggaccattgtaaccactctgaaatacaaaatatcatttctgtaaactgtgaaatactgtaagctgcatttaatagtgaaaattatgttaaatattatagcaatgccaaatgaagtgattggccactgcttgtttcttgcatttttgatccaagtgcacatttcttattgttgtcttcccattcagattcacaagtggtcagacaacctctatctcagatatattacgtaaacttccaatcatacgcatgtctttggtggttttgatttgaattcatgattctacagtctctgttccccaggattatttaacttattaaaatgatacttgtaaatctatttttaatatttgtgaaagtcaaaactctcctttgtaatttgcatatttaactcttttttcaaatacaatgtaatactaacggagcagctattaggtgcttgacactgtggttaataattttacatgtatttttttaaatattaataataaatctgtttggggtacatattttatgattaaaaaattacaaaccagagaagttaagtaacttcccttgagttttatacctactgctcacagttctataaagcttactctgtacttaattctactattagtgaaaagacattcagtttttgtaaaatgatttattggagggtttgaggatccactcagtgataaataccctgaggctctatgcaaaccctattttgagaaagaacacaatttaaagattctcttctaagtgcctaacagcaacgttgtattttggaagttataagtgaatttattcaattatttcttctctagttgttgttatccaattgctgcatgagttttaaccaactgagtgactgattttaaaattttcagttttcaggttggcttgcatataaactaaatctaagagattgcttgagaaactgaatgccaatggcctaaatgcccttagctggtatagttgtgatgctcagtgctaattttactgtaatagatatagaaatagaaataaaaatagttttaaccattatattttggttaactcattaaccaattggcttttcttttcttatggaattgtggtatctgatagcaatgtaagcaaatataatttttcaaaaggggaaccagaatttatgtagatgcatagatagccccataatcaccacttctcacaatcacaatcttcttgcctgagaaaaactgttgttttaatggagaacataaagtttcattaagatacagattttttttcagctgattcttctttatttctgtaaaattcagtagtctagaaaaactttatcttggaaaacatgtagtaaacttgattgaccatattagctttgctccaccattaggccattataccgaaactcttagctgtcagattcaattcagactttaattaaattgccttgtggtctgacctgaaagagtgaatgtcacaggacttctcaggaattaacatgatggttattgcagaagtagatagaaggaatggaaaatcacttaaaactagttagtgtgaaagccctattttgggtatttcccatgttttgcaagcatcagctctttctgacctttagccttccaaaaatcactctaaccattttatctcccttttgcatgcatatctttgccaaatgcccctccttccatattcagtattcagtcattttcttgtgaattctagaacaaccaaaaatagttcttgtatgtctactaagtgctttaactcctatgctggacactgtacagatcatcgtgagcaaaacaggcattgcatccaccctcaagaagcttatattccaccatgggagacagatgttcatcaacacagtctttgcatatgtcataacaagttactataagtgctacaaaaatgtatgtgcaatatgcaaatacattggagggtactaggaaaatatgtaacagaggatcttatccaggcttttctaggaaattgacatttgagttgagatctaaatgaggcactggaattcactgggcgaagttgggggatggtggaggattgagtgctggtggtcccaaactggggaacaatatagacaagacctacaaaaggaagaggcaaggctttcagaaactgaaggatgggttttggggctagatcagtgaagcagagtgggggtgtgaagggagctagagagatgaacagcagcagttcccagaggccctgcaagtcattctaaggcctcaaatctgagctcattagaaaattctatgtgcaaccagccttattagggtcatttaatgacttcttagtttattcctcttgaaataatttaaggatacctagttgtaatgtgtttttaagtaggaatgctctttcttgtgaagtcattttctgttttagaatttctgccaattaggtcatagctatttttcctttggtttttctttgtttcattctttctattactttcttccaccttttctgcttttgaaaataattttcatgtctattcacagtcttcatctctcccctctgtgattatggcacttcaacgtgtcacggtccttttctccacgttttcttgctatacccgtctcatcttccagttctttcttcttggctggaattaagtcctgagtaatcatttttctcattgctttctttactttctggatgatggaatcatcagtgaggcacatcaggaacatatcagatgatgggctctcagctgaatcacactttgagcagatgcacaggtaactgaagcttcccatccctgaagtgccttccctgtatgccatttttaaatattttacagaaaagatggacccacagttttccttcatgagattggttagtattctattcctgtaataacacttttcatttttcttttgttttgttcttaaccaattgctttctgttgtgttttcttttaaaacacttttaggtttaactttattatttaatacatgttcaatctctagaacactacaactaatgattctaagtaatagaacaattaagcacagtgtaacaaaaccataatttgtaaatatttaatatttttaagaagcatttccaagttgatgaaaaactgtatacataataaacaggcaaatactagttagtttcaagttctatcaagttcatagtcagcaatttcagttttgtggggttcttcaaaatgttttgttaaatccacaacattgtttactatggcaaggaaaaggactggaaaatttgccccctgcttgttgaactctctacattcttatgataccacttgacattacttagttgtgggttatttaagataatcagttatttgttcagtgagacaacattgctctgtaagagggtcctgtaagactgggaggggagctcagtgatcagatattcaatcagatcttcttgcatttcccttagtaacatgatactctgggccaggctcattcctgtaatcccagcactttaggaagctaaggcaggtggatcacctgaggtcaggagtttgagaccagcctggtcaacatagtgaaaccccatctctacaaaaaatacaaaaattagccaggtgtgtgtggtggcacatgcctgtagtcccagctactttggaggctgaggcaggagaatagcttgaacccaggaggtggaggttgcagtgagctaagatcttgccactgcactctagcctgggcagcagagtgagactccatctcaaaaaaaaaaaatgatgctatcatcatcatcattttcatttttaaatatttccccaaacataaaatatcctgttttaactacttttaatatatcttgtaacttttttaaacctagaaatttgaaactaatggtaagtcactctattatcaaagcagtaatctaaaattatccaggaaaataatcttttttctgagatctggcacataataatttgctgatctaccaaagacgtatggattttaccgaaataatagttttcatgaggttaggagttttattttgttatcctttttgcaaaatagtacctttctttttcacagagaatttcttctcccattaatatcacggtagataactcagttgatggtgactgtcataatgctctttaagttctaagggcactctaagcgtcatcttggctctgacactgccaagtatgacttggattttctttgcttggaaagttcttgcatggtgctctctcaccacatattcccatcccctgaaattgcatgttttcattttcttagcaactttttctttattggtactcatcttataggtcttcccatttgttgggtttgatgtttggctcaatattgtcactaaagcaacaccaccagcgattttccaggccaaagtattacattaaacaaatggttccatagaatacactctcatggtgctgtagttgctttcattgctaagtctggttcctggagcaccaggcattagaccttaaccatgccatctcaacacagatttggaccacacgcagctccgaagtgtacacacagacacagtgcttcttttatactaccattgactaacttaacacgagttcccagagataagcacatcatatacaagagataaatggagtttgtggataatcttttttagttcaccacagtgtatgaaacagatacattatacatctgcctgcagggagcatgtgctgatgtaggaagacacacactgaacaagtaactgcaagttattgagtgtatacaaggagaggttgcgtgaggatatgtgaattcaggaggaaggaacctcacctgttgatgaacttaacttttcttcagaggaagagatattttaaagagacatgagagaaattccagctaaccagataaaaggactagggattgagaggcagagacaatagtatgggtgagttcaaaaaaccagaatgtggtattctacacaagctggagattttaaattcacaatttttgcatgtattttgcatagtaacataagacttcttgttgtaagcatttctttggctttcacccctgggatactatttgtgcctaggatttttgagaaggtagcaaaacatttctataatgcctcaactctctatagtgagtacattacctaactggagtgagatagtccacagatgatgcaacctttgcaagctggaaagcactttcctcttattttatcatggaaattaggtatttcattgtgacagttacatgaggcattatgttgagctgtcgctaggagcagttagtattatctttttgggctttaaaagcacagaaaacagttgggggaaagtggagctattttggaatagcacaaacaatctgggttggtcattgattttcttatgaatctcatttgactgttccagataaatacaaaatatttggagaataaaagagtacagattcatacgtatcactgaaaactgttcatcttaaagttcgtgttctttgttgtcatcattttcttgtaatgctggcagaatccagatgctcaggtcaaataagaccataagtgagaaataaactgtggtgacatttgagttgacagacataattctgacacgtagaaattattgggaagaaaaacaaaaatcgaaactcacaaatgagagcttaaaatgaggttatgctgtctacttcagaattattttatcacacacccagtacttttatgccaaatatgcctgggtttatgcaatttaaggacacaagagagaaagataagttcttcgaggctttccaggagccaaagtctggcaattgtaggtgcatctctttcagactgaacacatattagagatcagttttaatgacactttttggaaggatttactcaaataagtgattctccctaaaatacgagactagcttttgatcgttgtttttttttttttttcatttaaatttttttttcatttttaatttttttttgtagggatgggggtctcgttatgttgcccggtctggtcttgaactcttggcctcacgtgatcctcccgcctgagcctcccaaagtgctggggttacaggcagaacaaactgtgccctgcttaggttttaattcttaatggtcatcaggattattcggatagagcttccgattccctcatactttcctataaatcaacaaggcagagaagccctaaaatttgccttgctgctctacattaaactggcttcagatattgccggtgttctcccagtctgcagggtccctagaaatccacattcaatggttttaaattttgcaaatgttgcctatgggagggtggctctgattcccactatcaccagtcccatttaaggatttttggttttataatttgcatcatttggatctgtttatgtttggcagaaataaaatgtatgactttgaacaaataaaagcttagccactagaatattaacttcaatatctacataaatatttttcttcaaagtagttactttggaaaatgacttttaatgtttctggaattctgccttttagaagtggtgccagagtcagctcacaagctgcacagtgaaaacactgtcactgctttatagtcgaaacttattttccctataaatccaaacagtgtgccattcaactggaacaccaaactattcagtacctatggcaccaaattatttttgtttctatatgtttcttcttaaaatcgatcattctgaagtatcaaaatgtctcatagcttaagtatttataaacaacagactttaagaacaatttcaaaaaagttccccaaattgttttaataacctcagattctttacttgcataaacatagctggcaaagtgactccttgaaaaagacaacactcatttaagtgttaagctatgttacttatgttaaacttattaatgaataaacctaaggtcacacaatcatatgtcttaaaggcaatggttgcaacttcttttctcacttaccttagtacgaaaatagcatacattttttaatgtctgccctgtatcatgcactttgctaaagattttacataaccatgtttatttgtctctaagtttttattggtagtcattttgctaaaaataatgtggctagtcttgaagagatgttgcatagaaagatcattgtacaaactcagcttaacttggcttcaaagcgtatttttccttctaatatttgatggtaatgctgagagattttactcctctctctttccttccttgcatccatcctatcctaacgacaatagtgacatctgaggatgggctatcagctttcagcatttgcaaaccatttcttctgaaactcttagtacccagtgttttcaaagcaccataatgttaactttctcttttagcttttgttttgctcttttgattgcattgactttaaaaatagttttattgttattaaagaaattattaagcatatttttagaatcctattcaactcagaaagtggaaggataaggctagggaggaaggaggcaaaggaaaattatactggtttcaattttgaagacttgccttcctgaaacagttactgttaaaatgttagtacttacttttaatatttgcctctctacgtctatgtgtatacacatacacacacacacacacacacacacacacacacacacacacatatatatatatatatatatatatatatatatattatttggagtcttgctttgtcatccgggctggagtgcagtggtgcgatctcagcacactgcaacctgcatctcccaggttcaagctattctcctgcctcagcttcctgagtagctgggactacaggcatatgccaccatgcctggctaatttttgtgtttttagtggagatgacgtttcaccctgttggccaggctggtctcaaactcctgacctcaagtgatcttcacacctcagcctcccaaagtgctagtattataggcatgagacactgttctcagcctctatattcttaaataatattcatgaataggcatatcttttagatgttatctattgatttctattatggaaggtgaatattttaagttttctaccctcgcacttttctttcttcatgtgacttttcattttcatttgaggcataattaatatacaataaaatgcacacatctcaagtgttgagttcactgaattttgacaattttatatacatctgtaaatatcatccaaaataagacatagggcatttttattcctctagaaagttctcccatggtcctatacataagtttattattcccctctccctcatatacacatacaccattgtctgatttctaacaccattgcatagttttatccgtatttagatttcatataaatgggaatgaacattatttcctctttttttctggcttttttctttacactaaaaggtttgaggttcatccatggttgtgtgtgtaccaatacttcattcttatttttttgctgagtagtattcaattacataggcaagtcctaatgtatttatctactatctactattttgttgattaatatatgaacgctttctaatttttgactattattaataaaagctgctatgaacattcacagacagatctttgttagcacttatgttttcatttcttttgggtaaaaatgtaggaatagaattgctaggccatataaaaaacagatgtataactttataaacatctaaaccctagagtagttctacaacataactaaaataaaataccattttacaattcttccagaaatggatgagaagcctattcatcttcatcaatatttagtgttggattttaaccactagtcttaaatttctttatgtgtttcttgtgttacctgtttccctaggttcctttttactttttgcttgtctatttttcttgtaggaagcgttcctcagattctagcaattgcagactacccattcatatttaaaagtgaagcactaaaaatataattgaaaattgtgttagtaggcaacattactaaatgaggtttcactttagaacaaccaggtgaccatctggcttttgaggatggtctcctaaagagcagctttttaaagtctttactctggggtggctcagatttcccagagaaaaaaacacatcctcttatctttcactttggatctataaatgtggttcccaggttatagagcccggtggataaagaggtataggatttctgttctgtatacagattttatttttctttttgtttgccgtctcaaaactctgtcttccttttctgtggatttgttgtctccaagtctagggattttaaggttaagttctccccatgtgatacctattctctcctgtccaggtagagaaaacccactaagttgacgtatgtggtggagatgggaatagagagagcagggtgtgcctaacacaaaattccgaacaattgtcttgttttcaacccctgacttactctggtcttctgtattatcaggctgtcctgggatctgtagggtgggtcctttgcttcccaaccatgtcttaccttagtgtccttaggtttgtgctttttcagctctgctgaaaaacattctctacctgtcttctcttcacattccataatccttgattatgtgtgttttctactttcctgaaatgtattgtttttttctcgatttctgtgttttgggggcttaatgtgtttccaagttttaattgtacacgggatgttcagattacactgtacttgaggcttgagggcgatcgaattagagaaaaactgtatttgctgatgaacagcaaatgtagtgtttctgaagagttaagcctaatggggccatttagttcattttcaagaatgcttaaaaggctgcgttagaaaataacacaaaggaacttcagaacctcagaatagggatggcacccagactctcttcatcatgagggttttgagggtaaaagttcaaacaaaagatacattcaccttttaaaatgtaaatgaactgcaatatcagcataattttcttgtactatctttgaaaaaaatacaagcacattcacagtttttctttattctctcaagaagggctttgaaaacccataattatagaatttattaaggaaaaataactaataaatacttctggagaagaatattcaaaagcctaaggattgctagacaaaatatctcatttttagatcaaatcttggaaagatgcaaaagttgttaccgacaaagataagttataaattaagcatattggaaacaagaggaaggataaaacctgacaaattattgatgttgcaggaggtaaccaaggaaggctgtgctcaaatggcactttgatgacctggctttgtgtgtgatggttgatgtgcgggatcacaggaaaaatttcccgcatatatcagtaaacatatataatcaagaacctatgacatgcccatcactgtgtaggctataaagaaatatgagcacactcatgatttcaaacaaggttactttggtagaaaagacagtcaaataaagagatgacataagggaatagattctgagtgccaaccaagtgatacagacagtaagtgtcaccttaactcagaagagacagagaaaatcataggtaggtagagaattgagtcagcacagcaaaggccgaatttgtcttggtcttaaaaataaatcggtgcaaatcaaaatggatgatttaaattttacagcctataatggcacttggcaaacatggtatcattgtctctaagtgatttttttttttttttttttttttttttttttagctatattaccctttggctaaggctaagacagattcttgcagttcattattgtttagcagatagcaagctttttagacacttttatagtgaaagtgtgtcttctcgctttatttatatacttatagaatcatctttgaaggcataatcaccaactgccaaatttgaggaccttggcagatggagacagatttcccagggaaaatttgaaatggcggggagtctaaccagtgatgtgctgataagaaaaacatccctgatttggagaatttgccagtttctgtgatacaaatagtctcacccttgccaatttcaagctactaacttggggttattgaatcctgacttggaaagagttgagcatgatgagtcgacctgagctgctgtaggcttgctccagcacactgcggaagctatcagacattcacatttcatctagaaagacatggggagggatgctgatccacgcttaagtccttcccctttccattctgatcctcacttggtcttccaaccattgttctttttcagatatatggctcttgtgacaagattataaaggtcaaagatgctttatcccaatatgtatcttattcatttaggctgtcaaatataatttagtttgttatccatagcagcagtgcctcattgcttgagcaggcatgcggcagtgatgtgaagagcaggagagagtggtgtcaggacctgaaagggtgtgcacctgtggagtagctgtttattaggacttgttcctgatgcaagcatgtcaggccagggttcatcttccaaaaataggggtagcaattccagagtcctccactgatttatggagaaggacccatcattctgtaactctgaaagctatgccaagaacaggttattcatgtgagacttcatttcctttaatggatctgggacaaaacttgtagtcatgtttacaagccatgagtgcctgcaccactgtggtggcatcccaatactaggatatttacctagagctatatgaagcagaatcatcaaaccataagtaagaatcttgttagagtttgtttagccacaggcctactattagggaagtactaactcccttcatctaaatttctacatactctaatagtcttcttagttatcacatggcattgaccattttcttgttgtctgtattagctcctgctgcaacggcagttatgaaatctgactgagtttgtgccaaggcacagctgttctcactggtcttgcagatgcccagcaagttgctgggaatacccagatgaagcctaaagctgctccagatataaaactgtccacactagtacaacttaaatgtagtacaaatgctgtaagtttgcaatatccctcagagattttaatggaaaatccaagtactgttttagtttttttccttttcttttgctgataaccccttttacaagatttaaagatgagtccacagggttggactgagttcagtggtaacacattctctacccctttgccctgagatactttcctagaatcacacatgtgtgttttattcctttcttgggagtattctggttttgatcccttaacctattcaccaagggagctctaaataatatcatccaccactttcatgggccactcacatttcataaagattgcaaaagagataaaacagaaaactattagtggtacattagctacaactcctttctcttccttttcactgaacacagtgaacagaaagactcattggcttgagagccactgtgctgaaaggcttgtttatgagttcccaacatcttcaaataggaaaccactcaagagaagtccagataaaagtcaagggttagttaaagccaggagatacaacaataatgccagctatgaaaagctgagccaggtcatacaaagaagaataaaattcagagtttagatgttggaattaagaatgcatgtcagttaggctggaaaaatagttgagaggagagaccatgaattttattggagagcaagagactatttttatggagtaccagctaggttaatggagtcagatggggtgggatatgtgaactgtctagaattatttactttcagccagtcatactcatgactgcaaaaaggacaagttgaggctgtgcctctctttagaatgtctgcattttaaatatctatttacagcaaatgatatgttgctgtactgcaggtttattagaacactagcatatgtgttgacaaggcaaaggtatgttaaatatctttctggagagtcaatcctgataaagcaggacatgcacttaattatagtcatttaacagtggcttttctactttaattatagttttatataatctatgcatgacaagtctgaataataataaaggaggaattataagctgaatatggagaaggttttggaccctgcctgcttctgaactacactctcaatctggattatatataagcatatataaataacatacactcctctcaagaatgctgcattactagagccttacactgttcttaaatatgaaggagatttgttttcaggttattggagatacagagattcacagaactgccttgagggacacattttttatgtacaaatatagcttttacctagccagttggtaggtcaaaacccaatggcccagggaaatggtttatctcttagctcagaatttgactctgtggtgggtagactatagttaaaagaaatgatttttttgacattggtcagaaagttatttccttatagtgacttattttgtccattcacttgtacctagaggttttaaaagacagacacattaaacctgtggctagaggtggggcttacagaagcaagagtgacagtcttcaccatcaaatgcagttgacgtttgcaaatgacaggagacaaactggaaattgtattccctcaattcctagcagctgattccgactcattcataccaatattgtaactgttgtcactcttcagagtccctctgggacattagtactaggttgtcagttgtcctgtagttaggcatctatgacgtgaacaccaataggaacctataattgctagaaactcttattcatttgttttagtgtgttgaaatccattatatttgtaatggattttccaagtctcactatttgccagacaccctctctgcacccttgcttctcagcttattggaacagactgacgggaaaactatgccgctctcttggtttctagggtggaatttcaggggagaatgatgggagaggccaggtaataaaaaagcctccttccagagatgatataacttggcagccttaagctcaagagatggaggtgggatcaggatgaaataagagcatgggaaatcaggattcatcacacaaataaattttccattaatgtttgtggattaaggataataagggaaagaatgccagcaaaaaacatgtatattttatgcaggaaaggcaataaaatttgatattttgatttttacactccttatcccacatctgaatataattgtctaggattgcaggaattattttctgcaagtgttgctggtaattcttcatccagtcttcttccagtgtgggtacagttacgaatattgccacctagggctgacagctgctttcaactggacaaggttttatggtttctttgtctttcccccaacccacaaatgttctcaaacctcttgcatttatttatgttattttactttgcatgaatgggggaagaaacagtgttcagcaattcaatgatggctgaatggaataacagaatttcatttcctaagggaacatttgagagtgattgaatcaccctcaatctacaagccacatttttgcactatttttctacttgactaattgattatgacaggtgtcacccaagctttgcagcttaggctgtccccatgctaagacagagccatagcaagcaacttctattgatgaaatagaaaagctatgcatggttatttttccttattgattttctagtatatgatgtcagttaattactgagagccattcactgcatacatgtaagtagtcattataaccatattttcaattgattttttccctacaaacataatcagttatttgtttgagctgaacagaaatgtaaatatctgcagttgtaaaaaaaaaattggatgtgtgtgtgtatgtgtgtatgtattatatgggtatattctttatgggcatgtgattttatctatctatctatctatatatatatacacacacacacacatacatgcatatatacacacacatacatacacactagatataatcaatattatatgcccatcgggaatatactccctgtaacatatttacaggtgtgtttgtgtgttgtgaacagagaaagaacagcacatgtcatggccatgctaacaattttggttactataccaaaagggagatttctaaagtattgagctttaagtatattgcatttttagtttcgcaagacaatgaaaaaattagcctatctaccttatgtggagggaaagaagccagatacaccaaaaatttatttgtataagtctacttatataaaattctaggagatgacaactgaatatatagtaacagaaagaagatcacaggttgctaggaactggaggtggcaggagggatggaccacaaagggttatgaggaaactttagggttgataaggtatcttgtgtctcttgcttgtggtggtgattttttggttgatgtacctgtcaggattcatcaaattgtgtatgggcacagtttgttgaacagaaatcatgtcccaataaagttgttttaaaaatgaggaaatgtatgtctcagcatttgaacactatttggagaattaccacaaattttccatgtttctaataatattaaatcatttctacatatggcaggaacttcatatttctcagaatatactcttggaatggaagtgattatatccatgatatatattgaatgtccaggccctaaagggccattcggaagacatttgagtttttttctagttgacttgataatttctacttacctaggaagaggagagcaataactaacctttgaaaatttctcatattgacctacatgatagactgatatattcattttcaattagtgtataacaaattactacaaacttagcaacttaacataacacacatttattatttcaaaatttccatgtgtcaggagtccaagcacagctttgctgaatttgaggtctccccaggctccaatccaggtattggccaaggttgaggtctcatcagaggcttgactggggaatgatccacttccaatctctcagattattggcagaattcttctgcatgtggccataggtctgagttccccatgtccttgctgactgatacctgatgactatcctcagaactttgaggccactcagcgttcctggccatgtagcctctccataggaagctcacaacatgaaagctcacttctttgggatcagcagaagctcttctttcagtctgctatgacatagctttgtaaaatgttacttaactatgaaggtaaccacctttgccatgtaatgtaatctaaccaagagagtaactgttttataaattttgctatattgtattgactagaaatccaactgtacccagtggaagtacagtcatcttagatggcttgggccactttagtgcatatctacctcagttgttttatagaggacccttgaaataagtaactttctaataatatatttaataaagaaatatttgaataaatttatatacatatacttaataattttagcagaatgtcattcaattttaaataagcaagaataatattactatttttttttcaagacaaggtctcactctgtcacctaggatggagtgcagtggcatgatcatggctcactgcagttgctgcctcctgggctcaagcagtcttcccacctcagcttccccagtagctgggactactggtgcatgccaccatgccctgctaactgttttttttttaaatttttgttttgtagagacaggatgttgcaatgttacccagggtggtcttaaactcctgggctcaagtgatcagtccacctcagcctcccaaagtgctgagattacaagcatgagccattgtgcccagggagtagtacttttaaaatctggtctaatttatactggtttaatttttataaaaactctcaggaccctacctattgtgtcgtcagggatgtctctacatggtgcaccaggccatgaaggagttaatgtgcctctctaatgctgtcaatttccatcttcctcgtcagtaaaataagacctataatttgcaaaatgaatccacattcttgaacagtgactgcattaaaaaacctgagtattttaataattagctattcaaattatcttatggttgcctactattcataaagtcaaaaacataatataaaataacatagatcataatattagttacagatgtcagcttacttctatttttctgaagaaaaggtgttaatgaatttctctagaatgatttctgacataattgccaggattgtacaatatatcattctacatttatgccagcaaattagcatctgtgattcatacagtggtagctttcttaattttatcatgtacaaaatacatgttgttttgatttttcaaaataactcatggctctctgccttgtagactgaagagaatttacaattttgtcgttgaattggtgaatatttcaaacaatatgacagacactaacaatatacccttgggtttacagcagaataaagctgctactctgataagctaccaaatactgtaaatgcatcaataatttcagcctgaaaaatattacttttttaattgatgcatttttctcatgacaattatacaatacttagcacgcaatattcactttctaataccagaaaggcagctacagatggtgtcaatataaattgtttgtaatattctctgtgtttgtacgtactatatacactatgattacatccaagagctcaggtttgcagaccttttctgcccttgtatttgtgaccttgggtgtacttctgcactatccaatgtctctcataatgcaaaattacagtaatatccacttaatgttcataggctgctttgtacaattacagttacacagcgatcactcaaaacacagtgataatacaattcctcatcaaaataaaccattactggccaatgtttgtgactttttccggactaagccactctcctggggctggcaatttatggtgcaaaaagcagcagaatgtgctatttataattatgcagctttcttctgggatcagaaaatcactggacctcattcctaccttactgaaagaggaaatggtaatttatgttgtgttatttgtctttaaaatgaggaaatagggtcaaaggaaggataaagtgtccaatgtcatgcactggtaaaactggaattagtagttaccatctcatgatctgatttctagttgtttgtttggttggatttttttctttgttgttgttgtttgttttatcttgaataccttttttgtttaacaaaaacttattgtgcacctgctatgagtcaggcattctgtatgtgttttataaattttaactcagttgactttcaagcttaggagttagctgctgctattgtcacccacattttataggtgaggaaaccgagacactgagaggtgaggcagtttgtatgaggacacataactggtatgtggcagaggcagtttggctctggaatctacacttaaccactgttctttgccacctctccttctcctgtgtgacttgtctttatcctccaggtcagaaacgcatcacataaggcctatttcctcccaccatgatcactagtgcttatactctgtttaccatattgagtcagtcaccaaggaggatacaaataaagaatgtgagctccaaaaaggcagacggtatttatcttgcttactgaatccccattacctggaacagtgcctgatacatgaaaaatattcaacaaaaatattttgcatgaataaatgatcagatgaatagatagataaatggacagatgtatgagatagatatgtaccttgttttaagggagcttttagtttaagaagacaaaccataattcagctgaataaaacattttatgattttttattcttttcatatccttcaaagagtgtttctataaataaaactatttcagtcttggtgaaacagatttgctcagttttaaaatatatattagaaaaacatatgttaaaacccaaattaaacaagcttttatctgcatggctcagtgtcaactcagattaatttggtagaggtgaaaatgaattctttcgcagaaattatcttgccatattttaggatgatgtttccgtatgggtggcatttttatgagaggaaattgagagcagaataacgaatggagttgggagaatattgcaggtgtcttcatcttaaatatgcccccaaatataatagagtctgcacagagattacatgctggagttagtagaaaggattcggtagtttgttttcatatccttatcatttaaataaaacattgtcatgtttatattttttcactgtaggtcattcaatttctctcacacagagaaatatgccgaagtagggacacattcaggaagggaaactagtaatcaagagacaaaaaattgatttttgtataaagactaatatatgctgagggaaaaagagaaggaaaatgtcagtgtgtggtaatataggaggtttgagtgattgattaaagattggaaagggaagcccgacaaagggaatttcatcaaaatatataaaaccaaaaaagacatgataggtggctattgatttattcaataaattgtagtatccttcaccccaagaatctactcaaactttagaagagtttgttttaggatgagttataaataaattcagataataaactcagcgagaaatttaatggcacaagaagttcctcaataagtcattaagataagtgatgagaatttcagtacacatccctaaattttgcagttggtgtcagagtcagtcaaatgtttataaagcatgaatcctggttaaaaaaaattatgtcagagaaaaatctaccatactcattgattattgagtttataactagagctttcttcatgattattattgagacaaatgatgatgaaagtccctagcgacctctgtttcctgtttgttaaagggctaaaaaatagtgaaatgatttgaatatagggaatgggaaagtaagagaaccactgtgtatgagtgggtatcctccaaaataaattgggctatgtttctgagccaatacgtatgaaacaaagggtggaccagaatatatgtaaagtgaaatttaaaattatttatcataatcgttaatagtcaaagatggggaaaatccaggaaggcaaaaaagttgaaactgctagcgaaatgggtttcccagattagccagaatcctaaattgccgtaaaggacacactaaattgtctggaagttcatcctaggttttagtgatctgtgatcattttaccctggactagcatgaggagcgaactatgatgtgtaagattttggaaacactatttcagctgactggattttgtggattctttcaatgacacattcctttcatcagagtcattggtatatactcttcagtaatttttatgttttgttttgtagctttcttgtggtacattgttctactgctcacttcttgcctctctcctctccatggttgtgtgtttacaaaaaaatgaaacttcccacccgcaattttgaattgtattgtcctggttatgattacttttcattttcttgtcatccttgatactgtgaccagtctttctcagggaagtacattgaacaccaagctacctgtggtatgtccatatgctcatatgctctgaaacaaaccctgtccaacatgttgaattcctttccctaggctctgcctaagtgcaagccttgtgattcgcttagtccatgccctctgggaatttgctatgcccactggagcacaactgtcttcccaccctgccacctttaattttattagctattagctgttacctaagttgaaaaatggaatgacacaggaatgtagttgaaatccagtgcattactccctaggatgaaaaacaaagtagacacacaggctgactggtgccaggtgatacaaaagcgtcagcatgaatcataaatgctctggtggatgacacttctcagattgatggctgcagtctgaacgctttgtgtcttgggcctgtgtttggaagtcgggtggtgcacattcttttccaccctttagaattaatcttttcacactggctgatagatgttagctacaaacacagtaagaatcctaaaacttaacactgtcgttgttcctttttttaaataagttctttactcagaaacaaatgatgcactcctaatagataaacatccttttattatatgtcttcatggagtctactcttttttagacaaacactagtgctaaccacattagcgctgatctttaactataatttaagcaacagtccctacccctctttaaaataaacatttttatatattgtagaataattttacatttacatgaaaattgtaaaaatatagcagagctcctatataccctttacccagttttccactgctaacgtctcacatgactgtgtatttcaaaactaagaaatcgacgttgctatattactgtgaactacagtccagtctttatttggatttcattaggttttccattaatatcatttttctgtctcagaatccaatcaagggaacctccttgcatttatttgtgatgtcttcccagactcctttttctgtaacagcttctatctttcccttttttcttgaccttgactgtcttgaagaggattggtcaggtatctcaatctgggtatatccaaagtttttttcatcctttagactggtattctttttggaaagaataccacagaggggaagtgtacttcttgccacataatatcaaggatacgtgacagccacatgacatcactgaggataataacttttaccactcactaagtggtggctgagttggccagggttttactctgaaattaatattttttcatctccatactcttttctttggaagcaagcatatcaatctagcccactccccagcctcctcacctctttttttaatggctgcaatcaactctatgactaagatctaacatgattgtaccacattctgtgttaattatctaatacaactctagatagttaagaaggcagtatagccagtgtgctgacagctgtatagcagtgattcctccttttgagaatacaggttggttgcccagaaagagtttaagaataaaactcttacaatctccagatttcctatcccttacctctacccaaaagaattagacaccagaacagatagtttacgtgtttggctcatgacatagctggatggcagagaggggtgaagtcacctctggttcatcttgaggatttttgtcttattttctagtcatcccttagtgaatttctttaaatatcatgttatggtttgtgttcagaccctagagcagcaggaaaccagagacaagagtgagttaggttttgtaactctatcttcatgcttattgcagagtagctgcagaatcgcaaactacatgttatagtcagtaattttaaaatgtttcaggaagcgtggcatcaagttgtgaactttacacaggtaattttttccttctgtcaaaatatttacttatgaatgtgttatataatttactttttgctttaagtagccacaggtgcgagaatgattgtttccatcccatttgaagcttaacaaattttcacactttgaaggtgaaggccacagtgttttgtattcttatgttgacatttattatactgaaataattctctttggtggaattaataattacttggaggatgaagttacaatagaatattcaaagatattgaaatgaaaggtacatatgctgaccctttctattatcatcttttctaactgtagcttacttaccaccttcttctctttgaataggttgatatgtaacagctctgcatattagggatgttaatgcttttaataatatggaaaatgtctcagattgtcattcatatttccatctccctattatgtttcctcatgtagaagtttttgtttcaatacagtcatatttatcaatatttcttttcatgggttctggtttttacattttcttagaactcccttcccatttcaatggtgtattagtctgttctcatgctgcaaataaagacatacttgagactgggtaatttataaaggaaagaggtttaattgactcacagttccacctggttggggaggcctggcaatcatgatggaagagcacgggacatcttacatggcggcaggcaagagagagcttgtgcaaaggaactcccccttataaaaccatcagatgtcatgagacttactcagtgtcatgaaaacagcatgggaaagacccgcccccatgattcaattacctcccaccaggtccctcccacgacacatgggaattgtgggagctacaattcaagatgaggtttgggtggggacacagccaaaccatgtcaaatagccaatatctattcacttctgaatttccaatatatagtaaggtggtgaaatagtcaagtcaggggctggtgccatttgttttcctttatattttgagactgtacgtaactgaactcaaggtactttatgggcattatccactgtatttgtgtcttgatggtcatgtgggagaagagggaagtttttacaatgttttcagtttggaagaaattcaggaacaggagataatataataaggtcatatcatcaaattttattgcttttatcccctaattctcatctttttctgtattatgctatctttagaaccagtgtgctatatggtctgagtgtttgcgtccctctaaaattcatgttgaaacttaatccccattgtggtggtattaagtggtggggccttttgggaggtgattaagctgtgagggctctgctttttttttttttttttttttttttttgagaccgactcttgctctgttgcccaggctggagtgcagtggcgcgatctcggctcactgcaagctccgcctcccggttctcgccattctcctgcctcagcctccctagtagctgggactacagtcgcccgccaccacgccccgctaattgtttgtatttttggaagagacggggtttcacagtgttagctaggatggtctagatctcctggcctcgtgatccgcccgcctcggcctcccgaagtgctgggattacaggcatgagccaccgcacccagcccagggctctgcttttatgagtgcgattcatgccctaaaatgggctgaagggagctgtcttgccctttctaccttgtgaggacgcagcaacgggtgtcatctatgaagcccttaccagacatcgactctgatggttggtgccttaatcttgggcttcctagcctccagaattgtgagaaatatatttctgctgttgatagattacccagtcaaggatattattatagcagcccaggtggattaagatgcagctattacttttagaactggatagtgaatctgtcattgagttccaaattctgtcccaaatttggatgaattgttttcaactagaaaacaagggggaagaagagagaaagaaataaatagaaaaagaagaagtaaaatagagagatggaagctactgttgcttcatagcttgatagagccttagtagtgattttagggactgatgtacctgcacctggaaggtatttaaccagctgataactggaagagaatatagtcctttgtacttttataacaaaataccacagactgggccaggcacagtggctcacagctgtaatcctggcactttgggaggctgagatgggtgggtcacttgagaccaggagtttgaccagcctggccaacatgatgaaaccttatctctactaaaaatgcaaaaattagctgggcatggtggcacacacctgtaatcccagctccttgggaggctgagtcttgaacctgggaggcagaggttgcagtgagccaagatcatgccactgtactctagcctgggtgacagaacaagactctgtctccaaaaaataaaaataaaataaaacaccacagactgggtgatttatgaaaaaaaagaaatttatttcttacagttctggaggctgggagcacaaggtgaaagcatcagcagatgtggttgtctggtgagggctgctgtctgcttctgggatggcaccttgtggctgcatcctctatggagcaggaagttggtgtcctcacatggtagaaggaatggaaggggcaaaaactggggcaaactctttgccaagtccttttataagagcaatgattcctatttacgagggcagagccctgatgactcaatcacctttgaaaggccatacatcccaatactgttgcattggagattaaatttcaacctgaagggtagagggacaaaaacactcaattcatagaaagccttgtctacaaagccaattctataattctttttactttattcaagaaaaaaaaggtcactgattatacataccacttacatcttgatgagaattagtgaacataggaatacctgccaagcgtatgctttgcctcagctacaatagcaacaaggaattaaacttaaaatagatacatttgttatggtggatgaacatctgtatcctatgttttagtattccacatgtgctgtgttatagtttgaattaatagatgtattgatcaaccataattcaaatcaatatggatctttaggtaaataatacatttaatgatttttttaaattaaaaaagacttttaaaaagacccatcttttctagaggaattaatattgttctatttagagtgaccagggggaatactgactttgatgcacagccacaatttatgatcatataatgtgttttattaatcatctctggtgattattgtttttattgtcctactttatagatttaaggtgtaagtactaggttcaggtcaatatgcctcttctatggttgatagcttagatatcattttcttcactgcagtacattaagaaagaaaaagaatgagctacatgagtgatgactcagctgtggttgcaagtacatgctcaccgtcctccttctcagaaagaggactagaagtagtcggggcctttttctttctctctctctcagaaatatagaggcctggatggtcatacctaaaaacaaaaaggaatctaaggaaacatgcttcgtatacatattatgcccccttttgttttgcagtgacttcataacagtggcataatactctacgtctatgaacttaattggaataactaataatttatcttagttttataccctcttttatttgcttcatttttatttccctttaatttgttttggtggctataaaatttagggatgggtagcaaggggtaagagccaagtgcactgcacacaaatgcttaataaacctcactgccatacacagccagtacattcttggcctgtggtgccacctcacacacctgttattatcctgtctatctgaaacacagtgtttagtgaacctgtcattctgcaactctgattctcagataattttttttagattgaaatgaacatatcctagaaatgagcatttccacagctatcctgacaccatatccttgagtaaattattttaaaatttattgtaagtcctatagggagagttggaagttagccatcaagtatgattggagccattttaatgagttgcctagtatcctacaatggtaaaaagagctcttaaaatgacctacattactaaagagagtagcttaaacctttagttcttcttacttaagttgtattatcttccatgtatctttacttgagtttctcactggaaacatttagttgtttaacacacacatacaaaattaaactccctagcattgataaaattatttttttccttaacaacacaacttgtcagctattttactttagtagtgtctcataaccaaaggaaattgcagggagaaagcactgattcttaaagcctgacatactgatctatatcagcaacgcatgtgttctttagacgttcttcaccggcagaggacaggattgcctgccagcctgggacaaagcaccatatggctgggatgaggggaaggatggtgatgcacatgaagggtgggaggggagctgtcacagcctgtcagtctttattcccagaggaaactctggtgacaagggagtgattgaaatggcacgtttggggtctctgggcatggagaatggataaacaatgactgggaattcaatgacataaactcaagggaaagggtggaaacaaagcgagctgcaattgggtagaagcataactctcctgtagttggggaaagatgccaggaagagacattgatgagaaagatgattaaaggtggcctcacaaagccttggaatagtgacagatggaaagggtgcaatgattagtaagaaaatacaaagagaaaaaagagacctgaaatgaaataaagtcttataggagcagaaatatggaacaatacaattttttaaaaagaaaatgaatgatagatttttctctgcaacctgaaaagttaagtagagaaggatgtacaagtgacgacgtactttccttccacagacgaagcatgcttgtcctcaacttacttgatctaccagactcaaaactagctcagaacttcccaatgcctttttttttttttttttggacaaagtctcgctctgttgcccaggctggagtgcagtggcatgatctcggctcactgcaacctccacctcctgggttcaagcaattctctgcctcagcttcttgaatagctgggattacaggcaccccccaccacacccggctagtttttgtatttttagtagagatggggtttcaccatcttggccaggctagtcttgaactcctgacctcgtgatccacccgcctcggcctcccaaactgctgggattacaggcatgagccaccacgccccgcctcccaaagcctttctatgagagttcctacatctccagacagccattaagaaactggacgagcagaaataggctttctgctctcaagatctaaagatagacaaataacaataataacagccgtttattgaatgcaaatcatatgctaggtatggtgagcagcccttagactccacttctcattatcacttaacaactctgtacactaaatattttgtatccacttttaatgtggaaattaaggcccagagaggctaaatacctttccaaataacacagtcacagagtttggagtagggagcaaggttcataccatttaattgcagttcgctagtcaaatctatttatttacatacatgatgccctagccacctcgccaagctgcctgtggtacttgctgtatcttcataaactctttaaaaggcactttcctaaataagcaacttggaaataaagaaattattaaaagcatatgatatatgtttttacatacctacaatgtgcagatttgagcataaaacctttagttgctcacatattggttggccagtttatcagataatatttttctcctccttttttctgaaaagagctcaaactctgagagctatagttatcgttgctgagatgaaaatacttcccgaaattagtttctcagtttatctctttgtgtggccataggaaatcctttttagcatacaacttttatttggccatactctttgctgtatgattctgggataagaatcacactttctataacagacccgtaggtccccttctggatacaaggtcagcccaaaccaaattttcgagcttcctttttgcttcttaatgaaagcattatttcccttaggaagcatcgttatgtgaacacacctactttgtttggcacaatgtagaaagcttgccaccagggcttcctctagggatcaaggctgacaaactgtgacagagcaggctgtgatatatttccccttctccatttggttcaaaataaaatgttctcaccccaaacctgcatttccttagaaccttcctctgagcttggtttttcattctactttgtaatttatctgcaaattaataataatgaacataactagttggcagtaatgctcagtcttctcccagtgcatattctcaagcaaccactgtacagagttctgaaaaggagtgttccagccaaagtcttaacataatctcacaaatttgcaaagccttccgtttagctggaccctgcaataatttaatgtatacctgtgatatggctaacatacactgtgataatgatggaggattaaagtgataaacagtttagacttggttccttctttcacagagcatacaatttgtaataggatcacaacaacaataacaaaaatgaccggattgttggagtccagggaagtgccctgacaggagagtttgtcttgtccagatcctgtgaacacccaggtagaggggcctaagccaggctggagatcagtgaggtgacactctaactgaaacctgaaggaggcccccacgtcagggcagcaaagcaattggaggaaggtattccagctgagtttgcagcacacaaaagtagcagaggtgaaagcatgaggtcttcctggaattgagcaagttcagcatggagaactgagaggtagcaaggaggctgttctgaaagtaaagtctctgcacactcctgaaacctagctccgcactctcagagaccctcaactgtatctttcaggcttagatccttcaggccctgtcatgctgaagacaactgagaaagtatagctgatatggaaggagtaatgttggaggtggcagcaaatgcatcctggagggtcaagccaagctgagtagggggtatgaccaagctggttttccctctgggatttgaaaatggattgaacagcttctcacccagtgccttgcacaaagtatgtcttcaattaacattgaatggattaataattggatgcataaattcattttatcaaagagtacatacaaggtatgattcaattccatagcactattattatgatagttaatgtacaaattaaataggtatctggaaacagaatagaaatcatttagtgaggtggtgtgttctaatgtctaaataacttttctacccaaactctagaatggaactcatttgtaagcaagtgactgtctctaacttttccatagtcttacacaggtacatcttgagtcctcaaattaattgcctgttctctaaggtcaaaactcagggcttaaaaataaattattattagcttcatgcgtaacagtaggaacatgatagatattccatcaatattcattattcatttttatctaaaatgtacctatccaatacattattttatgtgtgtgagataatgcattgtcaattagattttaccatttcacaatgtatatatgcctcaaggtatcatgttatacaggataaaagcatacaatgttatctggcaattaaaaacaaataaataaatgattatttaatgagattttatggagtacattaagtttcatctcattaagattaaaaatggtttcaaataactattttataaaatctacatttcttactttttctaaagttcttaatctactaccacaaaagtcatgattctttccattttgaaaataatgtaacattttagaaaaaatattatttcattttaagttttaattatacacaaccatgcttctttttttgataattttatgaaataactttatgaactgtaaaaacttaactatcatttaggtttatccacttcttcatttagacaataaaaagctagagtttagtgtcaagggaacaacaagaaaaaaaaatcaaaaggagaaatgatagttgtttgctcttaggaaaattaagtgtttctgttatttcactgacaatatctagttacatattatttttattaaatggtgaagatgcagactaataaagcagatgcagctaataaagcagctagttgatttggtggctacatttgtaatattttagtgagcaacatggggaatgaaacaaggaaataggtctattggcttgtttgaggtttaatgtaaattaaacatttttgttgttatgagtaccccttatctttcatatacatcatagggaatgaaggtagtggactatcaataagcttagaaaaaaattcatgttcataaacactgtataataacgtgtgacagaaaaagtccttggtatctagaaaaattgaagctttatttaaaaaattaatccaatagcatcattgttaccaaggctattgcaggggacctaaacaaaatattattttttggcttcaaaactatgaatatttggcttttcgttatctataaaaattatcaccctttcctggatttggctattattaaaaaatttttaaagatgttcttaaaagaaaaaaaaagactgtcattatagtgtggcaaattcacctcctcttctccatgacaacagataaagaagctgtagctatagcaacagtaatgggccagagagattagggccagactggagattaggcctccaagagcaaagaaaagaagtcctgattggttctttattgagaccttatttgaaggcaagttactgttgagagaaagcatggaggattagtaagaacaaaattaattcccctgtataagataagaagccattcctttgttaaaactgtgttcctccgttttaatataacgcctgtttaaactgaggtaaagagtccgtgattaattctatgctgagctttgtgccatctgagtctagaccagctctgtgagaagacactccctgaagcctaaggagaaaagagggaggagcatctgcctgcttgccattgccccttgccctcctctctggcactccctgggtgggttggagatgccaattggtttgtgatgttgacatcatgtaggagtgagatgctcttggaggaaaaagattggaaaacttccctcttgttcgtataaaacttatttgtctaacttcttgaaaatttcaaaaagctttcaccaagttataattaattatatgtttaaaaatacgtttctcaaaaatctagtaatgttcccattttttaataactggtaagttatagaggtattacattttgagtaaatgtgctatctataatttcagattgatatactgatgaaggagggatttgttattttttaaataataaatttataggaatgagaatatctggcctgatgctatgaatttttttaaaaggattttgccacatttacttctgaacatgtagtgctcacacacacttcaactgagagcctgtgagagcgccacaccctggccgacatgagatattcaccttctttaaagtggtctccgatagaattttttcagactctgttttaatgtgtatttcttgcattatttgtcaagttgaaccccacttttcaataagacgatttattattttaaagatttaaaaacatgctttttaatattatgttacttggtttttatatattttctaaatactttcagtcagtctttccacgggaaacaacacctcaactaaaccaagagggaaagtaggagttatacagatgagtgagaggggcttgttaaggtttgggatctgcttctgtgaaggcctaggcaattgcagggggctcagcatgaggagaacatacttaatatagaagcatcaagaagccaaggagcttccacataagcaccatgagaacattggcttcgtctgttgttccccactctctcttctgtgcttagacaaggaggacaggcgatctgagctgttcgaatatttgctgagtgagcagagctactgaacgttgctaactgtgcacctctgcaagcctctgcccgaaggtattttctgtcttgctgtaggaacacactaggccattgtttaggaaaggcaaatcccctggaatcaccctcaacaaatgatggagaaggagtaggtagataaatacccctatccactactctgagggatgaataactctgaggcatgtcctgtactgactcccagagtccccgatgggatttgcccttccgtttcccacaggtatagccatatagataatgcactcttcagataggtccctccctgccctgtctcacttcctgattctctgcagtatttctgggatcatctcccaaatgtagtacttgaacaaaagtcctcttctgaagccttgtttacggagaaagccacccaagacccatggtcagcaggagtcaggccagcaagctaattaagaagtttgaagcttgccctgaagacgatttgtggaggaaaaataagtagtagagtgacacgaccagatttatatttttataagctcattctggatgctgcacagagaatatatttgaggaaggtgagtttaaggaaggcagaggagctgggggacacttgtggtaattccagttagagagtgcaatggtgtcaatggaagcatggcagtggagacgcaatagtgtgggtagattaatgagatgttcaggagcggggaaccctagcatgcggtgagtgaaggagagtcaggaatcaaggatgggcttcgggtttccaggctgcacagctgagaggacaacttgaatatcacccaggaggagaagcaggctgagggggagggagagaataaattcactccagtgtgttagtcttagctgcctgtgatgtgtggaagtaaaagtttttgtcaagaagcttaatatcactcatatttttgagagagatacgccatccccaggcatcaatcttttcctctccctcaccactctgctataaaagattgactaactcactgccactcttccatttatttaaaatactgtactgatccagagagcaaggcgaaattttatctacaaagaaatagtcaaagaatctatggagtcagaaataactttgaatactttttttttttttgccattctttaaaacctctatttctctgtatagctagtaagaattgtatatcgataatgtttctggaaccattagaaaatggggtatttccactacccagatgaatttttctagctagcagaagtttaactcatggcagtgataccactcagccagtcgctatacaaagtgaatgcaagaatgaagactgactttgataaagactagggaaaatggaccacaaaagccggtttgaagattttatatccgcaaatgggtacctgtgatttgtggctagagatcacctgtcgagatgaaacacgtattccctagacttgagaactttaacaaacataaagaaaacagagttatcacagcaaagctgaattatgaattcacacacacccaagcagacacacactacaaaatatacatgcacatatgtaatagaaaaccctgtcttacatattattaattcccccaatttgtgaaaagacagttttttaattgtgaataattcagagttgttcttatgaacaagtccatgaaaattgcttctactttttgttaactttcatcagcttttcatttctgctcttaattttctatggtcttaaaaaatacataaataaaccacttcaaattgtttccaaacaggctgggagaggtggctcacgccagtaatcccagtactttggaaggccaagacaggtggatcatctgaggtcaggagatcaagaccagcctggccaacatagtgaaaccctgtctctaccaaaaatacacaaattagccgggtgtggtggtgtgtgcctgtaatcccagctactcaggaggctgaggcagaaataaattgtatcagaacagtgtaaacatgtagacagatactgacaggaataaggttttgtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactatgaaacatattttaactgtgaaatgaatattttaaagaatcaccttggggccaggcatggtggctcatgcctgtatctccaggactttgagaggccaaggtgggtggatcacttgaggtcaggagttcgacacagcctggccaacatggcaaaaccccatctttactaaatatacaaaaattagccaggcgtgggggcacatgcctgtaatcccagctactcgggagcctgaggcaggagaatcacttgaacctggaggctgaggtttcagtgagccaagatcgtgccagtgcactccagcttgggttgcagagcaagaccccatctcaaccaaaaaaaaaaaaaaaagaatcaacttcgttaccattttttaatacataagaagagttttatagtatgtgatttttctttgtcagaaatcatgtggtcttactgtatgttaaaactatatgattacatttttttctacagtaataactgcccccaaccttgtaaaatcctggagattatggccctcttagctcttcttagaactgttaaaaatgccaataggttatctttgacaaatagtcactgtaaatttagatttatatttagtatatcttgagtttatcttctgaattgtaataccgtcttttacttcgaatatagatacatgtgttcattcgtttattcatttatccatatttttacttattcaacctctgcttcattccagaaacaattcagggaaatattaattacttaaaatgatttgtcttttaccaaagacattttctatcatcagttaaagtcatgagaggtgtaatccttttacaatattgaatcatattatccacagttctaaggtctttctagaactcaagtgcttgttaaaaattcacattgccaaatttctctccccttttcttccctgagcagacatttttttcccttattgtcatagatcccatgggtaatagaaattggacatttaagcagtggaattgtatacatgtcattagccacactttaaaacccaagaaatacaaatataccttttattccatttactgtgtgcattcccttggttttcttccttgctttagaatcaaggtgactatgacatggagatgcttgctaataggttggctctgccttcctacccaattcttacctatggcagcgacacctctgatagcctcctcttctttctccttagctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacaggtaggtgatgctaccaataaaattcagcttaatcggtcatctctttaagtcaatacggttgggtaatggcaggaggagatcttgggcaggaactttggagaggctgtgaaatctctactatgtccttcactcattccccagtggagatgtgcacttttaaaaagcagtgttgttgacacagtctaatgaaattatctgtataaaaaatccttgaaaaaggtaagaatatattatgtcaattttttatttctttggttttcagagtcataaacagagaacagaattaggctgtatattagtagaacagtgtataaaagcactactgtggctagcttgtaatcccatttctgtcattgacatcacatgagctccaaaaaaccacatgacttctctgagcctcattttcctctttaataaggagaaattaataatacctaccttaaaatatacaataaagtgtataattggattgtttgtaatgcaaaagacaaatgcttgaggtgatggatgccccatttaccctgatgtgattatgacacattgcatgcctgtatcaaaatacatcatgtatcccataaatatgtacatctattatgtccccacgaaaattaaaagttttttaaaaacaaaaaaaaatcaaatttaaaaaaataatacttaccttgcaaggctttggctagcattaaattaagttgcatatataaatgtcatatcagtgtccagtacttggtagaagttgttattgtggatattactattgactaagcaaaagtgagctgtacatatctggtttcaagattacaatccattgcatttttttctcaacattttccccttaagatatttcaccatcttatgactttgaaatttgatgtttaagtctgaggtaaatgctggataagttccacttcaggagaagcagggattcatgtcctagggttctagtccctcaaatttgtgagtgctgtaaacatgtgatgatctttagaattcaaaaggggacatatacattggataaaccaaagtgttatttagttcaaaatgggacagtctggtgctcaggtggtgcagtacagctcctcacctgctgggtctcaaaatgctctcctttgtagttggcagcaagttcaagtttagccttttaaagtttctgttatcttttacaaattgaccttactttaaaatgaaaggaaagaggctgggcaaggtgactccacgcctgtaatcccagcactttggcaggctaagtcaggtggctcacctgaggtcaggagttcaagaccagcctgaccaacatggtgaaaccctgtctcttctaaaaatacaaaaaattagctgggcatggtggcgcgcacctgtcatcctagccactcaggaggatgaggcaggagaattgcttgatcacgggaagcggaggttgaagtgagccaagattgtgccactgcactccagcctgggcaacagagacgccatctcaaaaaaaaaaaaaaaaagaagaagatgtaggcatacccatattgccttgtgctcactaagattattcattactgtgaagaaacaggcgttcgttttagtgttatctctgtaactatttgtgatcttacgatgcctcctgagttccttggatttcagtgtgtgcagctgtgaaaactggaagcaatgattcttgcccagtcatcatgtttttacatggatttcctggaggtaccttaaattcaacctgcccaaaacatactcactttctcctccttatgtatatttttcctttcttttcttagtttatgttagtatcttccatccccgttgaccaagcaaaaaattcatgccatgttttactgactgctgcctcccaacactaccattcctcgtgaagtcttgtcaactttaccttggccatagctcagccatgcttcctttattctattattttcaacatctttacctgatctctgggaatcgctcctcacctgccaatccatcttcctcactgtttgtagttacctttttgaaatatagttttgatcactcactccactgccccaaaatgtgactggttcttaaatacaataaaactgctatacaaatatatgcacatggaacttcagacttctttcaatggaagtctagccccaatctatctgtatctatatctgtctatctgtatgcatatatgtaaaagtgtggtttctataatctataatggttaaaattttttcactcaagtcacaagagctagatttgaaaatggtcctactatttatcaaatgtgtgatgcttctgtatttaataatgtattaaatacgaataatacttttttggtaaaaggaataaaaggaagataaattctacctgttagcattgctatgaggactgagggaattcagataaagaattcagggcagtcactccacacaggaagaatggaagggctcagaatagtgtgagctcagagacaatgtggaaaagaagttgaaatttaggctcaaagtataggaagaaggaggatgaggaagagaaagggaaggagaaggggaaggagaaattgttgaaattgctatgtttgggtgaaccatttattttcataattgttcacaggcctgcttatcatacaattttgtcctttcctcttctcttgagcttgttcttacctttcaatcctaagcatcaatcctctatacccccttggctacttgctgccatggttataccatgaaccttgacaacaccaatcactgcaacctctcattatctgagtttcaaatcatattcttgcctcactctccagactcttgtcttactatcctttatttaggactctgaacacaacgaaactttgatttcatagagatctgcaatctgttgatcctatcccttatagttcctgttttccttcacttattccatagctacagttccatggccagtaaacacagcaattaaatatttgctgacttgcatcaatgttttgcctgctactctcatttcatattacttgcttagcaaaaaccaactcaagtaaatgtaactttctacctactctttacttgtgctcttgtagctgaatatagctagatggaaaggtgtaactgggctgattcgtctcactttaaattcatagctactaatctcctgttgcccattaatgctactggcaattatactacatttatcaggcagtctctctcacatacgctcctaatgatatttcatgactttttctctcttctcaaatctccaacaccttccgcctttcccccactcttagctgaccttgattttaatttcatgtaatataagaaggggaattctacatgctttcatatgtgacttttttttcacccaagtttgtcttaaagcgtataatctgtctttcctcaaatttccataaaacaactgcctgtactctttaaagcgaaactttcacttgtgcacaagatcccatcttttcttataaaagagcaaatcttcagccattctttctctcttctgtgccatcagtttctcccactaaggtgaattacacctatcagcatgtcagcatgtagtcgaatcttccattgcaacaaattttgcttcaatttcacttttctctcctctaccactccatgctctgttctctttcataggaatattccttgaattgtctaacttcactccaatgtcttacatcatattccaataattattttgttcctagaatgtaatagcaactgctcttatcaaggttcaccaataacctcctgttgctaacccagtagtcaattcctggtcttcacattacttggacaatcagcaaattttgtcacatttgatcatttctccttcggtgaaactcattcactcagtttcctattgcacatgctctcctcattctactctggctactcattttcaggctctttttactttttactcccaatttatctgatctgcacatatcaaattgcttcaggactcaagcctttcattcacttcttgactttatattctgtgaacatgctgatgtgttccaaatttgtatctctggtcctaacttttttacctgcaatccatactcatatacacgtcttcctacttgatttctcaacatcaatatcccacgagcatctaaaacttatgaataaaaccaaatacctgttatgcttcaaccccaattcctccccaccaaatacttcatcattccagagttccccccacttttgaaatcttcatatttctcattatcaggccaaaatctttgaaataattcatagctcgtagttaatttttaattcttattatgaaatccgtcatcaactcttggcagtaccatcaaaatatatcctgaatccatgaaatagtataccaggttttgttataaaataatattggaaggctggttatgattttatattctgagctgagttatggaaataaagtatttcatcatattattctgcctagttttatattgtttaaattttcataataaacaattaaaatcaaataaataaaaacaaaacatggccaggcatggtggctcacgcctgtaatcccagcactttgggaggccgaggtgagtggatcatttgaggtcaagagttcgagaccagcccggccaacataatgaaaccccgtttccactaaacatacaaaaattagctggacgtggtggcacgcacctgtaatcctggctacttagaatggtgaggcaggggaattgcgtgaacctgggaggtggagatggcagtgagccgagatcgtgctactgcaccccagcttgggtgacaaagcaagactctgcctcaaaaaaaaaaaaaaaaattaagaccagaaacaaaatatatactgagacctaccacttcttacccacttcttaagtacaaccaagtctcattggaactattgcagtaatctcctaattctagtcttaccatagcagctggagtaaaccttttaaaagataagttagggtatgtcattcctctgcttcaaaaccctgtgatgactgtttttctcattcacagaattaacagaactccttgcctttttctcatgttacttctctaacctcatcacgtagcactttccttatgtttcctaaatattcaagaatcttcctctattgagatctttgcgcttgctcttcagtctgcctaggatgttcttctcctcagagatccacatggatcattccctaatttctaccaaatctttgctgtaatgtcacgttctcatggaagcctttcttgatccctggcactcactatgtactttttatttttatttttctccatagcctttattaccttgtacttacaaattttgtttccctaatcccctttctcctcaccagaatataatattcctatgggcaaggctgtttttatcttctttatccactgagctattctcagcacctggaacagtgcttagcacattatagatactcactaaatatttttcgacttgatgccttagctgaaatgtcaactactgtgtggaactctccatagtcctccaactcagaattcatcaatttcacctttatctcaccccttcattttgattacattactgttatggccttggccaccttttatcaagtttgatgtttggctgagtacgtgtgtatttctttccctgatgattaagactagttcttattcataatttcatgctcaagtgtccagtatcatgcctcatgtaaacataaactgatcagaactgatatggtagaggtggcagagagatatgatattctcgatagatttttttcttacccagtaaaataaattgtgttactgaggaggatgaataagctgactacagttcaataaaaactttaattccaaaaaaagttgatattaaaattttattctaatatctccatttactttgatttttctggctttcaactagagccataaaatatgccactgtctcttagcagttagctgtgatgtttgtttgttcatgtaggtttatttagctgcttgacacaatacctttctaaaacgttgtgaatttaacatttatctcagattagcaataactttgtcaggaaagttattctagctcagatcatcacgaatctttctgacttgttaatggtgtagataatgcaagtgccataattcaaatctttttatccaaccccttggggtgcttttatttcataagttaaagagcagcatatattccaaaacatgaaagctagaattcacagtgaagtaattgcctcatagatatctagctatcccctcttagtacctaaaaatcattaggaatgaaaagtgatctttgagatcatagtctaacttcctgctacctaaacattcagagaccaatgatcagaggaaagtccatgcccaaggccacagttttatcatcaacagtgacagcaagcatttattgggcacttactctgccagatactaggctaagcatcttacataaagtatgtttaccaagatgagacttaaagaagaagtttatacctccattatacagctagtaagtagtagaactagaatttcgtgcagaccatagtccaaagcaggcactctcaatccctttttcatcttgcttccttagtggattaacctgcaagagaactaaatgttcttgatatttatagaattatgacatgcaattcttttatatgtttcattccaataattttttgacttaatggctaagttgatttgcattatttatttaccactaataaaacacactagtgaatttttattgttgtatttattttgagagatgaggttttgctatgttgctcaggatagagtgcagtggtgtgatcatagttgacttgcagcctcaaactcctgggctcaatggatccttccacctcagcctcctgagtagctaggactacaggtgcatgccgccatgcctggctaagtttttgtattttatatatataaaaagaacattatacctctcacttgtaactaaaatgacttatgaagtataacacagtatagccaaaagggtaaggctatgtggctgtggaattgaaccacctgggttcaaatcctggcttgttattttaccatctgtgtgactttgggccaattactagtgactttgttttctcacatggaataataatagtatctgatgtgtaaggttgtgatgagtattacatgaagttaaataaaagcacctaaaacacttgctctttggtgcacccacaacattccattcttattagctaatgccatgtgcaaatcatcatgtgggttgaaaattaaaataactgaaatacaagggtgtttcttaactcttatttagagaggactttattactttcataagcattcacacatttgatcctcagataaggtatttatgatgatctccatttcacaaatgagtatgcctttctctgttcagaaagactgaaaaatattgctaagaaaccacactaatagtaaatattagaactgggatttcaatgcaaggtttctagtccagtgatctcttcactgtgccatacaaagtgaaatacattttctgaaaaagctccatataaaatacagtgggagtgcagatgagagaattaaaacaattttatgagcatcattcaatttaatcctcacaataatactgtgaggtaggcagataagggactggtatcttcattttgcaaatgaagcagagaaggctccaagatagcccctgacttgctcaaggtcacacactgttttgtggcagaacaaaggctgaactaggtgttccaacttgcagcaatatatgcttcacattgctttatgctgcctcagaaaacctctgctcactgttcaggattagaaaccagctttttctgactgacatggaggattccttttagaattcatggtatattacatttttgatgtggtgtttacatattctttccccgctcttcagagttgaggactctgcagctgatggagcttgttatccatgagggaacatattgtgatggaaaaagaacaagactcagaatcctaagcatgacattctggccctggcttaaagcttggcaaagttagccttcttcttagagccccactctgcttctctgtaaaatataaaatcatggccctgtacctcaaagtgtttttaattcattgaatgagagaataatgattttatttctccagtggacttaatgcatattgaaaaatgaaacatgccatccacaaatgtcatatataaatgagcaaatattgaatgtgagttgactatatgtccatgtccagcagtgtattgaaaatagaagagaacccagcagattctctggaaggagttaatcttgaaaggttcgtcttactgatgaatgtataaccacacacttagttaagagctttagtggaaaggaacatgcttctgtgagagcatttatgaaatgtgtgcatgatgtctatgtcataatcagacttgcagtttcaaaagatgactatgactagaaagtggaaactagagcagaggtcagccaggtgggtgccagagtcattcagcaggctattgcagaagtccaaacaaaagatggtagcttggtctaagggtatgtcagtggagatggagcagcagagagaactttgtagatatttagggggcaaaactgacaggactgaataatgcattgcacatgaatggtgagggagtaggggttgtcaaggacagtcacttggtttctggtatattccagtgtagagatcattgtgcaatttgctgagattaggatgctggaaaggtccatatttgaaatgaagatcataaattcagtttcagacaagttgtgcttgacatacctttacgaccttcaaatgggaatgtccccaagggccgtggaaataggaatctggagctcaaaggagaggattgggacagagatatgtatcaggaatgtgtcagcatgtggatgctcgctacagctagagaaggttaagatggcccatcccaagaaaacagaatgataaaagaatccagaactcagtcacatttatcatgtggatagacgctgaaactaaacaaaataagaatttgaaatcaaaatctgtttcaccccaactcccaagatatagctcattatttgcagttacagtagccatttgttacgtaactagtctcaagtgtgtattagatgttgaagcagagattacaggaaagcacatttttaaaaagctcattcctagatttatcctttttaacaattcaataaaaaacaatttttaaccaaaacttagtggaaatacctctaaccaagagaggtaaacaaaaaagagacatttccagtcttcattatgcttttatctggcagtgaaacatcttgaaacctttctctctaagatagcattgatttccaaacctatggttttagggtaataaggaatgtgacatttgggtggttatcactctgctatcactttgagtcctatttcattaaacaccatgtttcagttttgaaatcttttaattgttataacattctggcattcactaaagaaataatgaatgaaagtagaagagataaaaaggagatgctaaaaatctttccactaagaataacgtaactccttctctacaaaggaaggttaatgtaactcttcctccctgaagcaactaattaggtgtttgacccctcaaggcagcatttgttgctcaactcacaagttgtaactaaatgttaacactctgaggcacttaggcaagatgatatgtatttactaaaaatgcatgttagagacttgctacaaataatccactaagaagcagaatcatgtttaatctctaaactctacttctgaaatgtaaaaatagaagtgctgaattcagctaacacaaacacttgtagatacaggagattttctattttttattcctaatgaagagtattagagtagtgaggtttctttaagtagatcccactctccattacggataatgaaatcaagacccaggaaggtgaagtgacatgccaaagatgaccgaaataaatggggatggaacaaggaatagaatccaattttctaggcatttctaaggtcacattatgtggagattttatgtaattattctcttttaatttcacatttatttatgcatttatttaaaaaattatgagccccagcaatgtagccatttttttatgctcagtgaatctatatgctaagtgtgaataaaatataaatggaatatggcttctctttttaaataatttacagtgaagtcaaagaaacatgcatgtccattaatacaaagtgatacataatacactagatgtataaacagaaagcaatgaaaacacaaaagagagcatttaatggtactgggtttgaagacatgagggtacgaagtttcagctaaacatttcctttgaattggattccaattgggtttcatttgaaacaagcttttgccaaacagagtcagaagtgtgagtcaggagaaggtaactccaggctcatcatcactggtcattgagaaatgcaaatcaaatcaaaaccaaaataagataccatctcatgccagttagaatggcgattattaaaaagtcaggaaacaacagatattggagaggatatggagaaataagaatacttttacactgttggtgggagtgtaaattagttcagccattgtggaagacggtgtagcgattcctcaaggatctacaaccagaaataccatttgacccagcaatcccattactgggtatatacccaaaggattataaatcattctactataaagacacatgcacacgtgtgtttattgcggcactgttcacaatagcaaagacttggaaccaacccaaatgcccatcagtgatagactggaaaaagaaaatgtggcacatatacaccatggaaaaccatgcagccataaaaaagggatgagttcatgtcctttgcagggacatggatgaagctggaaaccatcattctcagcaaactaatacaagaacagaagaccaaacaccacatgttcttacttacaactgggagttgaacaatgagagcacatggacacagggaggggaacatcacacactggggtctgtctgggggcgggcgggggggctaggggagggatagtattaggagaaatacctaatgtagatgacaggttgatgggtgcagcaaaccaccatggcacatgtatacctatgtaacaaacctacacgttctgcacatgtatcccagaacttaaagtgtaataaaaagaaatgaaaggaaaaggaaaagcaaaataagaaaagacagagaagctgacatgaacataggggtcctggggcaggacggctcattgcagatgactgtgcaaagctttgggccacatcgtgaaggtctttgaaccttgttccatggaggtgagatctcattaatctagaatggcagctagcacaaggttgtgggcatggagttgacaggttatgtgtgttaaaagggtatctttgtcaatagatgatagcaaaaattgagaagactaatggcaaaatgctagaaaaagctattattataatgcaatacatttaagtaccaactaaatcagggaccagttctaggcacaggagaatatactctaccagaattagatctcaatgtaaattgcacaatggtgcatcgcatgttgccatgcttgacttcatgcttcaaaagatgtcagtgcttaagagttacagggactgatctcagtaaagcaggaacattatggttagtgggtcaaactgcatgcttttagagtagaaacatttattttccaagacactttaatcaagtaactcaaagttcttaaaactagcattcacaaaaaattaacgcttcttattaactaactcttcttatagcctccttgtaaaagtccaagtggacaagttgtctacagactttttagcatgaggaatcagacttcgtatatttgatgctctatgtgaattttcattgagtaaatttgctgtgaatggattcaggcaggcacaagtggcttgattcctttacttcaatcgacttatcctgaatttggcttaactccaccacactgccaacttagagttagggggaaaggaatgaagtggagaagatttgtctgacaatccatctggtgttacagatcatgactctgagttctgcatatttgaagggtaattatgtcttcagattcacaggagagaacatcactgagagggaggaggcttggggtccctgccgcttccacaggagttgttaacgcagtgagaggccgaacaatacaagtttacccaaaaattgggtaaacttctcattattcactgttctcttttcttcagaacccagtgtgcttatctgcccatttacagaggggtatggactacagtgagcagagaggaaatccttaattactgcttcatggaaaatttactttaggtggctagtgttggcctatagtggaaccagagaaatcccacataataaactgcccttccaaactcagatgttacttagttgttgggaaatggtttgctatattttgtttacagctattaaagcctggaaagggtgattaaaaactcgtgggaatccttggggctagaactgaacaaatctgtgaaggataacatggcaggaaataccattttctcaatatgcttttgtataatgttagcaattagatgtcaccccattaaaacacagggaagccacgcagcagtttggcagcagacactcatccaccagtggggacatcagataccataagactatcaagctgtactgtggaactcagggaactcctatttcttctcagtgtccctcagagagcagtttccagccctttaaaaatgaatattttcattattggaacttgttcaatgtgtgtagttatgctcactctttttgttttgatttatctttgcaaagaaaattaatatgatagaaaatatcaataaagattttttttggagtgggggcaagccccaatgtcagggaaacctatctatgtagcttttttctatgtgattatatctctcattaagttatgtcctcagattcctggttttaaatactttgtggaaaagtccccttcttggacgcaatagatttatttcttatgaagttgtggtggtattttgttattataaaataatagcagtgactgccattatggcagaatccatattaagtatcaggtgccatgtatttttctttagatattttacctacagcatttcatttaattctttcagacattgtgatacaaaatttttatagcacatatgttgtacttgagaaatctggggctcagaaagtttaatgtgaaggccagaaacagcccccctgacttacctcagtcctgaactacttactccacagtctacataggcttttgaggtttgttttttgttgttgttgtttgtttgtttatttaaaacaaggtcttactctgtcacccaagctggagtgtaatggcatgatctcagctcatggcaacttctgcctccaggctcaagtgattctcgtgcctcagccactagagtagctagaattacaggctcatgccaccatgcccggctaatttttgtatttttactagagagagggtttcaccagattggccaggctggtctcgaactcctgacctcaagtgatctgcctgcctcggcctcccaaagtgctgggattacaggtgtgagccactgtgcctggcctacatagtgtttagatgcaaactccctttgatatgataagcagatttctggaaagtggcacataaaattgaaatggttagattaaaccatggtttaaaaccactacgagcccacattgtggaaaccagtgatcaacccagggcagaaccagcaggtgatcagaggttgaaccatagagttgtcttggaggtgtatttacatagcaagcacaatgcatttgcctgggttctattttacagatcaaaatcatggaaacattttcaaaagatgctttatttatactttatgtaagactgagaaagtatgaattgtccatatcaatgaatatgtttatacataaattttttatgaattattaattttggataatttttggaggctaatgaagattattaaatcttccccattatgaaatccaacatcctcttgtatatgtaagtgatattttcatttcatgatcttggacatttttacctggacatgtccagattttcttgcgtccctttcctttaaagtatacctgttcagcaaaagacataaacagatacttctcaaaagaacacatacaaacagcaaacatatgaaaaaactgctcaacatcactaatcgtcagaaatgcaaatcaaaaccaaaatgaaataccattccacatcagtcagaatggctattactaaaaaaaaaaaaataataaacaatagatgctggtgaggctgcagagaaaagggaatgcttatacattgttggcagaaatgtaaatttattattttaggcactatggaaagcaattaggagattcctgaaagaacttaaaacagatccacaatttagcccagcaatcctattaactggtatatatccaaaataaattaaataattctaacaaaaacatccatgcactcatatattctggataaagaaaatatggtgcatatacaccatggaatactatgcagccttaacaaggaatgaaatcactccctttgcagcaacacggatgtagttggaggccataatcctaaataaattaatgcaggaacagaaaaccaaatactacatgttctcacttataagtaagagcttaacactgagtactcagggacatatagatggcaacagtagacatgggactgtcacataggaggaaggcaggagggcaagggttgaaaaactgttgcgtactatacttactacctggtcatgacaagatcaatcatacctcaaaccacagcatcacacaatatacccgtgtaacacattttcacatgtaccccagaatctaaaataatgaaattatttaaaaaataaaatacagaataatacctgttcaaagggttatggccagcgtgacttggaacacagttatttcatccagtttatttagtatttgtaagaataaagtcaattatgaaagctgtccttccttatacatacccaaggtgtttgataggcaaatatggcctttgataacaatgttgcttgaaggtctagaaaagatgctttgaaatgattcacagcagatgatagacaaattgatcctctcagcagtctctgagtgctcattgtcccctttttccctataggacctcatgtcttttacccaaagttcccatgatccaaagaagttccttatttttccactattgttgaatgatatcaatactagatttagaggaggaagttccagatttcattcttaagtgtgatacccactaactgtgaagcctttgaataaatcatgttgcttttctaaatctcactttctatatgtaaaataatgataacaaaaccaccctatctatatcagtaaggtacctgaggcactgggtataaaaattcttctgctaaaacaaaaataagcaaaaatccccatctccatgtgctcaatctctttgagctatatacaacaaggcatacaattctattatgagggtttgcttttaaaaagcaatttgctgacctaaatgatcttagtttggtagaatatagcagtgtggtatgtggcaaatgggagcattgttccatatttcttagccttacctactttagattactattgaatctcatccagacccctactctcctagaagtcggaattcagccttccagaaacttcatactgcacttctaaaagaatgcctaaacctcaggctatatccagattcatacagggtgctttttctctattgtggtaaaacatatctttcattttacaattttaactatttttgagtgtacagttctatggtattagcacatgtaccttgttgtgctaccatcaccaccatctgtccacagaatttttcattgtctccagttaaaattaaaaaaggcaggggttgcaatcctactctctgataaaacagactttaaaccaacaaagatcaaaagagacaaagaaggtcattacataatggtaaaggcatcaattcaacaagaagagctaactatcctaaatatatatgcacccaatacaggagcaccaagattcataaagcaagtcctgagtgacctacaaacagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaggacacaacataccagaatctctgggacgcattcaaagcagtgtgtagagggaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatccaggagctggttttttgaaaggatcaaccaaactgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactctttttacgaggccagcatcattctgataccaaagccaggcagagacacaacaaaaaaagagaattttagaccaatatccttgatgaacattgatgcaaaaatcctcagtaaaatactggcaaaacgaatccatcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaagaacccttcatgctaaaaactctcaataaattaggtattgatgggacatatttccaaataataagagctatctatgacaaacccacagccaatatcatactgaatgggcaaaaactggaaacattccctttgaaaactggcacaagacagggatgccctctctcaccactcctattcaacatagtgttggaagttctggccagggcaattaggcaggagaaggaaataaaaggtattcagttaggaaaagaggaagtcaaattgtccctgtttgcagacgacatgattgtatatctagaaaaccccatcgtctcaacccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaatcaaagaggatacaaacaaatggaagaacattccatgctcatgggtaggaggaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcattgccaagtgaatcctaagccaaaagaacaaagctggaggtatcacactacctgacttcaaactataccacaaggctacagtaaccaaaacagcatggtactggtaccaaaacagagatatagatcaatggaacagaacagagccctcagaaataacgtcgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagtatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggtcatcagggaaatgcaaatcaaaaccacaatgagataccatctcacaccagttagaatggcaatcactaaaaagtcaggaaacaacaggtgctggagaggatgtggagaaataggaacacttttacactgttgctgggactgtaaactagttcaaccattgtggaagtcagtgtggcgattcctcagggatctagaactggaaataccatttgacccagccatcccattactgggtatatacccaaaggactataaatcattctgctataaagacacatgcacacgtatgtttattgcggcattattcacaatagcaaagacttggaaccaacccaaatgtccaacaatgatagactggattaagaaaatgtggcacatatacaccatggaatactatgcggccataaaaaatgatgagttcatgtcctttgtagggacatggatgaaattggcaatcatcattctcagtaaactatcgcaagaacaaaaaaccaaacaccgcatattctcactcataggtgggaattgaacaatgagatcacatggacacaggaaggggaatatcacactctggggactgttgtggggtggggggagcgggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaagaaaaaaattatttacttattaaacactaacgtcccattctcccatcacttagctcctggcagccactcagggtgcatattttaaatactagcagtgctagttaaaatgatggtaacccgtataacaaataagccctaaaatatataatggctcagaactatttctgactctataaggtatggaagggatgttactgattgtcagttcttttcccagctcttctctagaattattacaaatgttgattgttccatcatcacccatatggcttctaaggtcatcatgcttccctacctcaagacaacaggtggaagaagagaacatggtgaattacccatgtgcagtttattttaggccaggcctggaatcagcacacatcacatcacatacactcaacctcttgatgagactcagtcacaaggcctcaactagacttcagggaagccggaaaatacggtctagtacatgaagcagaaatttcgggtttgaggataagcgagccagtctctgccatcagtcatattaagagtgtagatatgcccaggaatcatcatcattcatgcacttagaacttttactttttgaaaatctaattttccctggcagaaaaagatattttattttaaatatgtccaaaaccaaaacatatctgaatggcaaaattaaagtgtacgtataattccactgagaagcaagagatattatctagatatagaaaccttgagaaacaattgagaatcttagaggaagtgccttcttcactcagttcaatcagctatatgttaagttccaatgaggatatctagaatgttcagaaggtgtagaattatgtgtgtccttaaagaatatttcaatagttaccatttctaaaatgtcagcatccatatccaaacggtttgtcatctcttaatacgcactataaatgcaaccatgatcagtagattaattcattagtttgcaacactgaggaagtttttagtttataaatgtattgatattgaacacatagagatgtggcttgaagagcaagacaaacaggcatatgttacagtttctcttcacgcaggaaggaatctacttcctttcactaattgcacttaaagtaaccacagggactcaggctccatacatagaacactaagcatctgcgttttcctttcatacaatgagagaaaatgcataaatgcatttgttggcaatactgacaaagaccgatttgtggaataattgaaaccttgatttctgtcattagccggatgtttacaaaactcgtcttcctgtctacattccagatgtttctccttattttaatagctccttgtttttcatgggttttgaattccaaattgtaaagtgtcgaggaaaaagactttcgtttgcaagtttcatggaaaatgacataatcttaaactccccagaatccttgcaacatttatttgtaggtccttccaattagtttattttctatagaaagtctgaggtcttgaattatgtcccagagtcaacattagatgagtgagcaaccttttggttcacctcactactcttgcacatcaaatacagattttggctgaaggtattctttttggaataatctttctctgcaactttgatttctcagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagtgtgagtatgaaaaggaacgggccacatttaaaaagtatttattttcctctgcaatatccttgaattctttcacagaacctttgcgaagtgacaaaagcgaagaagagttttttttcttctaagtaaacttatataactcgaggacttttaaaagataacttgtaaatagaatggcctcttcacttaggccacataccgtaatggcaaattaacctctataaaggcctaatctatctatgcagtctacttattcatttcctaagaaagtgatttactcttcctgacagtattttatcctcatcattgagtttcagcctcctctgttgaattttcagattttttgagtttgtaaagagtgtaacatcaaaggtaaaagaacaataacatacaatttctaaatccagggactaatttaaaagcttgaacacgcaccgcatgcactgaaaaacctactaaaagcaaattgagatttgaggaatatgagagataacctctattggataatctcactccctctaccttgaatcactagattcagctatgtttttttttcacaaagtagagcagctgaatgttctttgaccaatgtataattcaatgatttcaactttgataaaggaagagctccagaattacatatcgaaaactatttctgtacttgacaaaattttgttttttcttgtgcatttctaatgttttttgaaaagattagttgctgatgagtcattcgccaaatttgttttgtttcgcattaaaaaacgattggaatttaaaatcaaaatgaaatgcatggctacttgttaacaagctgccttatgttaaacacctaactgtacctgtttcctttttatataacaaaatttgtaatgatattttgatttcctgttcattttacgtgaaactgtaaagaggtatatcaaaatcacctcttgtattttgggaataaggtgaagtagagattggaaatattttaactggtaattgtgagagagtaacctttgtattctatcacttcttgggtggtttaaatcagcaagtcgaagaagagagagcaggagatacagtctgagtgcactttccacagaatctccatcctttctttcatttggccagggctacagagacaagatgataacaaattggaataaagtattaattgaagggacggaagagggctaagttgtgcaagtactacaaatatttgcctcacagaaataaaaacctcaacaacttcaaaagcatagtcatgttgaggttccagacaattatttggaaatgcaggcccccaggcataataataatttgtaggacccaaataatttctgtttgcaaaataaaaacacaggggcacattgttaaaaattattaagattatgggatggctacagcagaacgtgagtccttgcacaacttcaccctttgctgcctatgagctggtcctgctcccaggtttctgttctgggcaatgttttgttgctgtactgatttaaatcactaaacaatgccaatttcctcttcataatgtctatattaacataacatttcaatcttctttttttatttttgggacggagtctcactctcttgcccagactggagtgcagtggcacaatcgcggctcattgcaacctccgcctccaaggttcaagcgattcccagctaatttttgtatttttagtagagacgagctttcaccattttggccaggctggtctcgaactcctgacctcaagtgatccccctgcctcggcctcccaatgtgctaggattacaggcaggagccatcgcgcccagcccaacatttgagtctcaattgctttattgactttctcttcatagatcatctatgtaaaatcaataacttttatgactattttatatttttgattaaaagcaaattaggttttacatatatataatacacacacactatatatggtatatctcatgtgatagataggtcaacaatttaaaaactcttgaaaaattccttaaagaaatccttgataaattttccagtattggaactagctttaaaagcatgctcattttcaaaagatcaaatctccatggattatctgaatttttcatctcctagttctaaaattatcgtaaaattgttatactgtacttttcagagctgactagtcatgattacattgcatttctgataaaaatcctggttggttagccttgctttgtaagaatgagcattttttttccccttgatcaatactattgtttctaagcattcaacttaagaaagcaattttcagtgttttaaaattttacttcttttttttttttttttaacaccaacgttcccaagccaagggacagtaaagtattttcgtttttgacactggctaagaacactcattccataaaaattaaaaaaaataaaaactatgataaaatgatacaatatattctgctattttaatataattaagttaaaaagaataatgatttttttgtatcacacatatggccttaactttgtaaaacacaaacaatgacataattcataagtatgtttaataaacatttattatgttcctaacactgttccaggctgcatgaggcatgttagaaaagcatatgtgagtaataaagcagcagtatttatggatctcagcagatttggggggaagcaggtattttaaatatgtaacaataacaaaacaactcgagtaggggaacttataagaagttggtaaatggaatacaaacaatctgagtcacagatttgctcgtgggcccatgacctgtgatggctgcagcatattacctagttaatttcttatgcccagatcatactgcatccacctcctcaaatcagtcttgtaatccagttacaatgacagccatgtctatgctttatatatcacacattccttcccattcagaaagcagtgtgaaaaatttgtgcagagcacctcactggacccaagtctctataagcatttactttgcttaacaattagcgtaaatgataaggcataaaataacaaaagcctaactgaataaaacatgctgattgttggtattgttgtcacatataaattctattctctaagaaatgaaaatgaagaatctctctgctttagaaacatgatgcagccatgaatctttttcattaatggcagcaataacagccttagaatgctaaccatattttggcctttagtaacagcattgttctattaaattacccattttcttaccagtatatggaataaggatacctttgcagatcattgtttatttgcactatgatttgattctgtttcactgaacattgccactggataattcctcccttactgagtagataagtagttaggaataaagtagcctgcataaacaagacattcagaatatcctttacatgtgcaagagagttagccaattgcttcaattcatgtatattgagtactactaaactcacttgccgtctttcttacggacattagaataaataaattatattatcatgagtgataggcattgcatgtgtattttatcttctgttggtaacataaaatgccattttggcaatttgaaagtatttctaggataaggagcacttacttcatcttctccaagcctgctcaataagacacccaattactgaagaagatggaatataccagagatcctatggttcctttcctttcctttcccattccttcctcccttcctccttcccgccatccttccctctttgttataagcccatctttctgtccttaagagaaaatgcgagggctggttttatgacttcgctagactatcagaatttagtggcaagatcaggttaaagaaaacgttttcatcaatatttcttttctgacaaaatgatcttatcttttgaaaatgggtctcagctgagtatgcatttggttgctgcttttatcaatgttttccaaatgtgatgtagtaattgtacactaaaattacatagcttgtatacaaattgaatttcaagtttttcatattatttgaaaatatcaactctattatacaaaccatatttgcaaagaataaaactgatggaaaatatgtctgaaatataaatcagccagcaactgtttctaaaagtgcatacattttgtagtaatcatttaaagagatcgacagcccaagatccagtttatgaaataattgctcgaaatagaaaggcttgatttatatgaaggtttgtgtcctctgatggtatcttcctttgctaaacccttgcccattctcccctgcctttatggtatgtaatttctctaccatattatcagccaggatttaagtccctgtctgcttaagacttgtctaatcttttcataccacatgtggagattttttgaattattatttgcagtcctttaagatcctgttaaggcggtttaatcataaaggatgttaaaatggaccacatactggcttgagggcttgagttagaatgggaagcctatttgcaagaccacaactcaattacctacaaaactcttttagatttaagagttgtaagtaatattcttagtctattatattctttacactaaaaagatgagtgaaagcaacccaccaatttgagtgactttagaatatattatctagaggaatagccatatttgcttctttcctccttcatgagattttaaaaattctaatatggctctacttgtatggttgttaggaaaagaacagagaagttcaaataatgtctctgaacattactacctgtatcctagagcaagtttgtcaatcatcgagacctcagtttcctgaactataaacgggagtatcatttattcctcttcttcctaagttgcaaaaatgaaatatgataacacgtgggcagccactgggtcttgcctggcatctcatttaaaaaaaaaaaaaaaaaaaactccctgatccaacgggatcaaataagaacataatttcaactgctctacatttacaaacaaagtgggatactcatcagggtaatcacttgggtaaataaggctaatataatacctcatttatagtttagaactagcttgatcactatacagtcagcacatttacatactctgctactttctccctaattaacctctccttagcatttggcaggctgttatagattgccttgtctaaattttgaagtcttatgaacagaaagtgctacattatcccgtaagatgtatcacagcattgccattttataaataaagccatgtgtcacttaaggaaggaaatacattccaagaaatgcatcattaattgtttcatttttctgagaacataatagtgtcttacacacctagaaggtagagcctactacacacctaggctctatggtatagtctactacacacctaggctatatggtatagtctactatacacctaggctatatggtatagcctattgctcctaggctgcaaacctgtatagcatgtgacggtactgaatactgcaggcaattataacacagtggtatatgtttgtacatctgagcatgtctaaacatagaaaaggtaatgcattgcattagaatgatatgatagcaagatgtcactaggcgatagaaatttttcaacttcattatattcttatgggaccaccttggtatatctgggctgttgctgatcaaaacattgttatgtgacacttggctgtcattggttggttgatgctggtagaatatggtttgggaaagatacaaaatatcagttatatttattaaagtatggttacataaattaagcaaactaagttgatcacagctctgtctagctcattacttttgtcacttgatttacaatgattaactgcactgcactgagatttgaataaatatttggggtgaccactatggcaaacctgtccactcgacaacaattcagttgtctgatcccgtacatggccagacataaataatggaaagaagtaaagataagcactggcattacatcttttttggtagcatacaaatacattattttaaaagtctctggatgtaaaaaaatgttttcaggtgttataaataagagatggggaacgttaaaaatttatggtttagtatcctctgtgaccaaaggcttaaggaattcatttagatttaatggtcaattaggctaggtatgatgtctttgataatgacatatattagtggaaggattacaggtgggcttgagatgatgggttgtttaatcacctctagaagacttcaaagcaaatgtgagtcactgtgttctttcttcattcatttaaaaatatttattttgtgctaagttctagaactacagtttccagtacagtaaccacaagccacattggtctatttaaatttaaaagtattgaaataaaataaaatttaaaattcagtttgtcagtcacaatagccctattccaacttcttagtagcacttaaaatttaaataaaattaaaaaccaaaaattcaacttatctctcttgtgagccacatctcacgaattcatatatgattactggctactgtattggagatcacagagaacatttccattatttcagaaagttctctcagacagtggcagtctaggcactatgctggtaaacgaggatacaaatgcaagtcagaaatggtcctaactttcaaggaactggtagtctagtggaaacaactttaaatagaattcactaaaaacagctttcacagatttcatctccctgaacaaaattgttcagttttgttcaaaacaaaaaagttaattatgtgctaaaataatagacatgattttttaaaggccacagaatctagacctgaagatatgctgtttatttacttaagttagttaatcacattaaaaatccattacctggaaaaatacataagcatcttccgaagttcaactgaaagtgaaggacatagcttactagttgcttgggttgaacagtggtatatcgtaagtgtaatttccctaagaagcttctgctggctctcttattttctcttttcttttgagcacacagtacgattcaggcttcttcagttggtataaccaaacatctagaaaatttatctgcttcatgagaaattgcatagaaagaaagctaacttctcatagatagacataagggagtgtaggaaaggggataagaaagtgtcataataattattggttttcaggcagcacggtcaactagtctaggagaaagaggttccctaagtagatctgatttgggtttaatcgcctagtttggttatatgccctactaaacgtgaaagcggttggtttgctaagctgaattagagcaaaagccagcatgaacatcttcggggatattgtcgtcatgctggtgcagctgaatgaaactctactccaaggacatgagctgagctgctttaggcaaccgctttgatggagagctgatgaacaccactgagaaagggtaaagatagaaaggaataaggcattttaatcacatgtgtattgaagcactccctcatctttagagcatatttttctatgcagttcataagtatttactgagcaccaactatgtatccagccttttataacatgcttgggatagaaaataaaataagggcagaagtttctttctttgtctgtttctgctgttataacaaaacacctgacactgtaatttataaaggatagaaatgtattgctcatggttctggagactgagaagtctgagattaagcaggtgtggtgtctagtgagggctggtctctgcttccaagatgaggctttgttgctgcatcttccagagggtatgaacggtgtgtcctcacatggtggaagaagtggtaggacaaaaaagaggagctagctgttccctctagccctcttataaggactaatctcttcatgagggtagagccctcatggcctaatcatcttttaaaagattattataatatttgcattggggtttaaatttcaacatgaaattttggaggggacacaaacattcaaagaagtggaatcaaatttactttctctcttttttttttctttttttttttgagatggaatcttgcactcttgcccaggttggagtgcagtggtgtgatctcagctcactgcaacctccacgtcctgagttcgtgtgattctcctgcctcaacgtcccaagtggctgggattacaggctcacaccaccacacctggcaaagtttttgtatttttagtagagacggggtttcactatgttggccagactggtcttgaactcctgacctcattatctgtctgcctcggccccccaaagtgctgggattacaggagtgaaccaccgtgcctggctctatttcctttttttaacctaaagttagtgttacaaagtttcattgtgtaattaatgcataatctaacgcagatataatttgatgcacaaaccatattgccttttagtataaaatattttagtatattttagaaattatctgatctaacactccaccaaaattaagtaaaactcccttttaaattactgtactattttatggattcttttaactgcaggttatattctgcctgctgtaatatatggtgaattttacatgttacataaaaagtcaataatatgactttagctatttttctttaactccaatgttcttacattatgttactttaattgcccaatctttcctccttggggaacccaagatcccatgcaatgaggagttgagttgggacagaatttctgattacaggctattctgcagggagcggagattaccatgagttaaaatagaaagattttaagcctatgacaagcaattactgcttctaattgtagctgttaaagtcaaagctgagatggtgtcactcatttctggaaggaaatgaccacagatttgtatcaattgaaagtcaagcaatggaactctaagcccatggtcagtgctagtaacttgtacattgtcctcttatttaaacctataattggtgttataaattataactctgggtacccagagtctgacacatttcccggtgccctgaaacataattttaaatccatcaacactttaagatagtagattccaaccattgaaatgtgcaaccaataaacctggggaccagagcttttaaggctagccatagaatacgtcagtgcattagtgagagcccaaggcctatgtctagattcctaagtacaggcatgcttatcctaaacaatgggcttacaataatggcagtttctcttcctgaaatggaaatatcactttaaaaaataagcaaaagatctgtgttctagactgagatttatctgtattctgctgtttgtttttggggaagtcagttacctggtctgattctcaaatttttataaaataaggatcatactgcttgttttgggataatatgaaggggcactagaaaagcctcattaaggaacactgctaactgatcttacacaatttacctcaatttcattgatttttcaaatgtctcccttagaaataagtaagtgaacttgttaacccatttgggtgttgcattatttatctagggctaccttaacaaagtgccacaaacttggtgtctccaaacaacaaaatgtattttctgacctttctggagcctagaagtccgaaatcgaggtgtcagtagggctatatttcctctgaaaatgcttcagaaaaatccttccttgcctcttcctagcttctggtggcttctggcaatccttggcattccttggctggtagctgcataatttcagtctctgcctgcatctccacatggccttctcctctctgtgtctctgtgagtcctcttctcttcttataatatacttggaatgcaccaaaatccagtataaccttgtcttaactaattatatctgcaaagatatgtcatcaaataaggtcacattctgaggttctgggtgtacatgaatttttggagtactattcaacccgatatactgccctgtgaatcttagtaagaattcttacagattcttagtacgattcaatgtcatctgttggaggactgagcaaactatgaagtatatattatgtttgtatgtatttatgtgcatgtatatatatgtgtgtgtgtatatatgtgtatatgtgtagatatgtgtatatgtatatatgtgtgtgtatatatattcaggtcatagctgttaaaatcagagtccagatattggcattagtgtctggaagaaaaacattttagggattttatcaattgaaggtcaaacagtagaaatccaaacctgtggtcaatgttagtaagttttcacaggcagcttaaaacatagcaatgccaacacaattttatatatatataaacttttccatatatagtgtatatatatataattgtatatgtacatatagcatatatgtatacatatagaaaattaaagtgtatgtctatacaggtatatacatacattaattagcaagctatatttttcattttaaaaaccatttcagtcactgcctctcaagcaaagtagaaatgttggtattaacagacatccctagtgtccttaaaatcatatttgctatgctcttaccttcttcatctcttcagaattctaaccctgccttgtaagttgtaggacatagcactttctgaatattaaggactgcaaactgcttaggtggcctgaaggaaactaataagtgaatgaagttagccaaataacagattttgctgaaggtgcctgtgagatctgttacagacattgaccacatgcttggatttctactgtttgaccttcagttgataaaaacccctggttttcttccagacactgatgccaacaacaggactctgatttttattttattttattttgagacggagtttcactcttgttgaccaggctggagtgcaatggcacgatcctggcttactgtaacctccacctcccaggttcaagtgattctcctgcctcagcctcccgagtagctgggattacaggcatgcgccaccacgcccggctaattttgtatatttagcagacaccaggtttctccatgttggtcaggcaggtcttgaactcccgtcctcaggtgatccacccacctcagcctctcaaagtgctgggattacaggcatgagccgacatgtctggccaggactctgatttttaacacctgtggcctgaaacagtaattgtgtgccatcaccttaaaatctttcaacttcagaagaatagcaatactttgacctgtaaaatatcctgtaagcaagaattctggcccaacccaactcctacattagatatgacaaaattaaatgcaaaaaaactaatagtgtcagagccagagtttgaacctagcataatattcctactacactgctaactctgtgtgtgtgtgtgtgtgtgtgtgtgtgtgtgtgtgtgtgtgtgtacacaaactaagattagccatgatcgtttcaggaaaaatgatcaaacattaattaccttttgataacagttctttaatgagttaaaattcttattaattcaccattgataaaaattagttcagaaaacatagcagtgacaacataatatttttaaaatctcagcagggcgtagtggttcacgcctgtaatcccagcactttgggaggctgaggcgggtggatcacgaggtcaggagatggagactatcctggctaacacggtgaaaccccttctctactaaaaatacaaaaaactagcctagcatggtggcgggcgcctgtagtcccggctactggggaggccaaggcaggagaatggcgtgaacctgggaggcggagcttgcagtgagccgagatcgcgtcactgcactcttgcctgggagacagagcggactccgtcttaagaaacaaacaaacaaacaaacaaaaaatctcagctttggtgagattaagccagcctggatgaattatactaaccgtcatgccaacgaccatgctaggcacataatttctactatctgctataaatcacctatttgattttaactctcagttgaatttcttgattcaaagccctctcctatggccttgcagtgaaataaaaaataatgattactacttctattcttcagaggggttaattggcttgtagttcagtataagctcttcacaaaaatgttgaggactcccagaaatgagtagatgttaattttgatggtatggttcattatctaacatattatttaagagcaaaaacaatataataataaatttaacatatcacttacatttttatttatgccacagagtgtttaaattaaacagcttgattaatttttatcactttggatataatatgttttgtattttctttataacctcatatttttatagtatttttgccaatcttcttaaaaatatttaattttgtagtattacaactaatttcacttatttttactttcaatgtgcctactagaaaatttaaattacatgtatttgtagcttatattcatattggacagtgattgcttatatgtatattgcttgtgtcttatgtccagtcaaaaggaagtcaagaaggttgacaatctgaaattaaattgagttttcgagttaccaaaatacagtggttaaatttaactcttctcaaataactgtttctaaaagttatctaaataacattcatagttaactgttttccttattttactcagtgtttactcagcatgataacagctcttgagcatgagtcagtcattttttttttcctgttgatctggcactttgtgtcaccaatagaaataaaagcaaaagtggggttggctagagaaaggggaattgttgatccagagcagcacaccagggttcccgtattcagttttacctaaagtcattctccagcttctgtgagacgatttactgctgaagtctatttgtcttcctgctgctatctctgaacaagcccaaaccttccatgtggttaataaacttcttatcttttgaatactgaaaataaaataaacttaatcctcagggtggttcagtcagccgaccagaagcctttgagatgcttcttagagatacaggaaaactaggttttctgccctgtgtgattatcaatctttccattgcatgcatgtatgtggaagggcgttaaaggtgcttctcagtgataaatgtcagcgaaatcgcaaagtgaatattaatttcagtattgtcaaggtcagatgtgtacctgggttcattgttactggaatttttattgttgctgctattgggaaagatattttatcttgggctcattttttcaagtatggagaaagagtgagaaaaattcctcaatgtacatatacattgctcagaaaaaaagtactgtagcacagtctggtctgttaattagggaaattattttgagtccctaaaaaaagatcaaggtgtaagtttggaggagttaagctaggtgggaaacagagcaaacagatgatcacgagatctggagactagctggtcttcctgaaaagcagctgactatcaatcaatagaaaaagcagaaaattgaagaagaaataaagaagaaaatagtttgtgatgtgcccattaatagaagtagggtgtgaaattatctaactgggagcttataaattaaaagaagagaagataggggaagatgttaggttatgagtgttcatacaggaatgaataaccagctggacatctctgtatacagtgaactgcctcaaagccagtgtggtggcaaacctgtgaattcactcacccacacgtctccacctacacgcatgcccagtttagtctattccagtgtttcctttctcagtgaacaacaccagaatcacctagctatgcaaatctgtattgcaggagtcattcctgatgcttccatcaacttcactctcttaccaccaatccaagtcctgttgattttaccgtccctatagctcttaaatccctgcccttcttttcatctccatggccagccattattctaattcaagctgttttcctctctcttctggactatggaatattctaccaattgatatctcaacactcatctgtgccccttcaattcactgtctgtgtacagtagacaaagtgaaaaatgcttaaaatgggaatttctttctgatttttagaataaaagatccacatcctcccaaggcttttaaggcctggcatggacctgcccccgagaatttttctcacctcatttggactcctctcctccctgcaccttagggtcctgccatattagactgtgagttctatggaagtgttcactctttcccctcaaatccccgcagtgcctggaacactgtaaaaatagttaacattcattgagcatttcctttttgccagatataattcatatattatttattattaatcttcacaacaaacttatctggtaagcactgcccatttttttttaaataaggaaatttaaacacaaagacattaaatagcttgatcctagccacatagcttgagtgagtcttctggatttgaaccctaaatctctgattctggagggtataccctttactgctggtctctgttacccaagatgtaatagatgggatttgctggcatcttgggcatcaaagcatcccggaactctgacttccgtgaaacctacgtgttaggagaatagagtgctaaatttcttctttaatttatattccctcccaaaagagccagtttactcaaggcagttccttatcttttaaagccttgaaatagataaacaataaattgattccccgaagagatggtatcttttaaggtaggatctttttttcattatgtagaaaaatctgctcacttgactgtctgaaaaaagattacttgcttccttttcctctaataaatgacagcagggcttttttataaaagcaatctatacctgtcatttattgctctattaaaactacaaacatcagatattgattgttcccatattgaccataatacaagccaattttgagaaaggttgctgggtttagtcacattatcaccatgggaaacactctgagttgtgcataagctgaagacacctgcctctggtgcatatctatttatagagaactgagatttttgcatgcagaaatacaatcttgagatatatacaggctcaaatcaatgtgaagtaagcaagaagccagtgaatgccctttctgaaggtttctgcttgggagtcttctaaagaattaaacatcaatttatggtttgtagagtatggagatataacaacaaatgaaactcgatgtggattatttatgaggaggttaaaaggctccatttatatcggtgatgtcacatgtctggatcatcctggcttttctatcagggactctgttggccaggtttggtggtggtggttttttgttgttgttgtttttgttgttgtttgttttttttttagatggagtcttgctctgttgcccaggctggagtgtgcaatggcacaatcttggctcactgcaaccttcgcctcctgggctcaagcgattctcctgcctcagcctcccaagtagctgagattacaggcacgtgccactgcacccagctaatttttgtatttttagtagagacagggtttcaccctgttgcccaggctggtcttgaattcctgacctcaggtgatccactcaccttggcctcccaaagtgctgggattacaggtgtgagccaccacgcccggcccaggtttggtttttaagcataatcttggtcagaacttgggccacatccttttaggcatctatggaatgctatgttttccatctaccctttgcatacataatctcttcatgttcttctaacaatactgacagttaagaagattaaatacttcttcctccaattgtctaatgaggtaaccaatatttgaaaaagcttcagggtcttgatttcaggtaacaatattaactaacatattatattgaacacttgctttttcatataatctcatataatccttatgctagctctgcgatacagaaataatgaatacctgagaaaatgatgctctgagtatttaatacttggcccaaggatacactaatatcaagtaggagaaggggttttttgactcaggaatcaaaactaagatgtttcaatcctacctgaaatgttttttaaaaaagcactagttatcttagagatagtttctgacttttctatgtgattttgtcaaaaggccttgacaattcatttgaaaattagagttctgtgaatacttgtacctaaactgaattttctgagacaagcatcttgagaaaaatggatgattttttaactttctttgagtctcatgaaagagactacatttttctgagattggcaaaacattatttgatttgttgatggtggttattaggaaaacaacttaatggtaattccatgctttggggaaaaatgtggtttcctcaatacgagatgaaatgtgcgatcattaatttagttcatcttggaattattctcattgtttttacttgaaaacctcatatctgaagccttccacgaggtatagggtcgtttttgtctccatttcccaacttgtaagttctgttctggaaaggctcatgtcaagtatgttacccattcaacccattcctcctgatgtgtcctgtctcgtcggattcatccttcattcatccatctatgcaattcttaattgttcttcaagaaatgttcttaactaagccctccgttatcatcccagattcctatgtatctcatcaatagatctatttctggaattcctatatgtttggttgtccagataatttttagccttgattatatatgatatattgttcatttctaggtgttttctgtgcattttgtccttcctaagttccttgaaaatttctaataaaagttcatagttctagagaaagcactgtatgctgaacacatagaaattattattagactttaaaatcacgtggtacttttatctaaacatttcaatcacaatggggagtaatgagacccaggctaccgtggaattatttttaagtcagtgtgattaggtgtatatgacatcaagctgtcagtaatgtgtacatgtaacatttaatatgtaaacctaagcacatttgggtgaaactttaagtttttatcttccgtttggtgtgtgtaggtagtttttgtagatcacaaaaacagttgcatttgacattacttagaaatcagcacttgaaacaatttgagacttccaccatgcagtccagaatcttcgttgttcactacaatttgcattactaagcattgcttatgttttccaaagtaaaattcaaaaagctctacattaaaaacatattctacatacttcacaaggttattactacttggttgtgttagtgaaaaatctgagctgtcttcctgaaagaccttatctggaggtcaattcttgtaatccctttattatccaactgtttccagttctaggttgaattacaagaaatctgctttgaagattattttcttcacagggagtcactgaagtttttttctattaagctgtcaaaaatattcattaatatctaagcatatacatatgtgtgtacaaaggtaatatatagattacatccatcatctatatcacacattatatatgtgtgtgtttatccatatctgcatccgttctatatatatttatacacacatacgtaatggcgcagtttagaatattgtgtgttagcagatagaaaatattaaaactaaaggtaaaatgagcaggtaataactgcttcctccaaccaaatgttgccagactcctgtggttttgtaatagaaatctaccctatagtttgtgcttcttcctagccaaattactgtcttatctcctaactatgtacagttcagtcaaggagaggtttcattatgttaataattacattgcctgcaggctttttgatgttgcattccccatacagaatagaaacagatttcatagaaatatcattaaagctgttaactacaggagaaaaaaaatcaaagaggcaatcaaagcatatactttattatcaataaatgtaagtagtttcagaaatggcttgcatttgaaacacgttcactaagcagatcatcagcaatggaagctgctgcttaaagggagagagctttgtggtctaaatccatttggatcactacagatgattacttaggtcctttgctattcatttttaaatataggctcaagaatcatttttaaattagcaaactaataaagggatagaatcagccacagaattctgacctgaattcaggctatgtgaattatatataggtcattactgcaatgacaacacgtgacagtttttcttcaaatccacttttattttagtttttttttttttttttttttaacagtggctgttaaattgatgattttggaacagtagaactcattgtactacacagtcatttaaaaaagactttaaatattcaaatgttcaactacatattccctgacactaacatttatcttcattttggacttccagctgagaaacatcagtataatggctcggagacatcagcctcgttcagtattaggaagatagtggcatgccttgatccttctaaagctttttctttgaaaacctcatattcagattcttttttgaaaaggattaattaagttcccaagatttttaaagaaacatatatgaaaaatcataatttaggttttgttctgattattgcaaatatcaaatttcttacagtaaagggaagacaggaaggcagatgtttagatagttgaatgaaaacagagtaagagaaagaaaagataaaaagtgtattaattcatatatgctatgtgacttcttgattatcaggagccccaacatcctataaaacctaaaatatttggtgaattaaagcagatgaattcaaatgtctttgaaataccgatgatttggaaaataaaatagaagtctatttcacaaacacattttagctttgaaacagtagcatttgattaaaagttgaagatagctctttaaagtgaaattatgttttcctgttataaagtaattaacaatcactatgaatgatttgatgataaagaatcactgattttcacaaccaaaagaaaccagagatagctaatccattggcagctaaaatttgggggatagaaatggtagaagctcagatacaatgatagaagctaagaaccctactcctcaaaaaatatacatattacaacttttaatgtgcagataatttcaggggcttgttcatggaatctttgatgctaatgacaggtttctatcataggtagagtagggataaaaaaccacacatcctgtcatctataattaatcaattataaatcattaaactgagcagctctctctctctctctctctctcacacacacacacatacagacacacacatgcacaccctgtcttcaatatgattatatgtaatcaatcatgctttgttaaagattcggctaacttttatatgccgtttattgggtttaatatccaataagatctcattataaagtgctctgttatactataaatttttatatatagtcagaaattactgttcccagtgcaaatagtgacatgtaatacatctcatttactccaacataagtacttaatttgttctgagatacaggtgttataatgaatttccactgtaatgaaatattgaaatttaaaaaaggtagttggataggctgacattgattgatgagttacttgcatagattatgcatctattctgaaatctttccattctttgaagaaataggtaacttgaatggagatggggagaaattagaagcagtttgccacaaaattattgtccaactgaggggatcagtgaggaatattaaagacatcttcgaaatgatgagcagttaagcccattaagttccttgactgacatactaaaatgtaatgaaatggaaggctgaagctgttaacggtattgatttcacatctaattcccattgttaaaaattttttttctttttcttttttttttttttgagatggagtctagctttgtcacccaggctggagtgcagcggcacaatcttgcctcaatataacctctgcctctggggttcaagggatcagggatcaagggattatcctgcctttgcctcctgagtagctgggattacaggtgcccaccaccacgcctggctaatttttgtattcttagtagagatggagtatcatcttgttggccaggctggtcttgaactcctggcctcaaatgatcctcccacctcggcctcccaaagtgctgggattacaggcataagccactgcatccagcctcattgttgaacatttttgagtctccctttatttcattttctcttgcagctcatgtgcatgtaatgtatcacatatgtaaaagtatgtaaattatactaaaatatactttatggatatggagctgaataaatgtataagtatatatatgtacatgcatacctatacatatcttcataattaatgtaaataatatattcttcatatatatgtaagaacatatatatatatatatgacctataaatcaaagggaaaatattagggaaataatgaatttgaatttctggcatttttgtgaagatgagtaagcatttaatagctcaagtgaaacacagagcctcgacactagccaggaatgcagtaaacacatatctaacaagcaagcactattttggtctatttcagagcactgatattttatatatgaaatatatgtatattttgatattcatatttattcaaatcatacaattatgaaatttttattttaacatatgagaataatttgaaaatcagatcataaaataaattttacaacgaaagagttgaagtagaaaacaatttagtaccaaagggcagtcatttctcaggaaacaaaaaggcagttggaaactttacaccaacaaatcgaatgttctcatttggctggcaattgataaaaacgcatcctgttgttgtgaatacttaaagtaaatgatccagaagagtgcagttgatgcccagggtattgggattggcagtaccagtgtaaactgagtgcaaattatggtacttactgcctgatatttccccgccaatagtaattaagctacgtagatataaagaaattatcagatggggaaaagtgcccacaggctcacatgcacaccaaacacatagacacatgtaccgattttagttcataccagatgtgtgaagaaaacactcttttctgatcccttttagtaacaatgatgaatcaacaaaatcaaatgggttagactacataaagtgccttaggcctgtgatttatggtaacatttgtaactgtatataaaatcactcatttggctgacatttaatgagtcccttctatgtagcaacattgtgcatatccttgtggaaaagacagttgctgcaattacttgcacaactcaatggagtgtgtactggccgttctcctgggacaaagaaccaggacactgagcagccctggctaggcttagcaggagaggagtgtggcctcatgtttgttcttatggggatactgctttgagctgcagatattcctatagtctattttcccccatgatgcctgacggaagtgtgtgtgtggttgtcatatctgtttcccagaagtttccaagcctcaatgattctcagagtcatggtcaggtaaggctgtgcatgacctcccgctccagaccatacacagcccctacattgctaagtagctctctcagattgctcttccatattctcataggtttcactctggatgaacagttcatttgcagcttctcttccgtgccacacttggaacctcagaaaactctgagtgatatgggcacacctcacactccttccttctcagcaaatttgccacctactatgcatgtggtggatcagataaggtgcattttcttctcctttgccccttgaaacttggagtccatttgaattgtgtcacatcaccccattgtgctctagtgggagagatgagcagaaacttcccacacactgcctccctttcccttcccccagatacccactcatctcccagtcctcctggagtggttctgtttgggaaactagggctcagctctcacctgctttgaatgtgttacaagtcacaggaggagtgatgcccttggagttgggtcattttaaaatccaaatctctgctcccagattgagccatgttcacaacaaagaacaccctttccatgtggccacaagagagcaagaaggaacacattcaatgagtactttacttatcaactgggccacatgtttatgcactgtctgcaccatatcacaattctggatccctcacatacggcatatatcttaacaggtcattcagtctcaatgttctcgttcctttctctgccttctgtagaggaataataggttcagaatcagaaatgtcccctcttgaaatatgtgcgttgtctttgtgaatatatcaataatagtataagcatacaaattatttatgtttttttctttaaaatacagtactgtgaccatccacttgaacaatattagtggacacatttttggtttgctttgtttcatttttttcccattaaggaaatgtctgctttgttataacacaatactaatgcatcactgtacactttaagactcctcgttgttcaactttttctcttaaagtctcctttttggaacatagagctttttcatagaaaaagtatttcttcctggaagaatattgaagtggagacactcataaagtgtctgtgaaaatacaactctctaggagtaagggttctttctgtgaaataacacatcaaagaggaatgaggagagcaagacaaaacccagtagagatggattggaatgggatgcattactttggagtcatgaaacatatgtactgtctgtgtatatgtatataaacatttgtgtaaatatatgtgtgtgcgtatgtatgcatgcacacatgtttcttagctctgttcaccaaaaagacctagaagcaaatgcactcaagtagcaacttatacacctaggattcaaatatttgtctttataccattccccactaaaagaaccagaaaaccttgaaggaatgtctttttctagagctgaggcaagatcaagatgagcctggaacatattatgccaaaaagaaaagaggtactccaataaacaatggggcatgtcacagggacagagaaaaacgattaaaaagagcttccctagttgaatctgggtaaatttgaacaccagtataattaaggacaataatgaattatagattataaaaaggaatccatgtgcccattgaaataaaagattcacaaaagagaaaaatatggacttttgcttatagtcaaatgctaagtgtcaacaagtaaatgtagagaaaggaatgctggaataggaaaaaaaatcattattttgtaaccaccatgctagaaatggactccatcaagaaccattagtagatgctaaatctatgggaaatgttgataacaagcatatttatatggtcctaatgttatctccccatgggttgcttattagttgtaagtggtagagtagagggctgggaaggcgtaggggaccttcaaattctgcttggccaagtactcagttctggaatcataaatgaggccagagagagagcttgtgcctctggatgtgatgccctgagaacagatcatttacatttcatttgtctgaatgcataacctaagtctaacatgagacagagacacattcaaaatgatgaacattttatttataaaaaggggctagattctttaaaaatatcagttgcctgaaagtcaatgtatttagtactgttccaactcacagcagcctggaaagacatggcaacaaaacctgaccctaaactggatcctaaattggtgaggggagtgctacacaaatgacattattggtcagttgccaaaatgcagatgaagattagataaaagtattgtgttaatattaaattcactgaagttgagaactatactattcatatacacatttatttttaagaaatatgtaccaaagtatttaggattaaggagaaatgatttgggtagcttattctgatgatatatagattctcttgtgtgtgtgtgtgtgtgtgtgtgtgtgtgtgtgcgtgtgtgtgtgtatgtaattatacagaaaggaatattttggtatatatatttcaaagtgttgacaataggtaagtctggataaaggaaacatggctgttctatgcactatcctcattcttaaaatttcctttggttttaaattatttaatacctttttaatggcaagaaggaaaaaaaacacagtaatttgtaaagataaaaaaatacagtgttaagaacaaggaatctcaaggttccaggactgatgggaaatatgtgaaggtgacattaatacatgttctgccatgaatagaaatatttttccaaatgaatgtatgagcagtgataccataaggggcctgggttccatggaataaatcttgaaaaatgatgcagagttacgctgttaggttccacgctgatctaagaagtgtatcaacagattcatgccagtcagtttttcctatgccatttttgctatggaagttcaaactctcagaactgtattacaggcctacaatgtatatctgtccaaagctaggtgttatccaagcctggggaaaatacacagacaacattattaagtaaggctgtagttaaacctggaatggtggtatcatttgttgattttaggtaaccatagtgtggccattgcatttaccatttacaagctatatacaggtccatatgcaggaatacaaaattatgaaaaaatacaaaatttgcagagaatcaaaatggaagctttttcttaacacattctgtatctgaacctgacctgacctcatgctaggctattcatagtctctaatgagcccatttggcatgaatatcatatgctttactgcaaatatatagttacatttgattaacaatgtaaacaatttgatatgagtatcatatgctttactgcaaatatatagttacatttgattaacagggtgctactacagaccccattagggaaaaaagaaaaaaaaaccctgcacagatactatgttacttttctaaaatctgaaagtttcaaaatcttaagatacctgggctgggtgtggtgtctcacacctgtaatcccagcacttcgggatgccaaggcaggaggatcgcttgccaggagttcaagactgtcctgggcaacaacatagtgagacccagtatctacaaaaaataaaaataaaaaaataactggtcatgatggtgcatgcttgtagtcctacctattcaggaagctgagacaggaggattgcttgaccccaggagttcaaggttgcagtgagatgtgatcatgccactgcactccagcctgagaaacagagcaagactctgtttctggaaaaaaaaaaaaaaagtgttttaggtaaacgattgtggatctgtgctgtctaatttcattagcagacaagttatttatccttcttaagtaacaataataagagaaaatgtaatactaaaaagtggaattgaaaatggaacactaaaattcatttaatgaacccagaatcaggcaagattttaaaactctgacttaaagaaagacaatgtggtaaattatccatagctgtgcgacctattttaattataagtagaaccataatatacaagtactccaaatgtactttctcttttccttctgcagttattagccatgtgcaggcaaagacatagtggcatagtggcaaatttttcagactaagaatttagattcacaatcccactctttgctgccattatcttagtcacttgtactcctttaccagtttctctaaatgtaaaataaaataggcaattttggttaatgtaagctttcttatgaattttaaaatgaagcgattctaaagcttccagagtttatatttttatattcttattccatattattctaaaatacatactcctagaattttattgaactgtaaaaatgtaattttgtttgttttgagaacaaaaacccacttatcctaatcacttttctttctttctttattatttttttatacagtgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacaggtaggtgaaggaatggaccacactgcttccatctgttggatgtttccatccattggatagctctagggctggagaaataggaaaagactcgcaaactcttgaaacagcccagtgttaacacattcattgaaaagctgattagttttaaagcacttgttattggaaactttacacaatttaattaaattctggtggtaagaggtaaatgggcaataaagtgaagtcaatagaaaggataccaattttttggttgagtctgcagtggcctggcgtgtgtgggcaaccagatttgtattaactcacctggtcgtggaaggcatttgcagttttattccttagactaaggggtgattgccctcctagtcaatggcgtttgccaaactgcttttttcattctaagacatttatatctaactcccttccatcatcaggatgtgtcctaccattttttaatgttttcagaagaacttactctgagaagcctagtctccttctccttacattttgctcctacccaatggttagcatagacacctgaaaagaagcaaattaactgttcaggtaaactaaaagtaaaaaggtctttagggagacacatgaaactgaaaaattctatttggtgatacatgcacacacatatgttaaaaatagaaattgagtttcatatatatgtgtatatataatatgtatacctatataatacatatatattacatatatacgtatatgtattatacatgtataatacatatataagcataatacatatacatatattatatattatataatacatatatacatatacatatataatacatatacgtatacatatataatacatatacatgtgtatatatacatatatgtgttatacataatacatatataccacatatatgtattataacacatatataccacatatatgtattgtaacacatatatacatatatgtattgtaacacatatatgtatatatgtatatatacatatatgtattgtaacacatatatgtatatatgtatatatacatatatgtattgtaacacatatatgtatatatgtatatatacatatatgtgtatatgtatgtgttatatatagtatatataatatataatgtatatgtattacatatctatgtatatacatgtattatatataatacatatctatgtatatatacatgtatgtattatataatacatatctatacatctatatgtatataatacatatctatgtataatatataatacatatatgtatacatatatataatatatgtatacatatttataatgcatatatatatgtatgactgttgaggtatttacttccagattctcaacttcatgtaggaaaatatatacagacatgtatatattcaatagttaaatcaaaaattggccccaggatatgggagttcttattatttgttgtgaagcttgtcaagcatagaaaggccttcctgctttcacataaactgcatgatcagaatttttacttaaaaataagaaatattttatattcaaaaatagctcaagcccagtcccaaattatattataagataagcattacaagagctcctcctatgtaatcatgggttgtatttttttcttgctatcttcaagctattttttgctcttgttttttcaactttctgttttatctgcctttctatatattttagctcttcaacgcattttgccaaccaatttaaataaattcaaaaccatcatcatccaagatagatgtgagtgtgaagatctgattcctcagtaaccttcacctccagtatctcatttactgcagccatgagaggctcaaataatttcaaccaatctaacagcattttgggagataaaaattgtggcaaagtgtctgacagtttcaagagctgtgggtatatttcagcaagagaagcacaaaatctattatttcttggtgaattattccattttgggtacaggagaaaatctctgttcccatggcgttataagctgccttctgcctgtgagggtttaggtgtgggtagaataacccaaaccattcagtacattgagtagtgttaaacaaattggaacttaatgactgtaaaaatagcatgtgctgttttaacaaggagtctacagattagttggtttttagtgggggagtctgtgtcacaaggtaggttttatagctcattagaaggctggagtgtagtttgtaagagtctaatgtccaattcactgattgcacagaatgagtgccatttctactttaatgtgcttccttgataacagttttggtgttttatgtctccagaatatagaggttgatggactatcttataaactggaaggcctgaaaaaattcaccgaatatagtcttcgattcttagcttataatcgctatggtccgggcgtctctactgatgatataacagtggttacactttctgacggtaagttaaaaacagtgaaactccttttacatatttgacataatattgacaataatgacatgatattgcacatatatcatatattccattttcaaggcttcctgactaaaattttatggactattacagttaaatgtaaactttctatcaagatacatactcccagctggatgtggtagttcacacaggtaatcctagcactttaagagactgaggcaggaggatgagttaagcctaggagttcaagacccacctgaacaacatagtgagaccctatctctgtaaatgttttttttttttttttttaattaactggatatggtggcatgcacctgcgatcccagctacttgggaggctcattctggaggatcacttgagcctgggagttcaagactgcagtaagctgtgatcgttctactgcactccagcctgggcaacagagtaagaccctttctccaaattaaataaatatatatgtatatatgtatatacatatgtatatactcttgagtcagtatatactaataggtaatcctcaaaatgtgactattgactaagagctaaaactttgtgtattttttatttctttacattttctaatacacatttgtgcatgtgtggattaattttgattggcatgttttattcccccatctaaaagtgtgcagatgattaaaggtgtaaatgatagacaatccccctatatttacctcttaattagaaaatatatcaaaaggaattaggccaaataagctgatattaaaatttaaagtattaaaattgagcatgaaaaatgtgtatgttgcctactaaatggaagaatagacacaaacacacacatttgagacaagaagtgcagtgactcaattgtgcttcactacaccctttattcctgggctcaagggcttttcttttcttttccttttttggaaacggagtctcgctctgtcacccaggttggcatgcagtggtgcagtctcagctcactgcaacctccacctctcgggtttaagtgattctcctgcccccagcctcctgagtacctgggattacaggtgcatgccaccacccctggctagtttttgtatttttagtagagacagagtttcaccatgctgagcaggctggtctggaactcctgacctcaagtgatccacccgccttggcctcacatagtgctgggattacaagcgtgagccactgcacccagcctcaagggattttcctgccgaagcctcccgagtagctggaactacaggcataggccacagcacccagctaatatttttattttttgcagaggcagggtctcactttgttgcccaggctagacctgtttttgaatgccataaaagagaggaacaaatcttaataaagagaataaatttgacaaaataatggccaggggaaactagaaacctaactgctagatgatcatgaaaggttgggaaattttataaaaagtgaaaataaaatacatcaaagtatatgatgtggggccaacgaaaactcaggcaggtgcagaaatgtagcgataggcccttgtgaatattaaaaaaggccacaagctagctcttttcagcaacaatttccatttggtgtgtttaattctataaattatttatctttttaattaaaaaatgactttagcttgtgatttcttgacagatctatcattgtttattctgggaaagtacctgggtgtacatttcacacaatatcagtgaaatgaggaagggcatgcatattattaaggacagtacaaagagaacacaggaataatgctcatttgcaaattcaactttaaaatgtattttatacgtaataccactttggtatcatttttaatgtaattcttaggcccatccatccaattctgttattgaagacagaacagaatatttattggtagaataaattacttcacaacttataattataaaaataaaagaaaaacaaatgaaagtgaatgttttacataatttatgtagatttcattcactctgaactgtaatactgtggcctgattctccactttggttttaaatgtcataagtgagaaagatagattattattcattagtccaagaattatcttctggaaatgttacaatgtttaggacttagacagtgtctgtcagtataaaaaaagtatttcgtgaccctaaccccaataaacatcactgtgcaaaggacaccaaattctctctctcaaatgcactgaaaggagatagcaaggactttataagcttcttagagtggacaccgtgacctcgtttgcattcatttttacaatcaacccatctcttttaatgtccaacacaaatgtgtggctcttggctttcatttccttattatccagttcctttctgtctacttcaatctcatgtctcctcctctgtcctgaagctgttcatgctgaggtcatatatcacattgagttgtatttaatcacatttaatagtcacctgcttcccagtcttcagtcatggagcactcttcttcgttaactttatgtatgttgtaacaggtggatgttgtgaaaattaaatgggctgatctgtgtaaacatctaacaaagtgtatgacatttaagtgtttaataaacattatctctaccaaagtgcacttcactttttctcattatattaatattaaatacccctaaatatgaaggatgctgttatattcacctctgttttcttcctgagtaaatatttatcgaattaattagacagctcagtcaaaactgtgcaaatttctgtatgcaaaggcttatctttaggatttcccatttgtggaactaatttgatatattaatttaatatatgactgtgtctaaatgcatctgtattatagtgaacataataattcttttcatatcaggagtcttaccataaaaaatatattgagacatagaaaaatttttaaaaaagcaaaagttaagtgtaaatacatttcttccaatttcattactttatgtttttttttccctgttctactgggatgcttgtaaagatctttgtccagatgagctgtcatctctaatttagctcggctttattttctgagtagaaaccttattttttattcaaattcctccacctagaaaaccactggtttacaatgagccatttttttttcacaccactgagattatacagcatatgatcatctaaataattttgccaatttgttccaaaatactgtctcttgcactagttggtaagtcactaagagcttttatgaacgaatgaaccattgaaagtttccatgccagcttgtcctgtgtccaaatgcagaaggacctgatttcataggcaacataagaatgtgcttattatttttatgaatgttattaatatttcttgaatacttactaatggaaggccctgatccaagtactttgcctttacctttcatcctcacgatactactaaaattttccctactttacagatgacaaaactaagtcagaaagagttcacaacaggtagtaagcagcagagccagaccacataagctagtaaattcagaggcaagattcattgtggaaacatgtttcttttattctatgataagtgcctttaaaggaaaatgcttataattaaatatgaattactggccaggcatggtggctcactcttgtaatcccagcactgtgggaggcccaggcgggcagatcacaaggtcaggagatctaaagcatcctggctaacatggtgaaacccactctctactaaaaataccaaagaattagctgggcgtggtggcgggcgcctgtagtcccagctactcgggaggctgaggcaggagaatggcgtgaacccaggaggtggagcttgcagtgagccgagatcgtgcctctgcactgcagcctgggtgacagagcgagactctgtctcaaaaataaaataaaataaaataaatataaaataaatatgaattactgctgggcagtaattacacttgtaatcccagaactttgggaagctgaggtgggtagatcacttgaggccagaagttcgagaacagtctggccaacatagtgaaattctgtctccaataaaaatttaaaagttagccaggtatggtggtgcacacctgttaccccagctactcggaaggctgaggcaggagaatcacttgtacctgggaggcggaggttgcagtgagcctagatcacaccactgcattccagcctgggcaacagagagaaattctgtctcaaaataaattagaattattttggtctataaattctgtgtacatggcagcatacatttgctgaggggaggaattcaagtgcctgtgccttgggagactcatttacaattatggggacttgatctgtcctacaaaatacctcatctccatgagtttcaagccaacatccttctccatattgagggaagtttccagccccacctctcattggcttgaatggacctatttattataaataataaattatttgacattttgaagagaaaagtgttctttcacttctgcctcatgaaacaagaagcgtcttgggaagacaaatatagaaaagaacaatcgatatggattctcttcactttcacctagccctagcatctattgtatctatctatctccaaataatatggaaattgatagtgagaaggagggagtaggaactgatcactaaaaatactgtagaaaaaattctctactctcctccctgacatgacaacaatagccagtgtgctatcagtggaaagttagagaagaaatgtgcactgtaaaaaaatacagaaaaactacttcaataccattacaaaaggacttttagcagaattgtattttattgcctttcaattcttgttttttttttttctttttttttgagacagagtctcactgtcttgcccagggtggagtgcagtggcacaatctcagctcactgcagcctccacctcccaggttcaagtgattctcctgcctcaacctctggagtagctgggactacatgagtgtacccacacgccaggctaattttttgtatttttaatagagatagattttcaccttatttgccaagctggtctcgaactcctgacctcaagtgagccacctccctcgggctcccaaagtgctgggattacaggtgtgagccaccatgcccagcctgcctttcaattcttaatacagaaaacagccctgatgcttataaaattgtggtagctacagaaaaaagaacacatatatatctatcctcttaaagttttcttggctttctagaaataaggagttaaatgccacttgtaaactcaaatgaaagtgacatttaagggttgcatatcagctagaacagtacctacaacaaaacacatgataaatgttaccttctctttcttccaaaattcaattatctatcaaaaattcagttagtaattgatattatgtttggatactaattgatcaaaaagttagtgtaatattattagaaacatatagcatgacatgtcagtattacaacattaaatataaactagaaatattctttcatgtttaagaagtgactcggccgggcgtagtggctcactcctgtaatcccagcactttgggaggccgaggcgggtggatcacgaggtcaggagtttgagaccagcctgaccaacatggtgaaaccccgtctctactaaaagtgcaaaagttaactgggcgtggtggtgggcacctgtagtcccagctacttgggaggctgaggcaggagaatggtgtgaacccgggagacgaaggttgcagtgagctgagatcgtgccactgcactccagcctgggtgacagagcgagactccgtctcaaaaaaaaaaaaaaaaaaaaaaaaaaagaagtgactcaatatcacttaatattaagacattatttccaaactttgcttttaaaggataacatttttggaagtttgtgaaattatatgatatagagcatgttattttattctacaaatagtacttcaatttaaaaaactaaattgtaatttttatgtcaataattataacgtttagaatagattaaataataatacaagtacaatttatactttaacttaaaaatttacaaaacaaaacttgggaccaaaccctgaatatggaaccatttttattataatttataaactttttattaatatatttattcagcaactatttactgagtgtacaccatgtgccttcaactcttcctgatactggtgatacaacatcaaaatgaataaatatctttttccttattggggttacattctgtatttaattttaaaatcagaataagaatctcaaaaaattaaataacattttataaattgtggaatatttttgaaagaatacttgctgagttaattcatgaaaaacaagcagatgagcattttgtcagaaactacactggctgcaaccttcatcaggcactaagatcagaagttcaaaatcaaaataaaaaaaaaagatttcattttctgttattcccagaaaggtctagaactatataagtaagtactcatttgctcattcaatcattaattcagtaaatattaattgaatgtcagtttggaagataaaagattaatcggtggcacatcatgtcttcatgataattactatttagaagataaattcagagtatggcataaataaattcatggtcagatgtaagtactctatagaaaaacatagatttttttccaaattctagtaaaagaaggggaaagatgtcaaaaatggcccttagattcttgaaaatgcctgagaacttttctattaaactcatctatttgtgaggaacaaggatagggactactcactttatagattaatatgtgttaacaatttattgaatgctacttctattcctattatggggcaaaaagctttatttcatttatttttcatcccagacatctagagtagttcctgacacataaaagccattcaataagtggttgtttttaaattactcacatgatagaatattcacttttttggtagagtaaatatttattataagtattaaaagagagctgtatatgttcttccttctataaaggagtagttaaataaaaatgtaggcaagaaaaacaaaataccgtacctagaaactctacaaagaaaaatatactgctgctttgctaatagaattgactcatcaagtgctatttgcaacctgcttgtatttatcacataaggtttaattttacacagctaaaagaactgagaagtatttcttcttttcactttttaagagctaataaagtttgcattacagggattaagaaacctggctgaccattagaatgacaaattttatcataaaattatgcagattctgaaatgcgcaatatcttaagcctttaaaactactgtaagaaatctcctgtgtgtttttattggtttctctgggaaagttatcacaagagggctgtaattaaatggtggtgtttggtatcactgcccgcgttctcttgcgtaacagttttaggggctccctacataggtaagttaactggctagcgaaatgagaaaaaaaaaatagacaaatacagttatttttcatctctccaaaaatttttgaagtactacctgggttaacctacctaattatcattataaactatataaacaaaaccacactctctttttactagacaggtggtatttttctttcaagattttggcagtaactgtgacaatttgtttgattccttttagtgccaagtgccccgcctcagaacgtctccctggaagtggtcaattcaagagtaagttggctaaatgttcactactccattacctatcaagattacctatcatgtataaccttcactcacccaactgctgtcttgagtacaggatagtggcttccatgtgcagaaatgttctggaacaacacagcaagtgacattgatcccacatcctcttccatcagacttaagtaaattaaatgaaatatttgtctacttctaaacaaatattttgatttacaaatattaaacaaacattgattttgtgaatgttttagtggccaaaggctattccataaggaaacaaagacatctgcttcgtctatattcaccagtctatcatatagcaatgatgatgtgctagatgaggaaattgaaataattaggagaaagaaagactgtttcctaacacattacttagaattgaatatttcgtcatcatccccattcttcctttataaatgtagtcattgaaggccattcttgaacttcaatacagttatatttatgtagcgatgttacctagttgttagaactttcctggcctggaatgttgctatgacttccaaaggagctcaacttaggctagtattgctgaagtagcctaatgccagaggtcagttttctagaaacatgtcattatttcaagtgactcagggttggaaataagccaaggccacctagtagagtataacaaatgaggattcacctggtttgaccctgtcaccacctggccactatgcttggacctccagttaggtacttctcatgtgaggaaattggcctaaatgatttctaagctctgggagacagcagagaaatgatacaggtcttagaaaaagtcatactctgggttttaaatctagctttctcttttcataactatttggtcttagcaaagttttcaaccttagcaaacctctttctatgtttaagtatcctaagaattactatcttccttattgacttatcatgagaaagtaatagtaaaatgtatgcgatgaatctgacttgatagtgattccttcattccatgtgcaaatgccttgtcatattttgtaaaaaatctatgaggaagccatatcttgtgatgttaattggatttgtctcagtcaaatgaatttatcttttgaagcaagtgaatgcattattctcttatacttttaggcaatatgttggataagaactattaaagcaaacataaaattagaagaaaataactaaacttagtggaaaaaatgagctaaaggaaaataatcaaaaattaacataaccctacaaatgacatttttatctgcaacaacactgctttagagatgtgccacttaaattaagagattgccaagtcaaagtcaagtagatttttacaattattgtatgttgttaatgaatgaaatttggaaaacatattgtaatgtctcttgtttaacaattcatcattgttagaatcctcactcactttatgtttttcctccaggacagaatatagaaattgatatacaagctattttgtgtttgtgtgttcataccctttaagagtgtactccaggaaaagatgaatgttttcacttgaaacgtgtatagggcattactgaatgaccctggatgctaactgtatttgaatatggatgtactttactgaagacggaattcctggattgcaaaattgactatatatattatacacacacacacacacacacacacacacacacacacacatatgtatatacacacacacacacacacacacacaaatatcacagcttctactcttctctaatttgcttgcttgcagcaagcaaatacaaacacttctacttctatcctcttgtagttgatatctggaacattgcactgctagaaagtttaaattgttcattcgcttttcagaatgaaaatactatgcccaggcactggaaagtcacactccctctctcctttttctctctctgatcttatttcatagcttctaagaaattatgaattataaatttttatatcagactgttttcaagagaaaagaaactggatgatcaaaacaccactttttgcattctcagtgtattgattcagacaaaggcaaatgtaatattctattttgatatttgtgttttatttgaaatagatgaaaagttttaaaatatattaatatttacccctgactgtgaccatttcaaggggcaaactgtatttaaaaagaaacattatagttgaataaataatgtgttcttttttaatactaacagaattccagggtgtttttattttttttattctttagagacaaggtctttctttgttgcccaggttggagtgcagtgacacaaccatgacttactgcaatcttggactcttaggctcaagtgatcctcttgactcagactctagcatagctggtactacaggcatgcaaccaccatgactgactaatttatttttgtgttttttgaaagacagggtctcattatgttccctaggctggtatcaaagtcctgacctcaagctatcctcccaccttggtctcacaaagtgctgagattacaggcatgagtgaccatgctcaattcatgaattttttacgtaatttattttacttgggattttaagatggaagagaacacactttgaaaacgtattctatatcatatttgtaaatatagagcacaattgatttttttattgatagtaaatgaaataacttggtgcaactaacatttttgcagaaagattattaggatctctgtacataaaactgaggggttgttataagacatatgatcacaatctaggtactcgttaaggttttggtcacccgtaagccagttggacccagaaatcatgttccataataattaagcagagaagtctttacacatctagataatgaaactaagaacaaaattctcttactgtatcattcttgaaaacccagtatggtagaatatttttacaaagctgtaatagcagaacagattagattccttttctacaagctaactatgaacacaagttttttgttgtactaatggcttgacttacacatgttacatgtcaggtgaaactgggtcatagtgaggtggttatttctcatactaaaattttgttacaagaaatagtatcttttccagaaaaagataatggtttatgaaatggactttaaaatgttacgttttattaggaaaactttttataagaataatttccttaagaatttaatttgaaattcaattattattcaattattattgattcagttattatatatttcaaatacatactacaacttaattagttggctggaacataaaggatacatttacagaatgcagagagctaatgttggggcacaaatattaatacttccctatgtttcaatctaaaagttctgatgagtaataatgtttagaggatgatagaattcaagttgcttgggtccttttattaactctttgaacctgtgaaaagtcacgtgtctcagttttatttattcaacacttactctgtacctgttttaatgtcatacataataaggaatgtgatctagaatttgccttcatgcagctcacagttgggtaggaaaacgtgaaagaacattcactgttcctctagccactttaatctgttgaacctttcaaagttgacattattttctcattttaaaatgagagagctggatagagaatctctaaaatctcctgtggcttcaaacatctgtgcctgtgtttctaaccattataccttttctcaaccattttactgttaaagaattagcgaaaacacaaatcaatttcagtataccagtcaactcactagttcagatatatattgactgagcactacagagtgattgcaaggaatgaagtattaactcccctttccccccaaaaccccagtatattatgaggcatagatcattgttcagatttaaatttttaaatgcaaattgatggattcctctcattatatcacctcacacctctctgctgttgaaatccttattcttgaacaccagatgcatctatgtgaatgtctttttgttgcattcctaaaagctggtactcagtcactcacaatctgatattgtacatggtgccttcaaagcaaccgaagaaaaagtttctagtgccttcctacgtcttaaagtgtctcactctcccttgtttcagcacaacttggcatgcttaaataactcaagcctgagttcagcaatcatatgatttcctttatgcaaaaactatacagtaggagaacagcaagtttctactctgcaaagcaaactgatcatttttaacagatattttaacattctttgtgtgtgtttgtgtgtaacaagacagaggaaatctaagtgtattatgggataactgcagaaggacatgcttttgaggatgtggtgcaacttgttggattttgatggaagtctctataccctgtcattgggctggtgttgcttctcttattagccaagtccatagccaagtgggtggctgagtgagtcatttgcatatgactcctagtgggaagggaggagatggggaaaagctggaggcaaggaaaaaatgtgagttatgatattaaattgcagatcctctgtgtctggggtatgtgtatgtgtgtattcagttttgttttgtttttttctgaaattggggttatcttctcttggttattcagaaggggtttcagttcacacacctccctgctgcgtgacaatctctctgaaaacatacttttagaaaaggggtctggacccacttctctgctttcaccattcttctagtcaacgttcatttctctcctgtatgttgtatggagtcataggcctcaggcagcccatggaaaaacatgcttcttcatgtctccctaagtcctttataaaatacactttggctgctgagttcctggacccagagctctgagccctctcctcacaaatgtagtaggtttaaaaaatggatttagtgaagagaaagaggatatatatgagactgcagatgattgtatttatttaaagataaactagaaccagcatttgcttattaatgaacaatttaaatacaacaatgttgactctcacaagcttaacaatgacacttgtcctcaatcataacacagagcatttctgcctgagcatagtatttgccctagttatccatccatttaattcaagtaggtgtagatctcttatatttattttagttattgattccttcatctattcattacatggtgatttttaagcatagataatgtccaggggcctatgattgaaagttttaggaagggtggggagtaggagcataattgtaaggaaggcaatatttcctgggggctcttacagtctagtctttctgtttggaatttgtaggaaagactagactggatataaatgattatattacataagaatcagataatttgtaagaatctgtgagactcccttaaggataagattgtgtttggtctataatttgggtagaactcatcttcagatctcttccatcctgtctttttacttaatagatccttttttattgtggtgaaacaactttatataaaatttaccattttttaatttaatttaattttttaaattaaatacaaatttaagcatttgtaaatgtgcagtttaaatgtggtaagtacattcacattgttgtacatctatcaccagcttccatctctagaatattttccatcttcccaaactaaaacttagtatctattcaccagtaagtccccatttccccacacagtcatagatgtttgaagccacgagattttagacattctctatccagccgtctcattttatcaatgagaaaataatgtcaactttgaaaggctgcaacagattaagtgtggctagatgaaaagtgaacgttctttcacatgttttcttacccaactgtgagctccatgaaggcaaattctggatcacattccttatgtgggaatgtgagagaaaatggggagttattggtgaatagatactaagttttagtttgggaagatgagttctacccaattacagaatccctggcaacgactattttactttttgtatcccaacttactttataaatgagcaaagaaaccaattcataaaaaaattaatttcccttttgcttcatttaattgagaaataaaacagttttccatttttagatcccctttcttatagagaaatgaaaaacttaatgaatcagtggtcaagaatacagacagatgctttaattggctaggaagagatgcctcacttcccattattgtcagtgctttcagaatacttctgttccaaaattccacatttataaattgtttttagaaaatctgctgaaaaagccaactgtcatatttaataagaggaaaccagaaacataaacataggattgttccaaagaaactgtaaaagacataattttgtctcatattccatcagaatttagaccagagctcctgaccagttgctaaattgattcttagactttttttgaagttccaaaaactcaacagtttacgtcttttttcagtgaaattacagtcaatgaataaagatcaaccatgaattagaggaataataaaatagtaaattattggataactagtttttaaacaacataaatgcatcattccaacttaactgctttctgtaattaagttgaataaaagaatactctgcaaatttgcaaattcaaagcatatctttgtattacactatcactcattttctcagagcagcccttcctaaagtctatttgagagaatacttacctttttcttttttctttttcttttttctttttttttttttttttttgaaatggagtcttgctctgtcacccaggctgcagtgcagtggtgtgatctcagctcactgcaacctctgccttctgggttcaagcaattcttctgtctcagcctcctgagtagctgggactacaggcgtgtgccaccatgcctggctaattttttacttttttttagtagagacggggtttcaccatattgtccaggctggtcttgaattcctgacctcgtgatctgcccgcctcggcctcccaaaatgctaagattacaggcgtgaaccaccacgcccggcctatggtactttcccaagaaacaaggttgctatggcttaaaaaattgtgagaaatatgtgaggtttcctattggagatattaaaggctatgagaagtatttgtttaactcagcttttttaccaattgttttttctacaaaaacattttagatgaaatacagcctttaaaactctgtcaaagttacttaatgtcattgtaacattacaaatgagaacaatgtactccataaattgaagaacctcatcttcctccaaaaataccttcttatctcaattaatttaaaataataatatatattaagtgaaaaaataaatttatggaaagcagaagtgaatcaaggaatagttataaaggacatttatgcataactagaataggatattgagaaccttctgtgacatctgttagaagatttgaataagttagagacatgattaaatctccatgtcaatatgaatttttattaatgtaaataggacttaggaaaacattttctagacttttctcatctttcatatttcatatacataaaatacatcatttttctgttgtgttttgagaatgttatatttttgtcttttccaatttattgcagtcactgccattgagtatacttgcacaaaggattttgacaaaaagagattaaaatatatgatagaataccattctcttttgagttctagcctcactttaatattaccttataatttatacttcatcacacacatttctaatggctccatttctgcttggctctgaaggcaaagctcactttagcctttccatgaagtttaatgagatttccctcaagtcatacatttttgaaaagtgggaggtttaataatgggcttaaattaaatgaacctaggtctagtgataaggtctctgattttaatttagttcatggaagttgcccttatagttggaatggttgattagttagaagacatgaataagttcagccctaccagtaggtaaaagcagttgctaactatgtgatttgattttaaagatgttgaaccattcacccatgtgcaaaaactttattcagtagtatagttttgaatgttatttatattataaaacaacttttaaaatgcaagcactttattgaaagatttaacacattaacacgagctattttagtcaatattctagacacacattcaatgaatacctaattataactgtaataatggcagtaacctttcccaaaggtattttgtgcctggcaatgtgctaagcaatgaaagcagaatttcatttattgcttttaataatcctataagatattataaaactaattctgaaataccaattttgaactgtgcttgttgctggaaaggctataacaaaagcaatcaaatgccttcttttctagagcttacttatattctaatacatggaaatagactaataaacaaattaacaattgacacaagggagtggtaagttctgtgaagaaaatcaagaacagtcatgcgatagaatttgaggacctcatttaaatcagattgtcagggaaggaactcttaaggagatgagctgaggcgtgaatagaaaaggatcagctttgtgcacactcagagtaacatatttcaagtgatgccaacaactagggcaaaagcagtaaggagggaactatctttgcatgactgtgaagctgaaatgagaatagaatagaagacggattgctgggttccggccagatctggcggggctttgtagggtgtgataaaagttgggatttcattctatggacaatgaaaagcatattgaaaggagagtaatcagattcaccttttttaagaattacactgactactgtgggaaaattatcagggggtggaacgtagaggaagcaggaagaccagttcagagacaaccaagtgctccatgtgagatcatgtagcaggaacctaggagtcataggaggtgatggagagggaagtagaaacaatcagggtctgtgctggatctagagccaacaaaattggttattggattatagggcagaaggcagagcaagatcaaggatatagagtagatttttggctataaaatgtaagcagattgtggagctacttaatgagataagatttggtttaggggacaatcacttttggacattttgaattcgagatagctattaaatatacaattaggaatgtcaatcatgtagacaagttggtatatgataatagttctgatgacaggtcatgccaggagatataaatttaggagtcactgtcatattgataacacttagggagagactacagttagaaaaaatatggcagaaatttggaatacttaacatttagagattgggcagatgaggaggaatatgacagggataaaaagaggaagggtgatttcacagatgtcatggtggggaagaatgtttccaaagggtgggagctgttaactatgtcatatactaatgagagatacagtaaatcatgtcagtaaggtgaccactgtgggagggagatatgacattcgagagagagtatgaagggattaagtagagtgactatagattatatttgtgaggagttttgctctgaagtggagtgaagagatggatagtgcctttaggaggtggtaggcttgagggaggtgttattgtttgtttcatttatttttgttgtttcatttttgaacatgagagataaccacaacttttagaaataaagcagtaaaagagacacagcaatgatgcagaagagagaatagaaaattgcaggaatgcaatcctttgaggaggcaagaacacacaggatccagtatacaaatgaatgggcacagacaattgaatcttggtaagttgagcaaaggcagagagaacaggtctggatgctgatatattagtcaatttgagctgcagagacgataagtgtaagtaaaggtcatcagagtatgaaggcttggaggaacaagtattgaggatttcaaaacagggaaaaaggtggaaaatggttatctcagattgtagaaaagaagtcataatatacatgacattatgattgctgagtactgtggactgaccatttgagactggttgtcatgaatttaaagtgaaactaaccaacacaatcatgtttgtttttctccccatggttgattgctcagttgctggcttggggtaggcagatagctgggttttattcagtttgatgtttttccagggaagaacgggtcagggggattaatagtttttgcaaaggagtgattaaaaagaaaacccatggatctaagctacctatggaagaaaaaaatgggcatggggcagagtggtgatggataacagaaaaatagtaaggccagtgggctgcattattatcccaattttacagagagaacactgaggcttagagagatgagataatatgccccagtgtcacacagagaagggctgagtagcagcacagggacttgagccccagccagggctgttggtcatttggacacaatgtttcggatagggcccaatgctaagggaagggatgcaaatcagaatacaaaaataagccttgcattcaagtggcttaggttctcagtgggaatttttcccagacaaaggtaaggtctagatcagcagctaggagacatcagaactgttggtggaaactgaaagttttggttctaaaatgtgctgagaaaggagagctagaagaggaaccaaaataacacatttccctgacttttcggtttttttcctgtagtgaacctacatggaagattctgtacctcaagctatgtatttctccccatgggacttaaaaagcacatcagcgggacagcaggtttttaagagagcacaactgatacctcaataaacttcagtagacaaccttaaaaacttagggtatttttgaatgtaattctgacttttcttcaattccaagttatataatatatttgttattaaaagttttaaatgggaaaattgagatccactgaaaagggccttacctcatccctcaagggttgttggccaaaaaaacaaacaaacaaaacaaaaaacaaacaaaaaagccgacctctgattatttagcaacagagttctgcaaccattaggaaatttgtattaaattcagagaaaatgcaagtcataaaactgagcatacattttataatcagtcattattaacttaaatagtaaataaaactaaaccaaatatatattagttaagtatagaatagatgtcagataatagtgtaactgtgtgtgtgtgtgtgtgtgtatatatatatatatttttttttttttttttttgaggcagagtctcgctctgtcacccagggtggagtgcagtggtgtgatcttgactcagtgcaacctctgcctcctgggttcaagtgattctcctgccttagcctcccgagtagctggaatacaggtgagtgccaccaccctagctaattttttgtatttttaatagagatgggttttcaccatgttagctaggaaggtctcaatctactgacctcgtgatctgccacctcggcctcccatagtgctgggattacaggtgtgagccaccatgtctggccaatctgagtatattttaagatataacttctttagatactaaactgaatctgatatatttttatctggaagttattttagtttaatctcatcaaatgtccaccagcatcatacaatcttaatatatgtactcaataacactcaacaatgaaacccacttatttcatttattatgttgttctttcacatagaaaatgatagcctccattagttttccaaagctgttcaaaacattacccagtctactggaaaactctatgtaaaactgacagaatctaagagcatcatcttcacgtttccctagcattttgtataaagtgtatgttgcatacaaatggatttgtcagatacattgagaagtatgttaatagtaggaaaaagaaagtattaaggaacaattctgtatcttcagaaaattaacttaagaacatattatgtatctaatcttaatgcaactggtggaaattaccgtgtcttctacaaataactttgttccagggtaaacagtaagaaatttcactttcttttttttgtagtaatgcaaggtcctcttatctaaacatttctcatctttcagaggagtctacttgacagaccattttgtgttttagctgagaggcagtagctattaactagattgctgtctattttatttttatgtggataaagttgaagagactcacacaaaagggatttatatgtcaagaaatgccttatactaactttaaacaaaattgatatctttttaaaatatgaagctgactgtagatttttatcttttatgcatagataagtctaaatgttgcaaagaatatatatttccatgtccatgactacagtatcaacatgtatttctctagagatgcctatatttcaatatttccaagttgggttttgttttcttatacttcaaagaaaggaaaatacatttgtgtttcttttcaatgccaatacagataattcccttgatgaaatcaaatataatggcatttaaagaaaacgttgttagtaaaaaaataaaaataaaaaataaaaaatccagatgctctcttaatttggaaggtttatcagagaaaagtcaatgaagaatttaaaggttatttccgttacaatcttggattatttctttcattaattagtttgtttgtttaatgataaatattcattgaatatatgctgtgtaggagtcactttctaaacacttcagctccgtaagagtcttccaaattatttgtcagccaaaaaacctcagcacttctatgaatgtcagcaatcagtgagcaactggcatatgataacacctgggcttgcgtagagtttctgctcttccatggggaattaacttctctacctatgataaaggtagcagacactttccccttgtctgtcatttagagaaggttgggcattttctgactatacttaactttgataatagtcaaggatttcggggtttatgagataagaggtctatgaagctgaaccttggagaaaggaaaagttgaggggccccaattaaagttctcaaactttaaggaacataacaataccttaaaccagttacttgtttaaaatgccaaagatttttccctattcccctaacacacactcttctagtgcattattagttgcagtgttatctgacatttcttctatacttaactaatttatgttcaattgttttatatttctttattatttaaattaataatgcttggttgaaaatgtatgtccagcattatgacttgtattttctctgagtataatatacatttcctaatggttccagaccactgttgctacttctgattcagtaggtctttaagccagaaacttagtgttttcaaattgtagtccaaatagtataaagggagatgatctacagatcccactataataaagtctaattaaataaaaggtttccacacttttgtaatggaataaaatcttttaaaaacaaagatttatgtgacatcctggtataatatgcaaaggcaaagttatgcaaaaacacagattggtctccttgggatgagggtaatggggtactggagccaggttgtactgtcttgcaagaatcaattgttaatgttttaagaattttgtgagccctatgttaaacacagcaattattaaaaattcagttacatagccttataattaaacaaattatattaaaggcaaatgtatcaaatatgttacatgtaacagttcctcattcttttactacattttactattatctatgccctttaggttattcatatcgtatctgtggggtgaaaatacacatctcctcccagctctgttttcagtgacattatgctggcagcttgaaattggccttcttcggtgtatttgcaccacagaactcagcaaatgctacaaattaaagattttttcacctacagagccagattttgaacatttaatagcttacttctagagaagggcggatgctaggattgccagtttctaagcatctctctcaattccctctgtaggctctaggacaccacaggaaaaaaaaatgtagtttaaagaaaggaaaaaagctgacttaattatattgtggctgtgaacatgcaaaggtaaaaagaagaaatcaaaagaaaggtcaaattctttagcatgaacacatacatcttacaaatttggttatgagactataagcctttattttcttccaattccttggaaaaataacaatagactagatccaaataattattctacctggctatcttgttttgcaagctcctttacatgaagatgattacaaagatgaggctgtataatctgtgtataagtatctccagattacatctttattgtttagctcagaaaatggttcctccatcttcattgttattgatgaatgagagacacctctgcaccttctgtgaaatacaagtgatcatcttgcacaacagtaccacatttagcatttactttggcaaatttaattatagacatttatcctgcttactgtctataaactatgcttttatctgtaacactaacatataatttgatatacccccaaagtagaagaattgcacagtgcctttaataatatctttgcaatgaatataaataatttcattagtgatggattatttcagcctttcaaaaatgaaatgatcagaattttttaatgtttgttagaaaacaaagttctctttccttaagggactccagcgtatcattttaaataataatgtgtatagtcttgtgtctgtcattcagctatttattcatgaatttaattttcttgattcatttagtcaacagctattatgtaactattgtttaaaaattagatactgatattccttaagaagccttatttttaaataatctgaaatttaaatcatcaaagtaaggtgtctaaattgtagtataataggctaattagaccagttagtaattttttcccttactttgaattatatgtaaagggagcaaatgctggccttaagaattttcacttcaaagttataaagtatttacaaattccatagatggagattcaatttagaatactagatgaaaactgtgtttcaatcattcacctgtatgattgatttttctctatagttgatagtaaattcagtgattttttggaaatatgtatgtgaaggaaggatgtaagtctgtgacatcatgcagtttgaagtctacttttccttggggtattatgcagatatgtagatttgcctattattttctttaataaaattggtgtttttttttctgagactattttccaggaatgtagttttgatcttagaattgattttttcctccagactgaggaggacgcagatgtcaagaagtttcctatgggatatggcttgacagagggacacacaacaggagtcggaggttacaataagaaaatatacttactctatgacatgtgggtcttgtaaggaactgacattgatgggaagtgatgctttttagccaaaggaagaagtatctatcatgctgtcacatcagattcggttcaaactaagcaaacatttgtgttatggtactattcttgggaaatatatttctgaatgtgctcttggctctttagatgaaaagtcataaatgatcataaaatacataaaatggtacctgtcataataagcaaatgataaaataaatttatgcttattataactatcaacatctgtatgtgtaaaatagataataaagcaagtgtctgaacaatgcagcacatactagcttcacctaatgcaagcaatcagctattctttgcctgtctttgcagaagattgtgaccaatgatataatgagtttgaggaggctgtttttatgattaattcataaataagttaatctagacttatttcaggtctgggttttacatttgatgactcattttcagagcccagaaaataatatttaagggagtattaattggattgaaacttttaactgtgtgggtgttacacaaattctatttaatcctcagtgtgttagattaattttccagtattaacaattttaattcattctacctttatcagtcttcagcctcttcttatcgcatgcacaacagaaaaacagaatcaccaaaaatgtatctttagactgtaattcttattttgctgactcaaaatatgtgccaaaagactgataaaagtctgattttccaatagttcatttgacgtttgagtccttttacgtcatcttcaagctcatgcttgaacttttctaatgacagggatatttttgtctttaagcaaccatttttgtcatatgtaggtctaactttcagaaatgtatattcaaagttctgtccctctataacgtctgctcatttgtcataattgtttcccctgggactataaatacatctcatgagtttagtgactttctcttgcggcatgacttttaatatttggggatgtctgtcaagggcccccctcccccttctctccaccaatgcttctcttctccaagtaaaatattcttagtttctacaaatatttctctttgcttgtcagctccctacttgacttgtcatcctcctctgcatagttgcaaatgtcatgtgactattagacatcccttaagagtacctctctcatcttaagcacagcattattattcagatgtgctacaatcacattgatgttgtgggtggtcacattatcttatggacttattatggatctgattttccatgaaaacctataagtatttcatgaatgatgctgacaaactgcatgtctttcattctcttcatgccaggctctgtctgactcacatgcaagacctcttcatgtatctttgttacattttatcttacattaaccccactgctacaacctctcagggtaccttgtgtcttcatgcacttattcaacatcaataaatgaaggttagttgtacacctggaatgtgtccggctaaatcgaaaatgctaattctgtggctcaattatttgacacaccattccagcaatcttctctaccactttatttcatccaccatacccaggccatattttaatcttgttttcttctcctcgaagcgactttcactaaaaaccttaaacttcaaaaccatcctatatgacagcccctgtgttcatctgaatctctaatgtctccgctctcaataaactgattagctgataagcctcataaacactttcaacttgctcctttcttttttttttttccccaggtattattattcttattttctcactctccttttaaaactggaccttgtggttgatcaagtgactaaccatattctgcaccctcaagatttattttatttttgcctttatactatcatcatttatctcatatagtcctgatgaactaccttgcctgttcttaaggtcaagctaatcagtgctatgggagaaaatcctataatggctgaaaagcatagatatgaatgaccctaaaaaagccactaaacctttctacatgttgacgttctcccgttctttacatgtgtcatcataccagttattaatccaattcacctgtagtgtcctccctatttcttcatgtaattcacaaaaataattcaaatattctgctttaccccaaaatacacatttttttgcctatatccaaaaggtcaagtaatatgcagggatagatctagctcattttcattcaaactaaaatcatatcaagaaacagttttcagtctttctatacactttttccctagaatatttgaagccgatttttttaggtaattattccaggtttccttttcatcttatttcctgcggtttcaaggtcaacatatttatcatattttcattcaaagccataacaaaaatgagtgataaacagaaaaatgattttcctgcttgacttcctgtttattctgctaaactataatctgattttacttaaaactcttccgagttacctttgtgaataattcaccaagcatgtgaaccactgcttatataacttcatgattgttataaacaccttttttatgtggcatagttcaaggctcgaaccaaaagtgagatacaggaatgaagcaaatatgtttgtcactctttctcatctcaaaatgtattggccaggccaggtacagtggctcaagcctgtaatcccagcactttgggaggccgagttgggtggatcacctgcggtcaggagttttatatcagcctggccaacatggtgaaaccttgtcactactaaaaatacaaaaattaggaccaggcgcagtggctcatgcctgtagtcccagcactttgggaggccgaggagggcagatcacctgaggttgggagttcgagaccagcctgaccaacatggagaaacaccatctctactaaaaatacaaaattatctgggcatggtgaggcatgcctgtaatcccagctactctggaggctgaggcaggagaatcgcttgaacctgggaggcggaggttgcagtgaactgaaatcgcaccatcgcactccagcctaggcaacaagagtgaaactccatctcaaaataaaatgaaataaaaaatacaaaaattagccgggcgtggtgttggtcacctgtagttccagctactcgggaggctgagccaggagaatcgcttgaacccaggaggcagaggttgcagtgcgtaagatcacaccactgcactccagcctgggcgatagagtaagaccctgtctcaaattaaaaaaataaataaataaataaataaaatattggccagtcaggtttttttctgcttcaagaccccagatatcactcaacccctggcccagtgtctcacacaagtcataagtaggccctgtgaaaaccctcactctcttaaacagtgacttagggtcacgtgtttaaaagaaaattagttataaaatcacccaagcccctcattttcaagactgtgtaaaatataggcacatccaaatcccttggcaatttagtgacaaacctgaaatctgactccagttttttacctaaaccagtgcttactctggattatatcaaaagaaaacactgaggaacacacatgtggattctcagtgaagtgataatgccttttaatagctagatctcttgaagaagtaacaatttgttctgtaattattgatttaaagctgaagcttttgatgactagatggtttgttcctttcttcttctcttcctccttgtaaatatattcattttatcacttacacaagacaaatatgtgtcacaaacggacagtcatataatttttgtttgaaaaacctcatgaggatgggtgccctctagatagccaatttccattcttttcattctaatgttaatgatgttatttaaagttattggatacacagcatcaaatgtcattatttcaaatgacttcatgacacagggttcattgtgtaaggaatatcaagtagaggttctcaggtgttgtccctttaaaatgcaaggggagaaatgcaattgctattttttatttagttacctaatgcctgcccatcatgtctttttgaatttggcccaataacttataattaaaagactcattatccctgctggatgtgggcacaaattcacattatttccatggaagcctgtctgctgtctcactttaatgaaaatttaaaccctttagaatgacatgtgatgcttggaattatttatcttttgtctgagtagagttacaagaagaaagaactcctagaaaaataagtcactatttctttctgcagattcttgtcttccaagtaagcattcttttttgtttgtttctggaaagattgacagagaaaactatgaaagtatcagttagagcagaaaaaaattatggactctcccacctgtgcacttttgacctggtatttggctatcttttgtacatgtagtaaaatatacataacacaacatttaccatttcaactgtttttaagtgtacaattcattgacgttaagtatattcatagttttgtaaccatcaacatcatccatctccagaactttttcatcatctcaaacagaaactctacacctctttaacaatacatcgccgttcccctcttccctaagaaactggtaaccactattctactttctgtctctgaatttgcctattccaagcacttcaaacaaatggaattacacaatatttgtcctttggtgtctggcttattttgacatgtttctgagatccatgcatggtatttaatattatggtaaattttttgttaagtataattccattgaatggatacaccaaagcatctttgatgaatattggattgtttccatttcaaggatattacagataaaactgctgccacactgttggaaaaggctttactggacataaactttgtctcgtgtagatatttagaagtaaaactactgaatcagaatttagatgtatgtcttacttaattagaaataattttcctaaatgattataacattttgtattcgcaacagaggtatatggaaattccagttgtccaatcccaaccaacacatggaatttgttgacatcttaattttagcaaatctaataggtatacagttacatcaccttgtggctttaatttgtatttctctaataactaaaagtgttgaatattttttcatatatttgaccatttgaagattcttttttgcacattactttaggttgaattgttaatcttctaaattatcaatgtgtagaaattctttacacattttaggaaaacattttaattatattttggtattgttaacattttctacaaattggaggcttacctctgtaagttggaggctttggtattgttagtattttatacaaattggcggcttacctttttacttttttaatgctgtcttttgatgagcagatgctgtttttattttgttaaagtcagagttattgattttgaccttttatgatctacttaagaaagttttgtttaccccaaggtataaagatattcttctatgttttactagcttttacatttaggtctgtgatacaccttgaattaatttttgtgtatagattaaggaaggggccaaggttatttatataggtatccagttttgtcggcaccatttattaaaagagttctctttcctcattgaattatttagtgcctttcttgaaaacagttgaccatatatgtatgcacatttgtgtctatttctggatcttattctgttccattgatctatttgtttatccctatggtagtaccatgtggtcttatttgctatatctttatagctcatcttgaaatcaagcagtattaagtactctaatatggttcttttttttccaaaatggaatgtaactatttatatatgtttaaaaccgttactctccacaaatatatatatattatatattctactgagagtacagatctttatatatatgatcattatatgtatgatgagatcattatatgtatgatctggacacccagtagaatctagctcattagattgtccttcacagttaaacaatgcaaagcctatagaagaacattatgctaaatatgtgggtgtgtgggtgactgagataaaatagaaaaaaaggctaaatgtttttggggtacctgctatctgccagtattctgcaaagtgttttatatatcttggcatatttgaatttaattttcacaaaaattctgtgaagtagttattgtctccattagtggatgaacaaagtaagggttagagaagtaatttgttcaaaatatttaactcgaattcctttcatctttgatggtcacagccaatcagtagtcatattgagtgctcatgcagggtgcctgctttgtggttgacagctggattttcagctagtgacaggtttgctatattaacctagtcagttgtcacactgactaaacatacaatttagagcgtagttttaataattctgtgacaactcagtataccttccataaaaaaatgcatctaaaagtacattatttataagtgagttcttgtgaaagaaatcaaattataattcccattgttttacaaaatcattattgagtatacaaagttaaataaaaataacatttatttcatcaaaaaatgtctgacaaaccgagctgctggcattaagcattactagttgtgaaattatgtgttagtcacaaaatcaatttaaataaacaactagattatcatcttgccacccctgaaaacaaagaccttagcacagaatcagatttaatcttcaaatctattacttaccaagaaaacctaagaacacaatttgtttgaaacctttaaacctattactttctaaaagaatctcatggagcactgtgcttgaccttcacaggataaactttgtagatgtcaggggttcaaagcaatttgtttcttatattccttgaatttatctactatatgttgctgattatttccttcatgacagctgtttttacttatgacacacagaaatgcattacattttggagaattgcacttgattctactcttccaatagatattctaatttattatctgatacgtagtgttgggttctaggtgaatcatgactcctagaattattcaatgtgaacactttattgatgatagatgttacattaacatatggtagttgtgttccataagactgtaactattttagaaatatgttcacaatgagacattaatcttttagttatgcatattaatccttataaagttttatgatatacacagaattgaaatatttccattttcatttaagatgaagaaacaaagaatcagagatattgatatttgtccaagcactcacacatttcaggggtccctttttcttataagctttttgtgtccaagctcttataagccttatgtgtccaagctctcacacatttcaggggtccctttacttagaagccttataatactagtaaacactgaaaatgtaaagatatatgagaagtatgagaagtatcattgcaactaaggaactcagagcctagaggactgagacaagcagccaaacatgtaaaagtgaaattgaaaaatgctgtcatacaggtatactaagaggagaggagaacctcattgtatgggtaaattttcctacataaagtgaacccagagcaatcagacagctaatatttattgaaaggaacaatgtctgttatgtgtcatgtaaattagccatacctagtattatttaaccttcacaaaactccagcaaactatcgcaaggacaaaaaaccaaacatcgcatgttctcactcataggtgggaattgagcaatgagaacacctggacacaggaagggggacatcacacaccggggcctgttgtggagtggggggaggggggagggatagcattaggagatatacctaatgtaagtgacgaattaatgggtgcagcacaccaacatggcacgtgtatacatatgtaactaacctgcacgttgtgcacatgtaccctagaacttaaaatataataataataaaaataaataaataaaaaataaaaatgaaaaaaaaaaaactccagcaaagtccattactgttctccattttatagttacagaaactggagggaagaaaaacctaaagaatagaaaagatgaaataaccctttatggttcctcccaggtagatcattttggggtttttcaaaccacagagtcactgcaccatgagttacttcagttttcttccttgtttccagttaatcatattctctgctctaagctctttagtgatagctcatgtcacaaaaggccaggatgagagatgatggttgtgctgataggtgagtgaattcacggagcagagacagaaatgagggagaacgcacccagagaaaggtgcacaggggcttacatcactgggccctttgattggtgtttttgacatgaacacaaagaaaaatatttgaaaatgtcaaacaaaacctcactgattttctaccttgagtagaagaattcaaatgttttgaatgcttaatatttgatcccaggaatcagagaattgtgggaaaagacctccaatttttcttggtttcaattcaagggtgttcaaaatgatatacagtattttacatggcctattcaaaaaattattttattttgaataaccaagggctgataatataattcatgccttttatcttagcatgtaaaagtgctacataagtagaatggtagcataatacacattttaatcagaacaagggcagagcaacgaaggcaatgctttttatttttgttagaggagaatggtgagaaaatataaaaaaacatttagacattcaaaattctagttctagagttaaaaaaaaaaaaaaaaaaaaaaaacaacaaaacactttttccccaatgtgtaatatgcaatcaaaagcactcatgcctctactgttttccagaagaataaatatgaaagttataattactatgaaagttataattacttttatattagactagatttttttctggagatgtttttaaaaggggaagaaaaatcagataaacttatagacatgctcatatttaaaaataaatgaaaaagccacaaaaacagtcaatagcaagcttccatctttactccttacactgaatattttcccatttctgaggctgcctcaattcatcttatgtcttatcaagaattgtgggatcaacaatcatctctgtgattgtcatagttacaataaattttatatatgaaaagcagaggaataaaagctaccaatcctgggtttaccactggaaggatcagaaggagctgtcccctgttatccaggtaggaatatttgtagacaatgtattaaaaagtgatcttcaaggcataaaaggtcttggtgtcagactcaatattaagtccctcttttcatttgcttgactttttatagctaattaacaatctagccattgtttcccttatctgtaaaatgagactaatactaggttccaactctcatgagattgtcgttgggactaaataagataatgcctctaaatgcacagcacctagaagaggttgtcattatcatttttatcatttaatatttccatttttctctgaggctatggctacactcacaaactggcttgtcagattctatttttaaaaagattgcatttagttgatccatttttcagatatttgtaatagttacagataacattttcacttttagagagtcttgttgtactgtttgcatattgtttaaatgcatagaagtattgttagggcactagcctatgctcttggtgcagaagagccactgaaatgtgctggggagttggaaagtcctcagcaatattacttaccttcttggtaaccgagatctttgagcttctgaaaggaccttagttcccataaacaatttgaccctgaggctgggaagtaatgttattccaggagaatggatgagagtgatcaaaggcagagagatgaggaggtgtaaggtgaagtctaaaggtggggcttgagaaggtggcttggtatcttaaatttgtgactgtcaagggctaggctaagctggagaaatctgatctgcttcaggtcagagtagccattagctgatcaagaaaacaagccgagatgaaagtgacagtcaagcctttaatcactgaactgcaattgtacaaggaagaggttaaccagagaacacacccattctccccagtcctgctttcccccacggagcagcacctgtggagggtcaagtggaccaacatagacaaggggttgtctccctgatgagggagctctgaaccaaagcttcccgcagtttcatggtccctggggctggagaggtggagaggaaagagctaagaatgggaaattactgcacactgagagtggagaaaagtgtcttcaaggttttcttctgcttccgccataaagagaaccaggcagaggtacctctgcttgaaggcccagacaaagaacctctgaatgatggtgcctgggctggaaatacagatgtgcataagagcatggccagccagggcgaatgagtccttgcctgcaacttcctttggaggttgcagtggctgcgcactaagtctggtatggggaaggcaggttccctctgtgtgatctgccaggcaaagcctttttgactgaccatggccaggtctggaaaatcacacatggagttttagctagaagccagactcctcaatagaaggtagtcctatagatctccagtaatagtattcaatcaggcaaagaggaagtcaaattgtccctgtttgcagatgacatgattttatatttagaaaaccccatagtctcagctcaaaatctccttaagaagaggacttcttaaagcatgcgcagtctttttaaaaagttttcctgcttctctttagttgcaacaaaatttttcaaacagggaagaaatggtgggcttgtagtaaagaacaaacaggaagactgagtcttaatcaatcactggtaacaaagggaaactacagcagctgcaaatttcaagggaagacaagtgtgttaaaacatttgatttagaaagtaaaggagagctaattggctagtgtagacctgtaaacaacctacaaaaagacctatatgcttaatgatataagtttccaatgggacagccaggaagatattactttgtagttgttctaatttgcatttaggactaaatgaattggcatacataaaacacctaacacattatctgaaacatagtatttgttcaatcgatatctgctccattttcccaagtaagttgaagagggggtaaatatacaaaatgacctactcagtgactatatattagatacctactactgtaagctttcttcatgataaggtaaggccattgcctgtaaagagtatttattcttattggggacatagaaaatgaaatttaaccctatcatgatagtatctaagaaccaaataaatgcaagaaagtaataggataccactgtcaatgacaacctgttgttggcattaagagtttacacatctctacaaaatatgctggacaggcctgatacacaccatgggtcagttttccaaaaaaaatgtgccagtatcacattatccaatctttcacatactttttataggcactgaataaaagtatccttatcctccctaggggataaaggtgtccagacctatgatgacaagtaggtgtgtgtgtgtgtgtgtgtgtgtgtgtgtgtttgtgcatctggccagtgaacttgcagggtgcaagctctcacttgtcagtgctcattttgagatatggcagtaccataagtggtaggtgagaggaccccaaagctataaaagttgtctgattatgattcaagaaggaacatttttaacatgttgaactgatgtgactcaaagctgtgagcatttctggattgaaaagaaaagcagaatgatgagaaaacagtcctattttggtttatgtggcatagatgctggcaaggaaggaaatgtcgcttgagctatcaaggagtcgggtcctcattaggagtgtgaagacaacatctgactgtattgtggattttctgggggaagaaagtaaacacctctttcttaaagaagaagaatcatgtagcacagctgggaagacacttcaaaagtgaccattgagaaacatatcaatccaaaccctgagagttcaggaaggaattggtgcttggctgctgtctttagcaatcacgttttaaggatctccttgtgccagacattgaaaatcatttcaaaggcttaccaaggagacaagtattattctctaacccaccagaggctaacaaatgagatgaggcagggactagttgcctctttgtttctgaactgttcacagtagcttccatattagtttaatcaaaggatgtaaacttggcaaactcagagtgctctctgggaagaagaataatttgctggcagattatgtggtttaagaagctgcaaggaaacttaatgctgctgaacgcttggaaactatcatcaggattcaggctctacctctgagattatcatggagtattaacgacataatgtttgtatacaaaacagggtcactcaactgaagtgaagggttaagaacaacagatctgactccccgattcagctgattcctctgaagaaatggaaacataaaagtcttctctttctttttattaaatattttataaactcaacacacaaatcttctcgttagccaaaaaagcaagcttatgaactgtcctcagaatttaacttgacaaatgcaatgccctaaaattctaagcaatcatcaaaagcagcagataggttcccagatgattatgaaaaatatgagtttgcttctgcataatatacacagttttgtatcattagatatcaggctattatactgcagcagatgtaaccagatgtgacggatttttcaattcactttctcttgtcacactgagtttttttctttccaccatggaaaactgaatgttcttcactggaagtttgatactttattatcttaatttcattttataaatctgaaaaatatttccctttaaaatagggatcacctacagaagggatgatgctctacttccagtatgttattgcatggacttacagttaaaaaccagtgatggggttccttttaccaagtagctccatgcaatcctcaggataattttataggatttgaaccaagtgtcctagtacagatatgttttggtgatctattgttatggaacataccaccttaaaacttagtggcttaaaacaataacttattatcacttgtgattttgtgtgttgactgggttcagctgtgtggttcttctgctttatgtgacataagcaaagtctatatctagggatttgacttgactgaagaatacaagatgacttacttgcattgttggcagctgatgttggctttgtcgggaactcatttgggactgttcacttatgtgcctcttatctccacgtggcctctccttgaggcttggacttctcacaatatggcagctggatttcaagagggagtgcaccaagtggaatgggattacacaaagctatggttcattggggtccctttgtagaggctagaagtcacaatttggaatctggtttacatattcctaatttatctttaccccagaatcacagtgtgtgatactgtctatgagatacccaaatttagattgcctatactatattaagtcattcatcctgcctttaggggataaaagcaatatatcctatcattttaaatgattaaacattttaatattctcaatctaaatgtgaattagcatcagtggtggcttagttacttgtgatctttaaattttctcacttctgtctgaacctcagtttcatgagaaaatgtaattagagtcatatatttggatgccagaaataccatcttactatagtccatgctagaagaaatctaagaattcacctaattcaccccctatatttttgcagaaaagaagctgaaacctgtgaagttatgatttgttcaaatcttccttccccatttcaatcagagctgcttctctgtcatctgctttatatattgtgactcaggtataattttatttggaatctaagtccgataaaataaagtttgagaaagaagcagcatagttagtggttaaaagcacagactatgaagacagactaccttaggctgtgttctgtatgctctgtgcctcagtttactcatttgttatgtgtggaaaagtaacatcacctgccctacagagtttttatgtgtatccatgagcttatgttggtaatgtacttggaactgtttctagcatatgaatagaattatgtaagcactggtgaaataaatacatttccttgaagtaatgagagatgcagaaaaacatcagatatgtcggtttacagttcaaattcaggccctaggagtataatgtttctcctttcgatggtatatttttaggcatggagtcagtctccttaagcaagtctaatacagatatctaatatagatttaatagcaaaagatttaacagtaatccttgtgtatcagttagaataccttagactggaaagaacaaaaatctcaacagtcttaagcaataaggagtatcttattttctatctctatgcaaacgtcaaggtcacagtcataccttgagttttacttgtcaggctttcgtagtttagtttatattttcttcatcctgactccctggctacctcaggttgtaagcctctcagagtgactccaggagttggctgagcattttggataccttcacaggtctgcctgggtgtcagctgtcatgctttctcaggttcctacctaacaccatgtctgctactcagagcacacttacggtattgaatagttctccctgagacttgcaatcatcatgacgtttacccagggatgaaagcataggtcccctcatttctcagatttctccttaaccttttggatttctgttactggccactactgttcttagaatcagtcaggaggccaggctttagcacccttctttgagattcattaaaatctaatctatttatatttcagctgaggcaaattttattctcaagcaggggtttcctggctatttactcactttctttcaaatgtaatatttatagccctaactattaactggcttcctaggatttcatcttttacatattaaaatattcagctatcttgtgtgtatgtgggaggaggttgtcagaacatcactacttggatctgagaaagggtcaggcaacaaggaaatgcaatgataaatatctcagctcatatttctttattttatctggactaatgcagtcacttagtgaagaaaaaaaaaacaggtgaattaaaagtaaaaatatatatatttaaataaaccagtacaacaccatagacaatgttgcctcatgggcatttattattaactcaaatatttatgcagaactgctatgagaattcagaatgtatttcaaggccaagttggtcaagaacagtttcccaaagcaggatttttatataggtcatgaataatgactataagttgcatgggaatggagagtagaattgcatggtatgtttttagtagtagaatagccgaattagttacataaagcctgagtattataaagtgcgtttgaacagtagcagatggaacagttgcctggagttgggaattcatggaaataagtccaagctagggctctaaatgcagttagaaaagaagatgaactttagtatagcctataaatgatggttgggtttcatataaggtggtgggaaccaaggaacttgagtgttctaagtaaaggaaacattggagatctagtcaaagaaatgggagcatctgggaagactcagagaatagagcattacacttctactgaagtaaaggctacatggcagagtatcatgagccatgaaactatacacacagtttggacttggaagaggacaaccttagattacttaaaaattggacattgtcatatgttatttttaagaatgaaacctagaagtggctttttcttctgcccacattcaattggccaaaatacggtgagattcttcttgatcctaagtctaaggaagctgagaaatatgacccccttgagtgtccagaaagaagacaccgtgtggtgagtaatattgtttagacatcccataaaatgttgtatttaaaatttggtgcaaaggtggctatttccaggaaaattatatgtgcttataaatagtgaagattatttttacaaaccgacattaaactcctctactttcatagcttactcttacgaataggaaagagcataggagagtctctagcacaatacaggctttgacaattaaagagaaaaataatgtcatggttgctaatactttgtttatttgtttagagtgtagcaggagtcacataaagatgtagattgatttaatgtagctattaaacgtattaaatacatttttatagatgttaatttttaaaattcttactgtttgaagttaaccatttgccaaatgatttaatgcacactcttgagtgtgggcttttgagaccactcttgcttggaaactagtctatttggtttggttacccttagaagttgaagcttcctttaaagtctattgaacttcagaaaattctttttattttcaacagagccacagaattcttttcctgtctttagccctaagtctaagtgctttaatatccgtgtggacatcccatccaatactctagtttcataatttcttgactttctcaagtcccatgacctttcagccatacatgtcaacccattaactgctccatgtctgatctctttgaatcccttggtttagcagaatgtcaggaatgttcaggaatagatgctcaataaatgtttactggattaataaatgggttaatgttgggtgttccataaatacagaataaatatatatgaactgtttgttgactaacagccatcctgctcttgtctttcctaacagcagctctattttgatcatttatctatctcttcccccatctctttatgtatatgttggaagatggtgacccgacctgaacattcagagatgggcccagattaatttatgacaattctggaaatcctaaacctttgtcagtgattacccccagaatggtcctgtgggcatactgtggccaatgagacttaaggaaaggattactagagggtcctaggaaagttcttccccatttttagagggtagcaatggaaaaccactttcactctctcccactggaagtgatcaagaacacatcttgtccttcttcccaactggtagtagctaatttgtgatcatgaagaaggccagattgaggacaatccttctccataggagataaccaagcctggaaaatagcgaagaacgaaagccagagctggctcctgtcatgtgtgacattcccctgccacacctctgcaattccagttcattcagccaattaaacactttgttttttaatgccagtttcaataaagttgctaatatgtaatatcaaaagcaccatcctgatacaaaatctctagccagagaaattggatgatggctttaaaataagaaagtaaaatcatctattcccttattatcccccaaggattgacaatattctttctcgtcagtacataaacacaaaaattgttttaaatgcaaatatctaaataattcaattacattggcaactatgtattttagggggaatttttgtttggcatttaagaacaaataatatatttgcctgaaagttccaattttaccttatgtggatggaaaatcaggatgactgctctggttctgtttggcaccttctagagttagtctgtattcctttcacatgaaaaatgtcagcatagaaattttactgctttcctgctgagtttaacttgctttaggacagctggatcaggctaggcatgaacgtgtaatgtggattcccatagtttttaatgagctttaggaatttacacagtttgcagagttggttcactacattgtcaattttgttacatcatttagtaaaagtatgtgttttttttatttgaacaaacaaatattatagctatcttctagcaaacaaaaataaattgccaatgtatgtgttgtaccccaaagtgacctaggtgggtaccattctaagagaagtctcaggctaaatattgatggaagaggttccatctagtcacgtgtttttgacatttttacaattagggttttatgacagatcaagggctatgtctacgacctcggggtagtagaagtctatttcatgaaaaaaatagggattaaaacatatgtgtaaaattgatgaagataaagtagatattattgccctggaaatgtggggtagaattaattactcatttgttgtaccaaatttgattctgaactgcctaccatctaagacaaaaataaacagtgaattacatacttttccttgtctatggaataataggaggcgtaacagtagaaagaaatgtgttccctaagaaccacattttaaaaaacaatattatattgttagatttctttcttggaaaattttagccaaaatgcaaccatgtggttgtatatagtcagcacttatttcaaccttcaataaaagttaatggcatcatgattaattgtaaatctctgaagacatttataaggaagctaatgtaatgccttccaggtatgttgctctcttataatcagatttttacagtcataaaatcaagttggatttttaatcacagaatactctgctcaaatttaattggattttggataggagtgaagacagaatttgaaaataaggctcttcgtgaagatctgaagttcagatactctatgatgttgaaaagacattaatacatcttaaaaatcagactcttgatgcaattctgcccttaagagagaactgttccgtttttttaaaatggggtggagttgaatttccctcaagaagtagctttaagacatactgatgatcaggttaagtggcttctattactataatttcttaaaggtgaaatattcactatatagattctgtactccacacgggaaattataaagttttaccatgaaagcttccatttcagattaaaaactaatttaaaaaaatgagagattttagtttatttcagttttcttttttaatcaagataaatgactgcaccctgaattgtgcttggggttgcagctctactgtagtttcactctaggacaagtgacttggcaatcagctgtctctaaggaatctgactttctttactatacctagggtccctctgccttgtttcactctgatctggtgtctgcccagctcccagacctacaggcaatatctgcccctagtctcctcccctttcttccacaggcttctggaagatacatccttcctagtgtccttcctctcctgtgttccatctcctacagatttctcaggggtctcactctgattgtctttcctctcttatatctttaactgcccactcagtggcttttttctcattttcactggactgtaatcaactgtctaccatattaacaaaaagttgctttaactgcttactctctgttctttccttcatagcaatatttttgaaaatgttacccatgttcaggatctccacttccgttatctcccttgattcctgaaaccctactatctggcttctgctgcatcattttcctaaacctgttctcatcgaggtcatccgtgacctctatgctgttctttccgaacagatgagccttgttgtgcatggtttaccattcccttttcctggaatgagtttctatatttggcttcttgtccttctctccatctgtcttgcatcacctttgtggcctccctttctcttatagttcccttaaatggagactccttcgtctcttacaccatcatctctagtcttattccctgatctgattattagaatctatcatcggctccccccaacccctgctttctgacagatgttgttaaagcacctctgtgattctgtctgttcaccgcttaaaaattcaccatgatttcctaatgcttacaaacagcctcatcttatcctggcaaggtaacattttccataatcttgttttcctactgtacaatatctgtcttttgttttgaacgtaccttcttacctattccacattggactccgctcacttttgtatttctttatctttaaattagaattaagccatttaaatggaaatgagcattgtgttatgtcctatggatataactaacaataacacaaatatgatttgtgcatttatatgctaaataatcaagaacttgtcaaatcatacctgtaactcaaacctcagctcaaatggagtcttcttacatttatctaattctaatcttttcatttagaataagtatggattctctttgaaatcacatactcttttttgggttttttaaaaagttacatacagcactatcaaattgcgtgtgtgagtgtgtgtgtgcatgcaagtagacactgtaccacataggtataggaatggccaataataagaagaatagatgctgaatatcattagtggttagagaaatgtgctcattgatgaagcaccatatcccaccatcattcatgacttgtcatcttcagtatattgaattaggtgaataaatgcatcctcccatgttttcacttccgtatattgtccttacccctggatatcacaaaacactgactatttccagggtgttgccactacctttttctgctgaggtctcttcatttcaccccactgggctggatctagaataatcccaggaagatgttctctggcatggtctgatcctccacaatatgtatgtatccatgtatgtttcctatatttttaacataaaatcaatcaagataggatctaagaaaattttgtcagatttaagtcaaatgattttgtctaataaaaacatcaattacgctgcttcacactcttatactctgtatttgaccttcatttgttgcaagaaaccccttgaaatactatgtcatttaggtgtttatgtattttgcatgtgctcatttacatactgcataggattttagacgatctacaatacagagacagaataaaatagaaataaagtattacaccacaataaaaatagagttaagaaaaagaatgaccccaaagaaagactgagacttaatcactctgggggtttaggtggttcatgtgacagtatgttgacagaaaaatagttgtcaaattgggtttcataaaaatatcttaaatttaatacttattaccaaaacaacacatttattttcaaaccccaaaaggcaatttaagaatttctagttagtgcaatctaaagaagattcaaacattccatgagaaataatgaaattgtgctagaccaagcaatagcaacaatgaggtgtgaaccatcaccaagcatctttcttgttactactctatgctcagaactaggagaagggctgttcaagattaagggagaagtggaaggcactgagttcaagatgttgacttgtctatctggagagcggagcacataaaagacccaattattgatcaaaacagaacagactaaagccctaagttgggttaaatgagcaatttggaaaaaaatgtttattttcaaaacaatttatggagatagtttgcatttgtataatatattttgactgcatccaatgctgtaattttgctttaacaaaataagtttagaaaactaaaggatagaattataacatgcttctccaaagtcacatagctaatgatataataggattagcacttatatttcctgactcctgataaattactcattttattcatgtaccattttcgtattaatcaaaaatatcattgtatgtcagaatataacatatagatacataaataaatatgaaaaaaatgagcttaattcaaccacagatgtaaatgatccaaaccgagacagtcagtaggatccggaatattttgaaaatctaacaacacagcactctttcttttatatatttctttgtgttgttgaagtttccgtccaccccctcttcctatactaatggtgaatatttattaaaagcttattttatgccaaccatgattttaagcatttcataagtattattttacttaatactgaaaaatccctatggggtagaagttgttattatctccattttgcagatgaggaacaggataggacatgattaaataacttgtccaaggccactcaagtattaaatattagaatcacagcttcaattaaaggtgattctgaatgtcctcttaggttgaaaatgtctaactctaaaacaagtggcgtaccgcctcaaataatgtatagaccagtttggtctcattataacaatactctttattaatattgcccttctctaagcagttgaaaatactctgaaaaaaaatcactaattaactattctgtcaattatgtcatattgtttctatttttaaatggaaaacaacatgagctttctcaaagccagcttggtagcagtttcaggaagaaaatgtggatcaaatttcttagactaagacacctctcatacagacttaaggagttagattgaaactaattataaatccatgacatttttatttaccttagtataagaaatcatcccttcctccactcccagccatgcatgctattctacatgactaatgagttaatttgagaactgatgcttcatctggaacaggtgatgaagggtatataggaatcagtgttagatggcaggtgtctaaacaatgcctgattaaatgaagtgtgttttccctccaatgtattagcataaagtgtcatatagcctcagaagtcaaaaacatcaggagagttgtaaaagctaatgagccaagggatgtttccagggttctgccattgtaaaaaagaatgattatttaatgtgtgtggggacaaccatatttatttttgtatcaagcaaatatcctcactcttagcgtaaataaaaagtcatctgagcaacagggctccaagctgccatggttctttgctctgaaatgataactttttcctggaaaggtagggaatccactcagcacacttgaaagaagataatgggtttcagattcgcctattactaaagtggtcatgaatacctgggtggggtctgcctctgggatggtatcaaccccaatttgtactggacttctttagctagttttcttcagaaaggtagatcccagagctatcagcacccagagctatcagcacctgaatcaccattaaaatgcaaattcagggcccacttcagtcccattgaatccctctttcaaagtataaagatgaaatctacattcctgggaatacttgtccttcttccctattcctaactggttcttaatcaggggtgtgacactctataaaaatatacatgccaagcccatcacacccagttctattcccatgcaggatcctagggaaagtttattagcaggtgcatttaaaataattctctagtgattattctgaatgtcccctttcgttcagaattgtcctggatcttattaaacaagtggtcttaaacctcactcagggtgagatggaatcatgcgtaggtataagcattatttgtgagattattaatgctgtgcatccatcagcaatatttctatgaaacatagtaatattgttgcaataagagaaagcatataacatatcctaatttaacacaccttagggactacatataggacaggcatttccccctaaattggaagactttagagccctgccctattctagtctagcccagttgttcaggtaactgcaggttgacccactcctctattggaaacaatgagtcagctattatgtccacgtctgaaagtgctttcctgttgacacccaagatattcccagggatcagctgggaagcattcacttctagcttcctgggtattcctatcagaatcccaggcctttcgggcccttctgtccacttgtcttggatatgtggggaggttttttgtttttttttctattattattatactttaagttttagggtacatgtgcacaacatgcaggtttgttacatatgtatacatgtaccatgttggtgtgctgcacccattaactcttcatttaacattaggtatatctcctaatgctatccctcccccctccccccaccccacaacaggccatggtgtgtgatgttccccttcctgtgtccatgtgtcctcattgttcacttcccacctatcagtgagaacatgtggtgtttggttttttgtcttgcgatagtttgcttagaatgatggtttccagcttcatccatgtccctacaaaggacatgaactcatccttttttatggctacatagtattccatggtgtatatgtgccacattttcttaatccagtctatcatggttggacatttggattggttccaagtctttgctattgggaatagtgccgcagtaaacatacatgtgcatgtctttatagcagcatgttttatattcctttgggtatatacccagtaacgggatggctgagtcaaatggtatttctagttctagatccctgaggaatcgccacaccaacttccaaaatggttgaactagtttacagttccaccaacagtgtaaaactgttcctatttctccacatcctctccagcacctgttgtttcctgactttttaatgatcaccattctaactggtgtgagatggtatctcattgtggttttgatttgcatttgcctgatagccagtgatgatgagcattttttcatgtgtcttttggctgaataaatgtcttcttttgagaagtgtctgttcatgtccttcacccactttttgatggggttgtttgtttttttcttgtaaatttgtttgagttcattgtagattctggatattagccctttgtcagatgagtagattgcaaaaattttcttccattctgtaggttgcctgttcactctgatggtagtttcttttgctgtgcagaagctctttagtttaattagatcccatttgtcaattttggcttttgttgccattgcttttggtgttttagacatgaagtccttgcccgtgcctatgccccgaatggcattgcctaggttttcttcagggtttttatggttttaggtctaacatgtaggtctttaatccatcttgaattaatttttgtataaggtgtaaggaagggatccagtttcagctttctacatatggccagccagttttcccagcaccatttattaaatagggaatcctttcctgatttcttgtttttgtcaggtttgtcaaagatcagatggttgtaatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcggactcttttttggttccatactaactttaaagtaggttttcccaattctgtgaagaaagtcattggtagcttgatggagatggcattgaatctataaattaccttgggcagtatggccatttttacaatattgattcttcctacccatgagcatggaatgttcttccatttgtttgtatcctctttgatttcattgagcagtgttttgtagttctccttgaagaggtccttcacatcccttgtaagttgtattcctaggtattttattctctttgaagcaattgtgaatgggaattcactcatgatttggctctctgtttgtctgttattggtgtataagaatgcttgtgattttttcacattgattttgtatcctgagactttgctgaagttgcctattagcttaaggagattttgggctgagacaatggggttttctagatgtacaatcatgtcatctgcaaacagggacaattggacttcctcttttcctaattgaataccttttatttccttctcctgcctgattgccctggccagaacttccaacactatgttgaataggagtggtgagagagggcatccgtgtcttgtgccagttttcaaagggaatgcttccagtttttgcccattcagtatgatattggctgtgggtttgtcatagatagctctgattattttgagatacatcccatcaataactaatttattgagaatttttagcatgaaagttgttgaattttgtcaaaggccttttctgcatctattgagataatcatatggtttttgtcattggttctgattatatgctggattatgtttattgatttgcgtgtgttgaaccagccttgcatcccagggatgaagcccacttgatcatagtggataagctttttgatgtgctgctggatttggtttgccagtattttattgaggatttttgcagatgttcatcagggatattggtctagaattctcttttttttgttgtgtctctgccaggctttggtatcaggatgatgctggcctcataaaatgagttagggaggattccctctttttctattgattggaataatttcagaaggaatggtaccagctcctccttgtacctctggtagaatttggctgtgaatccatctggtcctggactttttttggttggtaagctattaattgttgcctcaatttcagagcctgttattggtcttttcagagattcaacttcttcctggtttagtcttgggagggcgtatgtgtggaggcatttatccatttcttctagattttctagtttatttgtgtagaggtctttatagtattctctgatggtagcttgtatttctgtgggatcggtggtgatatcccttttatcattttttcttgcatgtatttgattcttctctgttttcttctttattagtcttgttagcggtctgtcaattttgtagatcttttcaaaaaaccagctcctggaatcattgattttttgaagggttttttgtgtctctatttccttcagttctgctctgatcttagttatttcttgccttctgctagcttttgaatgtgtttgctcttgcttttctagttcttttaattgtgatgttagggtgtcaattttagatattttctgctttctctggtgggcatttagtgctacaaatttccctctacacactgcttttaatgtgtccctgagattctgatatgttgtatctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagttctttacttccaactatgtggtcagttttggaataggtgtggtgttgtgctgaaaagaatgtatattctgttgatttggggtacggagttctgtagatgtctattaggtccacttggtgcagagctgagtttagttcctggatatcctttttaactttctgtctctttgatctatctaatgttgacagtggggtgttaaagtctcccattattgtatgggagtctaagtctctttgtaggtcactgaggacttgctttatgaatctgggtgctcctgtattgggtgcatatatgtttaggttagttagctcttcttgttgaattgatccctttaccattatgtaatggccttctgtgtctcttttgatctttgttggtttaaagtctgttttatcagagactaggattgcaacccctgccttttttttgttttccatttgcttggtagatcttcctccatccctttattttgagcctgtgtgtgtctctgcacatgagatgggtttcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgccgtttcttcctaaccttgatggtctttacaatttgggatgtttttgcagtgtctggtaccagttgttcctttccatgtttagtgcttccttcaggagctcttttagggcaggcctggtagtgacaaaatctctcagcatttgcttgtctgtaaagtattttatttctccttcacttctgaagcttagtttggctggatatgaaattctgggttgaaaattcttttctttaagaatgttgaatattggcccccactctcttctggcttgtagagtttctgccaagagatctgctgttagtctaatgggcttccctttgtgggtaacctgacctttctctgtggctgcccttaacattttttccttcatttcaactttggtgaatctgacaattaagtgtcttggagttgctcctctggaggagtatctttgtggtgttctctgtatttcatgaatttgaatattggcctgccttggtagattggggaagttctcctggataatatcctgcagtatgttttccaacttggttccattctccctgtcactttcaggtacaccaatcagaagtagatttggtcttttcacatagtcccatatttcttggaggctttgttctttttcttttttctctaaacttctcttctcacttcatttcattcatttgatcttccatcactgataccctttcttccagttgagcaaattggctactgaggcttttgcattcgtcatgtatttctcgtgccatggttttcagctccatcaggtcctttaaggacttccctgcattggttattctagttatccatttgtctaattttttttcaaggtttttaacttctttgccatgggttcgaacttcctcctttagcttggagtagtttgatcgtctgaagccttcttctctcaacttgtcaaagtcattctccgtccagctttgtttggttgctggtgaggagctgcattcctttagaggaggagaggcgttctgatttttagagtttccagtttttctgctctgttttttccctgtctttgtggttttatctacctttggtctttgatgatggtgacgtacagatggggttttggtgtggatgtcctttctgtttgttaattttccttctaacagtcaggaccctcagctgcaggtctgttggagtttgctggaggtccactccagacactttttgcctgggtatcagcaggagaggctgcaaaatagcgaatattggtgaacagcaaatgttgctgcctgatcgttcctctggaagttttgtctcggaggagtacctggctgtgtgaggtgtcagtctgcccctactggggggtgcctcccagttaggctactcgggggtcagggacccacttgaggaggcagcctgtccattgtcagatctccagccatgtgctgggagaaccactactctcttcaaagctgtcagacagggacatttaagtctgcagagttttctgctgccttttgtttgtctatgccctgccctcagaggtggagtctacagaggcaggcaggcctccttgaactgtggtgggctccaccctgttcgagcttcagggccgctttgtttacctactcaagcctcagcaatcgtaggcacccctcccccagcctcgctgccaccttgcagtttgatatcagactgctgtgctagcaatgagcaaggttccgtgggccttggaccctccacgccaggcactggatataatctcctggtgtgccatttgctaagaccgttggaaaagtgcagtattagggtgggagtgacccgattttccaggtgccatctctcacccctttctttgactaggaaagggaattgcctgaccccttgcacttcccgggtgaggtgatgcctcgccctgctttggctcacattcagtgtgctgcacccactgtcctgcacccactgcctgacactccccagtgagatgaacccggtacctcagttggaaatgcagaaatcacccatctcctgcattgctcacactgggagctgtagactggagctgttcctattcagccatcttggctccacaccctcgtgaggacgttttgtgtcctcttctcctgcactagcatcaggggagagaaatgctgtcagtgactcagctatttggccagggctcagtttcaataaggagctgggtcatacttatgtctttcctctcctctgtcagtcagatcaccacaacttaatctgataggctcactgttcctgcttgttttgaggtgggcaggcctatgcatacctgtctccaaagtctgtgaaagctgagaagccaaagagagtggctatcacgccattctcctgcctcagcctctccgagtagctgggactacaggtgcctgccatcatacccggctaattttttgtatttttagtagagatggggtttcaccatggtcttgatctcctgaccttgtgatccacctgccttggcctcccaaagtgctgggattacaagcgtgagccactgcgaccggccatttatgaataccttcgtggggtctgcctctgggatggtatcacccccaattagtactggacttctttagctagtcttcttcagaaaggtagatcccagagctatcagcacctgggaacgtttctcagaagaaatgtttaatagggacttaccaataaaagccatgtctgtgtctcaggctgtgtgagagaagatggtggatttccatcagaaaagaggggaacaattgaagcacaataacagaaaagttgttttatctaagagcaagatctatagtaagtttctgttcttacacaaagaacagcagataaactggaaatcttagaggctttcctggagcagaggctaatcagaagccaacatggcagattagcttccaagacagagttgctttagcctacacactactctatccttctgaggctatatccccaccccattctaaacttatgtgaatgtattatacccatttttcctcgtagcctaaaatcaactctatatacagaccaaatgctattttctgcaaattctaatatttgagagtccattctgtggtggtctaactcatgactttctggcataacttttttctttcaacatttggtgtagataaaatgagttttatataattcattgtccctggatcctcctggccagacatttaaagctaaactcccatctgattctgaagagcttataatactttcagaagagataatgtttgctaaattttcatgcacatatttaaaacatgcagtgagcatagttcctcagaaaggtgatccaactcaaaggttatataatttcatatgtgttctccttctgtttatataatgaaaaacactgttaaattctgaaggataaatagaaacccttttctgcatagacattctcccttagtctttcatcagaggttatttagtttttctgaattttgaaggaagattaaggaattttaatggagggttgaaaatggcaaataatcacaagcatcttcaaaaggccaataaattcatttatctgccagctaataaaatatttaactccatttatggctagaattaatttcatgatattttcaggaaatgagaagagttgttcatttggaatgaaacattaaaaatattagtgattttgtaaacaactttaagaatacaataagcatatctgtagatttattggtctttcattggtaagcattggcaatgaaagttccaataagaactggatttgggggtatggggaacaaatatggccatctagcaaaagcaacatgaacatatgtaaatgttaaaaaatcatctcttttattctgaatgaattcaacaatatgcagagtgaataattttgttttgttttattttattttttgagacagagtcttcccctgtcatctgagctggagtgcagtggtgtgatctcagctcactgcagcctccgcctctggggttcaagcgattctcctgcctcagcctccggagtagccgggattacaggtgcctgccaccatgtctggctaatttttatatttttagtagagacagggttttgctacattggccaggctggtctcaaactcctgacctcaagtaatcctcctgcctcagcctcccaaagtgctgggattacaggcatgagccaccacacccagcctgaagtgtgtaattttaaaatgtatttctatatcctaataatttaatgttttatgcattatttttagaaaaataaaattttattaagttgattttatgaacagaagtagttattataatggaaagactgggaaacattattaatggtgcatctaaaataaggatgcttgaaaacacacaatgttttctccaaacttttttagacataaatattacggaagttctgtactaaagttgtgcaatatagttttggttttgcattataatatttaaaatacatgtcaatcatatacttactggaattagataccctgttagtagctctaaatattacttttatatttttaaatgattttatgatatttataatattaatataattttgtaacaaactctgaccctactgatattatatccttctcaatttgcagttgtttcatcttggaacctttttattttttaaaggaataattacaatcaataatgttttaaaattcctataaggcatagtttctgatttatgtgtaatataatgattcacaaagcatattttcaaagaagggttaaatatattaggaaaattctttgttctgtattttgctcttacaacccacaaatcccatcagcataggaaacattctgagtctaatggtaatacagcctcttacattgttggtccttacatttcataaagtcctgtcaacatgaaattattttacagggaattttgggaagcagtatttaaaagaaacacagggctaggcgcggtggctcatgcctgtaatcccagcactttgggaggccgaggcaggcagatcatgaggtcaggagttcaagaccagcctggctaacatcgtaaaaccccatttccattaaaaatgcaaaaattagccagacgtggtggcggctgcgtgtaattccagctactctggaggccgaggcttgaaaccagaaggtggaggttgcagtgagctgagattgcgccactgcactccaccctgggcgaaacgagcaaaactccgtctcaaaaaaaaaaaaaaaaaaaagaagaagaagaagaaagaaacacagtggtacctcctaggcaatccccatgcaatgctcttggcttagagtttaactgtgattaacggtcctcttccacaaggtcagagatggagtcagtggcccctctggttcctttctaaatttggaaaaggtggtatcagtctttcaggttcagtggaagacagacctgctgctcagcgtttagatcattgaaaagtagttgttaggtgattctccctttaactcaataattatcatcattttttttgctgaaaagaataaggatggaaaaaatcagaatggacagaacaatatgccataaagtcaagcagtgcggtagaagcatcttcacatcctgaaaacaaatgtagctactttcaaaaaagattcttgagaaacactgtgtaatatttgaagaaaaaagaatcttgctcacaatttttgcttttggacttcttgttgaaacagactatatttttattcagtgtttgctgagtgttttcctgttcacataatgcccagtatgtgcccagaagtgagctgtgaaagcaaccgtacacttttgctagtaggaaagtagctccatctcagctaagcatactccatgtcagaagcaaccggatgacattaaggatgcagtctatgggaaataatgtgttcttttcttcccaaatgctagctaatgagaaccaggtccttggcctcatcagcactaagctctcttagctgtaacctggttcagtattacagcactaagctttcttagctataacctggctcaatattactaatagaggtgacagcctctaagacattagaggagaaaaggtaaacttttttgcatgtcataaataatttctaggtgatgagtttctatcataaaagtgtactatgcattggagaaacactccatgtataaagaaaacctacaaaatgtggactgatcattatcaagccttaaacaaatgtgatgattgacagcaaaagaggttttctctgctatagagaataatgtcttgagaatttggagaccatttttattttccgtttccctgttagttttctgaatcttaccctaatcaagtttgacctgtttccttgacctttcaatattattggggaatgaaaaatgtaaagatgcttacatggcatatagttccagaaatcaacttatcatggaaaaatgccaatgcaggataggatatgcagatgatgcaacagacattctcagctccgatctgttatctagggctttcagaagcttacagggtctccttgccatcttatcagaaccagaatttcaaacttggaactcatgatctttctcataaaattagctactatcccctgaagtttactttctgttggtgatacctctgttcttcaaggttcccgttttaaatggattgatgcatcttccaaggatctctttggtttacccccagcttttcaatccttgtttcctggcattctctcttgagctctactttaagccaccctgcctgtggacatatcatgaaagtttctccctctgggccttgtttatgccctttcctgctctggggtcttcctcacttcttccaagccatccaaatcctaaccaagcaccaggtcagtgacctcatgaatccagaattcctattatgttttacttcttttgtcaacatcactacacatttcatacctgatttctcattatcttgtttcttttctgtgtacctctacagctcaacactgttatcttgctgtgctgtcctagggacactgctatttcaatcctcatacattgtatgggccatgtaatagatgctctataaatatttaaaaagacagcagttggaacaacttggaggagatcatctcacttaatacatttttttattattgttgttttatgatttttgttatttgattttgcttttttcaatgcctggggtaaaatgagagttcaaggtgaagtaatttatttacaaacactcaaagttgagactcaacccaatgcctttgatcccttccctgtgctctttctttcttttttaaaacagcgttgttgaagtgtaattcacatgccataaaattcactcttttaatgtgtgcagttcatggcttttagtatactcatagaattgtgcaaccatcaccacaatctgattgtagatttttattatgaatctcttagcagtgccctcctcacacttcagccataggtaaccactagtctgatttctgtctctatgtatttgtgtattctgaacatttcatataaatgaaatcatactagatgtggtctgttgtgattggcttctttcatttactgaaatgttttaaggttcatccatttggagcacgtgccaatattttattccttttgattgctgcataatattctattgtatagacataacatttcatttatccatccttcagatcacagatgtttgggctgtttttacatttttactattatgaagaatgctgctatgaatatttatgtacaagtttttgtgtaaatgcgtgtttttgtttctttttggtagacaactagattaattgctgagtcatgcaataacactatgtttaacctttatatacacacacacacactctctctctcacacacacacacacacacacacatatatatatatatatagagagagagagagagacagagacagagagacagagacagagacagacatagacacagacacagtcttgctctgtcacccaggctggagtgcagtggtacaatctcagcttaccgcaacctctacctcctaggttcaagcaattctcctgcctcagcctcttgagtagctgggattataggtatctgccaccatgcctaactaacttttgtatttttagcagagacgaggtttcatcatgttggccagcctggtctcgaactcctgacctcaggtgaccctcctgcctcatcctcccaaagtgctgagattacaggcatgagccactgtgcccggccaatattcttttgagacagggtctttctctgtcacccagggtagaatgcagtggtgcaaacactgcttactgcagcctcaacctcctgggctcaattgatcctcctagaaccacaggcatgaataatcatgcccaactaattttttttagttttattttttgtacagacggggtcacaccatcatgcccaggctagcctcgaacttctgggctcaagcaatcctcctgacttggtctccccaaatgctaggattaaaggtgtaagccaatgtgcccggccacatattcgttattgttaatgagaaatggtcagtactttatgtttgggacttgtcaagttgagtagacataaatacttttaggtttgtgaatagcaggtttccaaggtttaatatttaataaaattcaaacctggtacagattgattacttctaaaggagatccttttgtattataactacaggtataattattttgcagtcataaaaagtaagcacttcaaagcactaaaaaattcccccgtgtgagcaccttattgcaaacttattactttggggggtagctgagagcttccattgtatctgaaatatttgatttccacttgaacacaggcagcaaaaatgagtttatagaatgtctctgaggtaaatttagccaaaaacaagattaatattaagtgttgtctctggctttctttcaaaggaattttttctcagtgggaggtcatttcttctgtaacctaaagcatcatgatttttacagatttgtcaaaaaatgttagcaattcaaactaggcaatctgatttacacatacttatgtaaatagaacatgtaacagatatgttgagtttaaactagcctcacatagatttggggaggaaggaaattatgctttttcacaattaataaaatttaaaatcacaagaattatcactttatttggcttatagaattaaaattaagaaatattttttcttcctttcacccagagaaatgttaagatgaaatgccttcttacatattcaataagcttctctcaagaatgtgtctaatcaggacttctcagccttcaattttctcatttgcaatgctattctcattcccctttattccctttgttatttggccttgaaaaaaaatggcgagattcatatctctgtccaactgctgaaatctcacaagtttaaaatggcaatgtttttatggaggaatcgtggtgctgtcacggtgatttcagaaagccttacttctgttttgctctctctcagtctttattatgaccacctgaacaggatgaggggccaaagacactgccactgtgtgtcagctaaagagcagaggactgggcttggcctgcagtgaggaactgtagggaatgaggatggatgagtggacaaggaactagggctgcaaagaccacctttgggatagaaggcaattgctttttatagagtgtagtctccaggtcatttacactagaaatgtgtttttagaggaaagaatattgtccattagtgaacagatggtctcagcaggaaaggcatctcaggggcaagttttactcaagtttagagttcacaacaattatcctgatagatgtgtgtgcgtgtgtgtgtgtgtgtgtgcatgcacgcgcatgcctgtgggtatatgtgcacttgtgcctgtgcatatgggatttttcttttagcttgcttgactggaatgataaaataactagcgtattctttatttatttgctataaaatgataaaatgtggttttaacaaaaaatgttttaaaatattgttcattgaactttaacaacacacatacacgaatttttcttgcatttgccaaatcaaaacaggtttcatcctggtgttcttagtttaacaacaatggtctattttacattaaagcctattagtcaaccctgagcacaaaactccatccaaggtggtgactccaactatgacaccccctctccaccatatcaacctagatcttaagtgaaaaagtacaggggaaaattattctcctgcatgcaaagaataggaaaagagaaaggcatagaatgttaagaataatagtcgtaatattaatggcaattacattaatcattgtctttcaagtacctgttttgcgccaggcacaatgctaagtcgtctatgtatattgtattgttgtttctcctgatagctccatgtggtcaagactattattgaacccttttggtagacaaggaaactgaggcaaagaaatgttaaggaacagtcccaaagtgcacagctagatgaaaatctagaaattgcactctagagtctggttgctctagagtcagtttactcaagtataatttctggattatatgatatctctccgataagatgagtgtttcctagaggtgagccccctagagtttgggctggagaatggatggcaataggatagattaaggcttggaatgttgacggagaaagagccttctagaagagaaatatactatactttaaggcagggtttagaaaatgcatgtggtgcattcatgggataatgaagaatccaggctgctccattgggctgtttatgctggaaacactagttggagggacaggtagttatgcaatttgtagtagacaacctctccctagcaaggtagaaaagcaagagaggtaggaacaaaattctgagtttttatttttccatccatattttaagacagatgcacaatatctgcagtttgaccacttacctcaaaagagtgctacccataagctcctggctccaagaatgcttttgttcaaacataggaggggatttgaaagatgctttgaagatggtggtctgaatattttaactatagtaaggaattcctagtcaatttttgttattctttgtttttgggggagggggaaaagtgccaaatattttcatataggaagaatagagtattcaaaatctttctaaaaacctaattatatatgattagttgtaagattttaatcctagagtttggacagatctcaacattaaaatgacggttttggaaaattgtttaaagatacaaatgtcaatttgcttcctgggattcatatactgggaggttttaccctaatatgtttagaaggcagaatttggaaacaaagggctccctacttcttacagttttactttgtacttcatgatgctgaaaatgtaattagcccctcgataccatatggcacattggtacccattgttatctttttaaaattatgttttagggccctaacctatgtagattttaactctgcagatttatccaaagtacttcatcttatggcatgattttaaggctttattcataatttttacttattattaagagaaaactctctaggatcttttttctagtataagcagattatatttatagagtccttactatgtgccaggtactacttattaaaagtacattcaactggcttaattctcacaatactttgtgaggtaagtaatattacccattttattgttaaggcataaaattttcaataactaccacaatggagcatagctattacatagtggagctcagtgtgaaatcaaacattttggctctagagattttgctactcaccactgtgctatgctacaagggtaaggttaaacccacatatcagcctatataatactagagtgttttggttaataagtaggagcactttcttttctacaatctagaaaagtgctattgaagggaggtttcctaagtggtctctgaccatagatacagatgagatatttaaaggaggtttttaactacatcactatgtaatgagtggaggaagcaatatgtaatacttatctattattgcataaaaaattaccccaaaacttactggcttaaagcaacaaatatacatcatctgccagttcctatgagtctggaatccaggtatgattcagctgggtgcctgtggctcagaatctcccacaatgctgtctcaagttatgaataggagctgtgttttcatctgcaagtttgactggggaaggtctgcttcaaagctcatacatttggctgttggcaggccccaggtactctggctgttggacagagacatctgttccttgctccatggacctctccatagggcaggtcatagcaaggcatctgaattccctcagagcaagccagcaagacagggaaactcaagccggaagctatcttttgtgacctttttgtaaccaccactttttctgtattttgatgattaggagcaagtcagtaggtccagccatggggaggggattacacaagagtaaggggtttacacaaaagggatcactgggcaccatttttgaggctgcctaccagcgtctccccttgtcagcctaagataagttagtattgctatgaagtaataacagatcactgaatgtattgtcacctgcctatttttatagttaatagatacagcaacgtattttgtatttaaagcttctttttaggaaaaggccatttgtgtgccctccattaacttcacaccaatttcagtcagtttgctgtgttgtgataagatgtttcagttacaccctctgtgcttcagagtgactggtccttcattagagggttaagaaacttagtattttggcagaactgagtaatttgtttcacccagtggttaatttaggcaagcaactgacttgactgatctgagtccttttagtacatgtctgtttagctgagttaatcagatggagtattggtttagcattaggtcagggaattctgaaagtagaatatgtattacctagcctattttccacatctaaaataaggaaatatataggatttattaataaaatatttgagaaaacaacagaatatacattgtatttttctatgtaattttgtgtttgatgagtaatcattctcattagagaatgataccagttttgagttttgaaagacatcttttctcacagaactatcaattgccactctttgccagaagagtttttcaaagaggtatgcgtatttctgctagctatcattacaaaatgattctgagttatagtatgaattggtaatggatctacttatgacacactggttcacatctcagattgtttttatcttctaatggaagtcattcattccttcacatagtcacttatatattcagtaattatttgttgagtgtctactctggaccacacagagttgtaagcattgcaatgtaatttcgtatatttttcaaaatctcattgtaaggaaaagagtgtttagcacctctcactggattgaggtagcaatgtttacttcttaatatttttccttagaaaacaagcttcaaaaaattgtgttatcctttgattgtttcggaaaaagctgttctctttaaatagcatttaaatatcaccacaaattgatatatgattctcgaagaatgaagcttcatatgaaaataaataaacagctcaacacagataaagaaatataaattaacctagtgagaaaagaacacaattattggctggatatgaaccttgattatgagtcagtagcaaacactaaaagagggaaaatgatccattattcaatggaaataatttagcttgattattcctgcattttcaagagcagtaagatcagccacatgcagacaagtgggacagagttgttgtgaattaaatgcagttgtattgctattatatttaagacatcacaatctcatttactcccatggagcctgaagtatgtgctcttatgaataataatcttatgatttttttcataatatgaaattatacatgagcctctgaattttatttcagtcaatgaggtttgtcctctttttgttcttgccattggtgattgatataatcattcatatgtgtgtgcaaaatgacctgattcatcatgattatatatattaataatggctatattgaataactttagccaaaggaaatttgattggtaggattcacaaattatgaaatgtctaggatttaaagaacatatatcattaaaatcctttgaaaaaacaaattatccaattcatagtccttcggtcaagaaaattatttgatactcagttccactttaaaaattaaatattaaatttcatgagtgttgcctgaaagctatttgcaaataagttctgagtttgtgttattacaatgggtttccatgccattgaaaatattgttcttctacacatgacatctttttttctcataatttatctccttaggtcctatctctttctgctgctttttttttttttaccccagttatttcaatatgaatcttcttctcaactcagcaacacttcagggctcactgctcttgtcccagtgagttatctcaattgagcccgcgcatcacacatgtgaccctggcacatctgtgaggcaccagcacatgtactccacagccatgtagaagcagctcatgttccctgataatattgtgtagggagagaaatcaatagggccttaggcgagcctgaggaaaagagttaattaagcagtgtggaaaagagaagcatcattgacaagcagcaagatacatttaaaaggaatttttcaaatgtattgaaaacaaaataggtgaaggagggggcaaaacaggaggaaactatgctaccttttctcagtgacactatcacaaatttatttactttttcaataaattgcatatatatattcacacacaagtacattcgtaacttaaaccctctttatatttcagtgtagacaacatgtgagagggctgttatcgattctacagaagaatcatggcatgttatatcaatcatgtttcatgtgcaggagctactcgtagggattgtgattgttgctacatcatccagaatctcatagtcaagttgcacttttgccccatcaaattccacttttcatcctattaggaacaactttgctatgtaagcagggtttttatgtaaatattttaaattgaatcaattgcaatatgctgtcatgacatctgatttccaggtatgaagtaagtgtgcagtatattgtggacatcacacgatttgcctctctgttctttaccatgtgtctcatgatgccactgcaagttgcataggagaaaactgaacatatctactcctagaattagattggttttttagaagcaagattttcagggaaataaggaggaattcgtttgaaaatcccagttgaacacctattcgtattacagatgggtttatttcttggttttattcagaaactaggggcctggattgccacttccttttaaagcaagctgtgtaggcccttattgatcgaagtgtggtctcttggccagaagcatcaggatcacctaggatcctttagaaatacagtctcaatcttcagattagtcaaactgaatccaaatctgcatttaacaaggttccctaggtgattcttctgcatattacagtacggggaagcactgagcctcagacagttgcattttgggtagggcatatgtatttgtttcaactataactctcaaatcttgtcctctagctgtaaatcccaactacactgaaaattttaaattgtcaatcaatgcaaataaagataattaatatttggtgcctctggtgcatgcttaggatagtgaggaatgcacagagattaaaagaatgatgtcagctatgcagaagagtggaattcgttaagaatgtgattgcctcccatcttaagagataaaacatgcattgaaaaaactattagagaacaacatatacccatatttagccaactgctagattgagcttaaggctattactgctttgcaagtactaagaagataaaaatcattgtacaaaaattctctaagaatttttgccttttcttcttctctcagtcatcactgcaattatgataaaattatactgacctttggaaaactcagtcaaatatatgatctccactggccctgaattctacagtctaactaaacgtgtcacagagagagaattagatagttctctttaattggttttaaattggtagtcctttcactcaacattttttgctggcttcctttagttcactgtattacagtataacacagaaaaattggaacaaaaactttttgccaaaaactatgcattcgtagtcaagtaaacaaacatggctactctgagaaattggttataacaatatagcaagcaacaacccactaaaaaaatcaagcagcactaggaaatatctcttatgtttaatttcctgttggttttgctattcaggtaggtctggttttttgagagctaatgtggtagtctatacaaaagggtcatcgctgataatgtgtataaccaaatgttattgactataatttttttaaaataattttgttacaatttttctgcctttatattatatcagcaatacaaataaaaacactcctttagagttaaagcaggattttttaacaaacagttattttcaggccattagtaaaatataattttcaaaagttaaaaatatgactctcataaatataaaatgaacatatcaaagattttattcatttcattaattaatgacagaatgaggaaaatggcaagcctggcatttattggcactttaataaaaaattagaatatgtttgctaggatagttatgaaataggctaatatccattaacagtaataaactatcaactttgacatcttctcagctggacaggaattatttgcatttctaatagaaaatctataacatatagcttcactcaactggggttctttaatcaattgtaaacaggctgcttaacaaaatacattccctagataattaaatcatctttgtatggacctgataaatccccatggacaaatatgtcacctttcttttttccttattttcacattttacatcactacctgtatttagaaagatcacatattaattctagttctcattccattgttcttgctttctttagattggagtcaataaacataatctgtttctaaattctctggaaaataagcacaaaaccaccttactctaaatgtccttctttccttactgacctttccaggtagggcattcctaatgccatgtgacctcataaaatcatgggctagctggaatttattaatgtgacttgagagatgtttaaagctgaaccagtatgattaataatcatgcagatggaaatgaagggaagggtctgagatatatctagaaagtaaaatccaagggacctcatgccttcttgagtagaaaggagcttgggagaagaaagagccaaaattgacagtgggattacatgagaaataaataagatctttgacatttgggtttaaggtagtaaagaaacattgaatttaagatattgatgaagcaatgagaaattttactatggaacttgggtcagtgtaggaaccaggaccatagagtcacagggtacccattgatggtggtacttgaagccatgggaaataatttaaaaatagtcaccaagagagggcatcctaaaacaaaaccaacaaaatcagtattaggtaccagagaaagaagaggcaatgaagaaaagatagtcagataagagaattgaaatgtggcagtgtaagtgcatacaagttttttgaaatgtaaacaaataaatatagtactctcaacacatatacaggaatacattttaatttctctaagattaatattgtgtgcctctttccaaattactacaaacagggccaggcacgatagctcacgcctataatctcagcactttgggaggccaaggcgggaggatcacctgaggtcaggagttcaagaccaacctggccaacatggtgaaacctcatctctactaaaaatacaaaaattagtcaggcatggtggcacacgcctgtggtcccagctggagaaggaggatccttattattctgcacactcaccacatttgcttgccaaatgcaagcacaacctgaggattcctccagcactttcaatgttactactgcttcaacattccaatagttgacagtagatataattttggcaaaattagaagatcttatggaatggtttgtctcattcaatttctgacagatatgttaaagaattgttttcctgtcctttcgtctcctcccttttgcagttttgataatacagttaagcagaaaatcagtgagctagtctcccagtgaaatctcctctcttccaagggactgtgcccaagtgatcctttgatcatttggagaaataaagccctcgctgtacagaaaagctcagctccacagtgcctcagccacagagcagatcagcagccatgctgtcatatttacagccaggtgaaactctgggttctttgctctgcatatttgtaaaatcaccaactatgatgagagtccacgggatagcaatttgctgctgccgaaacatttccatgcaagattccagggaaaaagaaaatggcatattcctgggtcttggctgaaatgattttgctgttatttgataaataatagtgactgtgggcttcttttatgttaggtattctgttcacacacagataattgggattgcaacagatattttgtttttctttaaagggagttgatcttaataacaaaaaaattaaatatattcacaggcatatgactagacaagtagtgtatatatgacacaataactaaactaaaattgaacagtataaatttggcacagtgtacattaaaaaatctgaataattaacctcatggtgctttcattcacatattgggaattatatgagtctagaatgtgagaacgtgtgctgttctcattttctagaaaagactagaattttcctttatatggaaagaaatattttctttcagattggaaaaatatattcactttgtagggtaacattgacacagcaaggtttttgtgtgtggtttctagatgtgggaaatgtgaacttggcccaccataccgtctatatctattgtatgcattatcaagaattattatgaagggatctgttgtaattagttgacacaggattactattgtctctgcattaatgaggtagaggtaaaacaggatctctgtcttgtaggtcctcttttccctctgctccctctccttcctgctgttaattttcaaaagcccttcaggattttttaaaaaggaaagcctattgatgtgacttgataatttctccttaaaacaattcattttcatttctttcagttgagaattcaatttttgactcagcatttagccctaaaagcatttgaaacagggttgatcatgtgccagatgtgcataaatgctttacatccattgtctcatttgatcctcacaacaccacaaagttggtgttgttactcccattgtgtggcaagagaaggtgaggcacagagaggtaaatggcatgcaccaaagaactgacagctgttaagtgttggaattgtgacttataatcctttgggtatatacccagtaatgggatggctgggtcaaatggtatttctagttctagatccctgaggaatcaccacactgacttccacaatggttgaactagtttacagtcccaccaacagcgtaaaagtgttcctatttctccacatcctctccagcacctgttgtttcctggcttttcaatgatcgccattctaactggtgtgagatggtatctcattgtggttttgatttgcatttctctgatggccagtgatgatgaacattttttcatgtgcacatgcacacgtatgcttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaataccgcatgttttcactcataggtgggaattgaacaatgagaacacatggacacaggaaggggaacatcacacactgtggcctgttgtggggtggggggaggggggagagatagcattaggagatatacctaatgttaaatgacgagttaatgggtgcagcacaccaacatggcacatgtatacatatgtaattaacctgcacattgtgcacctgtaccctaaaacttaaagtataataaaaaaaaaaaaaaaaacctgtgacttaaactaggctaaatgcccatcattggtaaactggacaaagaaaacatgatacatatacaccatggaatactacacaatcataaaaaagaatgagatcatattcttggccgcaacatggatggagctggaagccaaaatcctgagtgaactaacgcaggaacagaaaaccaaatactgtatatcctcactttgaaaggtgagaggtaaacattgagtgcacatagacacaaagactagaacaacggacactggggtctacttaagggtggaaggtaggaggagggagatagtaaaaaaaaactaccgttgagcactatgcttattacctgggtgacaaaataatctataccaagcccctatcacacaaaatttacctatataacaaaactgcaaatgtacccatgaacctaaaacaaaagttttttaaaaaaaatcctaggcttctgttgaagcctatgggctaattttttcatgatactgcctgtgcttgttaaatgaatacatgtaaagcacaaggtctagcacaagtaataaaatctagttataagcaaactgttatttttattttctactgatgtttagattcagtattgttttctttccctgtgttggagatttattttagagtaacctagtctcatttctgtttacatttcagagacatttgtaggttttattgttgatgttgatttttttggaacaatatattgaaaaaccaaaatgtcatgaagttactgaaaatagttattccacatttcaatctccaatcttgttcctaatctcaaaattttgaacgtctacctgatttaaatttctttgagaagttttttgggtaggatgaaggagcatgctctggagttactgggtgttttctttcttcctatggagccaccctgttttattcatactcttgccaagcttccagcacggaagctttctctgtgatagattttctctggtatgaaatatttttttttctctttctcaaaatcactattaatgaacgtactggaaaatggagcagcctgacaattttggttctgaatgtaaccactatgaaaattttctaaaatatctaaaatatccttgaagtttctgtttcctcacttaaaacccgaaaaggttggactagatgaggaataaaaaatattctagtagactgaactatatgaaattaccatttttgtaggtaaaaaaagttgattattggtcatttcatatgacctaacctaagagattaactatcttgtaatttcaggttaaatattaatatgtatttatatagagaaaaagtagcagtgtgcagtcttctctatgaataacttctcctcagaagagactgagataccagcaaaatgttatgaattcttttggaataagtaggggttattttggaagatgctcagaatcttgaaattgtgatttaataaaagatctgttttttaaatgtttatagcacaatgtagtatgtgagcattactgggtaattgaaaacagtatatgtgagtattaaatatagctacaaaacagtattatttgccatcaactttccattttttaaatatattttcatgatcctaatggttttgcaagtactagtaaactggagctaggtttaagatattatccaacattttctctctaactaaatttgatatgtcatgtaactcttttctgattttaacagaaattctgactatataaggtcaacacacacacgcacacaatatattgcatggctgagttttagtctttaatccataaatatttcttttgctgagaactacagaagataaaaatgctgaatcagacgtaggccttgtccccaaggaccttgcagtcaatttttaggtactgttcaatctaaacctgtcccattctgacttctggacttgtgtccttttgctagcaaactgacttcatattcctttttgataagtgctggagctggctgggactggctcatatgagcccattgttaaatacgcaggaattttgcaaggcagttgctaaactgttattagtttgcaattggcctaggtggaagtatttaccccacagaaattggcagatgctattaatgggggatttttttttttttttttttttgcctgagaggcactttgccagtataccaccagaattcaccaggctggcagttgcaatagaattctccaaaagatatacatccgattattacacaaagatagaattataaaatcttatacacagctacgctggggtaggataaagtgagagatcttggagaattgtggcttaagaaaaataacttcaaaactaagacaagcacccttagtttagatagtaagttcaatttctccttatagcctttgcaggaatactgataacttcccagggagaaacaaatggctttttttcactacctacaacgtacttcacattgataaatatcatatgtaattcacatgaggatcctgtgaggttattatttactgatagatttttcttttgttgtttttgctttctttattttttattcccactttaaaagcaaggctaaaagcacaggtgtgttccgtggttagtaaatagctgagttgggatttaaacacaggccatgctgactgcaagactgtcctgcttctaccacactgttttccaggcaagagcatctgataagtagggccagtgattttgagtgtcatctccttttttatcccttaacatcttccttccccaagattagctaactcatacagaagaggcaagaaggcttcttggagagtttctgaagtcaagatttagaaaattaatgatttgtataattcatacgcaaagaaccaatcacaactttgccttaatgtcctcatttgcaaaataactattgtaaggaaatggaattgaaaatatttaatatctggagtttattatactgaagcattataggagcatagaaccttaggattttgtcatttctgtaggctaatgtctctccatacccttcctattatctctcacttttaaggacaatttttaaaaagattcatgttttttcaagtggggaatgagctaaaataaggaatctgtttttatctctcagttataagataggcagatgacagtactcagcctcatgttattgaatatgtgcagggagtgaaaaagacttctaattaaatgaatgccattgggtaccaaattttaaaggcctgcactaaatggccctagtcattaatcctagaaaaaagaaaatcgatgtgtgcagaatgttctctggtgaattttggtcatttgcttttcccaggaatattcactgactgtatcacatagtctttatatagctcaataatgagcaaaagaataaaaggagacataaaagaaggaatcagtaagtcagcactgacctaattattacaaagtgaatgtttttacaagtaacctgcaggcaactcaggagtgagaaaatatttttgttcaagcgtttcagtatttcttatgcatcataaagcttaaagcaaaaagaatagcattcagccataattgatgaataagctgaaccctgaattttagaataaaaatgtttacctgtaagttggctttaacatgataaaatagggatagtcaagacaaaggttgccttctgtttggctataaacaagtgtattctgttctattccaggaaagaaagaaggactcattttcttcattttttcttccttcccctatttctctctctctttcttagaattttcaggctcagagtctttaattataacattaatataggaaggacacgtttactgatttgatgtatattattttaaatgtgttttcataatatttcaatgtaatttggaaagcaaagataatagataatacatagaaataaaaacctgaactagaatatcaaaagatagcctttattttatgcttattccattgctcactgaggctttcttcagaacacaacaaaggtatccaggtctgtctaacttctacgattctataaaaaggaaaattaaaacataggccaggattacaattgtatataatcaatgcatgtaagaacatgtatatatttcaaatctgcaattttccaaaaacaaagaacatgtgtcatgattatcacttgtttgtcatttactcaaattttctcatgaactctggtatgactttgtcaatgctaattataaacttaccttgcttcataaaagacagcagcaaagttcatgagtttaagttctagggagctaaaaaacaaacagatcaatggaaactttgaactgtgataaacactatgatgaaaagtacataggctatgaatacgttccatgtattatcattttattttcttgtgcttgagcaaataagcatataaattattatttttcaagacctttcataaattttatgctgagattaaccattcatttgcacgtggcattttactaacccctacctgcatctcctcaaaccctctgaaagaataccctgtacaggcttagacccatgttttgccctgtagttctgttatgtaagatcactaaaaggattgagattgaaacctccaggaatttccccatgggctgtatttgttcttttaaataacttgaggatagatatggctttgctgtgtccccatccaaatctcatcttgaattgtaactcccacaatcccacatgttgtgggaggaacctggtgggaggtgaatgaatcatgggggtggtctttcccgtgctgtttttgtgatagtgagtacgtctcatgagatcttatggttttaaaaatgggggtttccctgcacaagttctcttctcttgtctgccaccatgtgagacgtgcctttcaccttctgccatgactgtgaggtctcccagccacatgaaactgtaagtccaataaacctctttcttttgtaaattgcccagtctcaagtatgtctttatcagcagcatgaaaatggactaatacagtaaattggtagtgggagtagggcactgctgaaaagatacccaaaaatgtggaagcaactttggaactgggtaacaggcagagattggaacagcttggaaagctcagaagaagacaggaaaatgcgggaaaatttggaactccctagaaacttgttaagtggctttgaccaaaatgccgataatgacatggacaatgaaatcaggctgaggtggtctcagatggagattaggaacttcttgggaactggatcaaaggtgactcttgttatgttttagcaaagagactggcagcattttgccccttccctagagatttgtagaactttgaacttgagagagatgatttagggtatctggtggaagaaatttctaagcagcaaagcattcgagaggtaacttggctgctctcaaaggcattaaattttacatgggaaacagaagataaaagtctggaaaatttgcagcctgacaatttgatggaaaaaaaaatccgattttctgaggagaaattcaagccagctgcagaaatttgcagaagtaacaaggagctgaatgttaatccccaaagcaatagggaaaatgtctccaacgcatgccagatacctttgtggcagaccctcccattataggcccatgggtttaggaggaaaaagtggttttgtgggctgggctcagggtccctctattgtgtgcagtctagggacttggtgccctgcatcccagccactccagccgtgactaaaagaggccaaggtacagctctagctgttgctccagagggcagaagccccaaaccttggaagcttctacgtttttaagcctgcaggtacacagaagtcaagaattaaggtttgggaacctttacctagatttcagaaaatgtatggaaatgcctggatgccctggcagaagtttgctgcaggggcacgaccctcgtggagaacctctgctagggcagtgcagaaaggaaatgtggggtctgagtctccacacagagtccctgctggggcactgcctagtggagctatgagaagagcaccaccatcctccagaccccagaatggtataaccactgacagcttacaccatgcacctggagaagccacaaacgctcaatgctgccactgaaagcagccagggaggagaccgtacccttcaaagccacaggggtagagctgccaaataccatgggagcccacctcttgcatcagcatgacctgtatgtgagacatggagtcaaaggagatcattttggagctttaagatttgactgcacctctggatttcgaacttgcatggggcctgtagcccctttgttttggccaattgctcccatttggaatggctgcatttacctaatgcctgtatccctcttgtatctaggaagtaactaacttgcttttgattttacaggcttacaggtggaagggacttgccttgtctcagatgagactttggactgtggacttttgagttaatgctgacatgagttaagactttggagggctgttgggaaggcatacttggttttgaaatgtgagaacatgagatttttgaggggccgggggtgaaatggtgtggtttggctatgtcaccacccaaatctcatcttgaattttaactcccacaattcccacatgttatgggaggaacctggtgggaggtgactgaatcatgggggcaggtctttcctgtgctgtactcatgatagtgagtgggtctcaagtgacctgacggttttaaaaatgggagtttacctgcacaagctctcttctcttgttgaccatcatgagatatgtgcctttcaccttccaccatgattgtgaggccttctagtgacttggaactgtaagtccaataaacctctttcttttgtaaattgcccagtctcaagtatatctttaccagcagcatgaaaacagactaatacacaattgcattagcctctaattgtgcctggctttctagatgtcctcagaggcagcacttgatgcaatggagtaggactcattgctctgtatatactgccttcttcgccttcttctggaggtccagtgcatcgccattgctgtcttcaaatatttgtgagtaccacgcttacagggcatcatagccatgatgaaggaaaacaacagacaggatttaggttccctctggaaagtacttcccatttatggcaagactcacaaatgtaggggtgtttccaactctacaaaaatatttagaatttccttaaataaagtgtctatctggagtctttggcatatatataacaagactggcaatatactgagaatttgaaattaagtgataggcatattgggactcattatactattcttttttttttggtggtgaaattttccagttttaacatcttcacatgtggtatttaatttacacaccataccattttcccatttaaagttacacaaccatcaccacattaattttctaacattttgtcacccctaaaagaaattctctagcattcacctctcatcttccagtccctccctcaacccatcagaggcaatctctcatctactttctgtctttgtatatttgcctattatgtacattttacataaatggaattatacactatgtggtctttcatgagtggctttcagatgagataatttttcaaggttcatccatattgtagaatgtatcagtacttcattccttttgatggctaaattaatattccattgtatggatatactacattttgtttacccattcatcagatagtgggcatttggactgttttcactttttctggctattgtgtgaataatgctgctatgaacatttgtaaataagtttatatgtagatatatgttttcagttaccttaggtatatactttgggaaggaactgctgggtcatacttaattctatttttaaccttttgaggaactgctaaactatttttcaaagaggcaacatcaatttacattcccacaagccacttttacgttcccaccagccagttgtgtgaagattccatttttttcacatccttgccaatattgttattatgtgtttttaatcacaatcatcatagtggttgtacagtggtatttcttactatcctaatttggtatctgcttaaaacttttctaacaaagaacttttaaaaattataaatattaaattctctgagtttgtttaaacagtcatttgcagaaacattttattgataacaaaagagactattaaaaaagtagccactgcctcaatccatattttgaggtcactgattcttaaaacgttatattggtataggatagaactggagaggattttttttaagtttagaagatttattggttctttgagcatgtacgcaatcctaatatgctgtaagccctctcttgcaataccgtcatgtaaacacgcatcatctgcatacaggatgttttgtcactattgcctgattttaaggtatattagttaaaaattgactttctcttttagaaaaactgtgtttggagcaattatttagattcttattgtgcataaaaaagtaattcaaggtctctttttgacaatgactattgactagtctgacatattcttgattaaaggatcaacaaaccttttcatttctagaacatgaatatttattaaagcagattagaaattttatctattgttacctaggaactttttcctaataactattgttctgatggacaatggcatattctgaactacttcctggtctcccaggaaaatggcaagttagttacattagaatgatcactgggcggtttctttccatgttgcataattgagggaaaatctgttaacattgcttgaaataaaaatcttttaaaatattttattaattggctttaatctcaattttaatagagtaattattttggaatagttttattcttttccttgtaatctaatggcttttgtgcagatataattttaagtagtcagccctaatgcaatcagtaattaaaattatagccaactacaggtgctgctaattgttaatcaattagatgcagaacgattacatatctaattgaaatactgattgaagtgttgatagttacccatacttttttcaaaagtaaactacttctaactgttcttaagttggaataagttgggaatattttctcaactactctctcactcattaacttatctgaactttagtggagaatagacttgctctttctgcatgtataaataaaattggtacagtagatcagaattgacctgactggctgttgaatgagtctgtgatttttaattggtttatgtgcatattaacaggccacattctgcagatggttgtgtgggttctgagtatctggatttggcaaatactaggaccattatataggaatgttatagtcattaaacactgatagaatccttgatttgccaggaggctgcagtgggtatcactgtcaacctgctgatcagcctttacagacattaattagttcacatatttataacaatttagtggtaagaatatctgcatgacaaaaaaaaagatttgatatttattccttttgaaaaataattgttgaaattcgcaatataggctcaagtttagaaaggaacattttacctataccatcgtaactgaaaactattttgcagtttctaagcatggaatcacacgaataggagacagcaatagtaagcaaagactgggtaatattatttgtgtttcatgattgatcaaatcataatcattctaatttagaggcataaattctctacgaagccagaatttattttctcaaaaggggactatagtatggtgtgtctatttatcttagtagatttaagtaaacctgatttaccaagagcattatataatctttcactggaaagaatcaatcatgttcttcaaggaaagagtttgagttgaatatgcctgtttcagcaccatgcctggagtgtagcaagcatttgggatgtttattgaacaaattaataaagtgactaatgtaaattatagtgagattttctgcagacattaataaaaaaagatcattaacaatccaaaaagagtgtttttttattttttaaaaccagccatgtaattttgagactgctgagatctcttgattgtgcatctgacgtgatgcttcagatgtaacatctcttctgtcagctgccaaaagtcacctattaagccaagtaaaaacttccaagtatagactgggataaaggaaagaaatttaggagaaaactacttcaaaaattttcctaaaaattttctctttttcagaaaatgggaatggattttagatttgtgtgcttgaggagagggaatgaaaatctgagcaaataccattttgattcaaagcaatagaaatgaaaaacacaaggacaggtattttatcattctgtttggttgcatggtatgctatttgtgaaagcattgtatatgacactatttttaatccagcaattctattgtcacctgaacatttatggtttggatgtaaagtgtaactagtaaatcatactattggtctatcatctggcattacctgaagatcgaagagagagaacaattccatttacctcatccctggtaggaatatttgttaggatgcctgaagtcttcatttccaacaggagaaagccacaaaacacttgtggttctgaaagcagcctgctgttaacatgagttatgtgaatctgatctataatcttacctgacatttggaactcaaatattttccttatttctccaaaacaattaaaatatttagtctcacttcattttatgagacataaatagctatataagtactctgtaattactgtacattgtaacaaatgacctcataaatacattgtaatgtcccatgtaattacatggtacatcgtgtctttgagatggctgctctgagattgaaagcctgctggtttcagagattaattacttagggcctaatttgacagtttgcttgaagataggccgctgttaatagccacttctgtggtttcataaaaaaaaaactgtttcttcacaagatcttatttccttatttactatagacccagctgtacatgtttatccctgaatattggccatacctaaatttttctgtatataaaagcaaaaaagtgaaaagggcatggttctgtacaggaagaagttgatttgcaattatatttctcccatcaaacactatgacttattttatgacaataattttaaaagttctggtttattaatttaaaaaaatgttggggccaggcacaatggctcacacctgtaatcccagcactttgggaggctgaggctagcggatcacgaggtcaggagttcaagaatagcctggccaacacggtgaaacccctgtctctactaaaaatacaaaaattagccaggtgtggtggcaggctcctgtaatcccagccactcagaaggttgaggcaggagaattgcttgaacccaggaggcggacgttgcagtgagctgagatggtgccactgcattccaggctgggtgacagagcaagactgcatttcgaaaaaaaaaagaaaaaagatattggagtataagatattgtaaaaattatgtcatttttttctctgattaagcgttatacagcctataaactaatatttcattttgtaagagcccaaattcgtttgtcacaattattttatcatgagggcattattataataccttgcgatctcagtggttattcttgataaatgcatcttatcctatagttgccgtttttatatggcatgaatcgtatttaaaccttctttctctttgactcaggttgcttaaatatctggtgaaataaacttttctcaagttgtactactcaccttactgctcaaattctatctagtttccatgttccaaaacacaaaggaaataagaaataagtgaacactgtattttctgccttaaattatatactggccctattttcttgtgcctttctagggtgtaattttacatataactcccctgatgtatttctattccagctttcttaggtctagttcctacatcaaatatattatattgcttttagtagttttatttagtacaaacgaatagtctgagaaaggacctagtgatctgaaagagttaataagcccttctaaacatccagcttacttccaaggaatgatttaggcactggagaattaagtctattgatactgacaaattccaaaatgtattaatcgtaaactcactttatcataaactctagggaacaaccaaattgctttattgtaatggaattttgtcaaaacgtgaatacctcctagaaattacatttccagtttctaggacctagaagaaacaagcctggctactaggctatgcatagaaaattatcagatgtaaaaaatgctattttaaatccaggagcttaaaaaaagaagatgctaggtacacaccaaactcactgctttcttttcatgtctttttattctttgagctccacccccccccccttttttcctgtaagctgggctatactctgacatttggggatcattttcttagtcagtttaggaatattgggttggttttgcttagttagccaagaaagcccagcgggcaggaaggattaattgatttttctttatttttcttcccataatagaaaccatatatggttacatatctgagaagcaactcgaatagagctgtggtaatcagtggaaaaagtgatgtttctatgggtcattcatctgaatatgggaaaatttactatttaaaaaaaaccacctcagccaggcatggtggcttacacctgtaatcccagcactttgggaggccaaggcgggcagatcacctgaggtcagaagttcaagaccagcctgcccaaaatggcaaaaccctgtctccactaaacatacaaaaaattatccaggcatgggtggtgggcatctgtaatcccagctactaaagaggctgaggcaggagaatcacttgaacccgggaggtggagcttgcagtgagccgagatcgtgccactgcactccagcctgggtgacaagagcgaaactccgtctcaaaacaaaaacaaaaacaaaacaaaacaaaaaaacaaatctttgcacaatgctgaattgtctttgagaagcaaaagaacatttctcagagatttgtaatctaattgttgcaatcagattaagtatttatgaaggtaattcagtcacaaccagaatcactccatttatttatttttatgtctgtgaaacccaatcatgtgaggccaaagtgacttgattacttaattctttgaaaacttgcttcagtttttaatgtcattttgtgtttcaaaacagttatccatactactcctactgcaaatcatgacaatcgtgacatgggaaaactaaaataagagcaaaactttgtattttgtagtgttttcaattttctaagccctttctcatcgatcacctctcaataactagggagagataatgttgtaatacatacaattgatgctgctatataaataatttctactgtcacttagcaaattaatgaaaagctgagagtagaacaatatgcatccatgttcatacagtccgtgaataccttttatgtgcagaacactattctgcctttctctaaatgattcagaaatgcacactacacttgatcttagccaaaaagtcaagaagcaataggaatgcagctagatagaacatctaataagattttctaagcaccacacctggtataaaaattaagaagacctccaacatgtttctgtacatctgtgcctaggatctgagattcatttaacatttggagttaaatttttaaatagattactagcgttttttaaatttttattttagtttcaggggtacatgtacaggtttgttatataggtaaacttgtgtcataggggcttgttgtacagattattttgtcacccaggtactaagcctagtactcaatagttaatttttctgttcctctccctcctcgcaccctataccttcaagtaggccctggtgtcttttgcctccctttttgtgtccaaggatcactagtgtttatggtccagaattagcatgccagtttggggctacagttgaattaacctcatcactagagagatgtctgcaggctactctcagctgttgtccacttttctcctgatagagctccgagcttcatatttaaataactcaagaagtagttttttatatattactttggaagtgtgcaaaatactagcctaccagactctcaaattattagtctccactgggcttcctgtgtctctgtgaacagtcatagattggggacctcacaatgaaggtttggaaacctatttgaccctaatttactggttcaagtctcctgtgctcctacaatgaagcgggttgggtaagttattagtttctccttttttttccttagaattgtgaagtttgagttgtaagaattagattaaagcagagaaaagtggtggcatgtcaatttcccaaaatcaatttaaatttagctcagtttggctaaaaaatataaaaatggaacatataagaagtggagcataattcggataacatttcttactggtgtaaatgattttttaaaaaataaccctaactgtgttgattgtatacacttgaaaaagatcttggggatgaacaggcatggagttcagagccagtggcaggagggctgtgccctaaaccagaagaagtgaggtgatgaaggctgtcattcaaaaagacagtatccagagaagtggagtggtagaaagcagttatgcctgataggggagtcaaaaagactgaagagacatttctggttgtgaatcagaaggctagtaggttttgctggttcagagcgctaaatcaggtaacatgcctaagttcagaaagggtgggtgtattttggaagggaagtctgccagcctctgattagagtctcagagaagacagtcatcgctggaggactcagccttgcatgtcttggagggacctggcagattaacaaaatgaagggggactcacccggaaacaaggcagtgtccccaccagagaaatactgttacaagagctgggacccaaatcaaagtagatgatttgatttgaagttgaacaatctgagaaattgtcccaggttggcttacgtttttacataaccagggaaaggattctcccagagtaggtaaaggagagcttaatctctaggtaagagttccactggcacttttacgagaaccaggggccagcagggcaaagataaagattagattgttttacaactatataaatgtattgatgaagaaatgtttgtatcattttcaagctgttaaataaaatcacaacagcttagcctttattttttttaacaaagtaacatttcttgcttcaatttaagacatctccataaaattttatttaaaatcaaatattacccaacgtgtacttaaacatactttattactgcacaaatatttacttcaaactttgcatagtaatgtcagagttttccctctggaaatgtatcatactgatacattttgtctaacagttgtctacatgaaattacggatctcaactttagtattctacccaaatttctaacttcccttaatacaagaaattatatatttattaatgctaaacttaaaaatatgtcaaatcaacaaaaatagcatataagagtaggaaaaaatatgggcctttattatatcatattgatattttatcaaatccatgctgggttggtaaaataagtttatagatttacatagtttataaaaagacaaaattgttaatgaaaattgtttacaaatacacataatagaattttttcatagatatttatgttctagcttgaaattcagttagatgttttcaggatctatagaaatatttaccaagtatttagatagatactgtaagttaaacattaaatgttgctattttgtaattttgagattatgagtataacatttgttctgaatgatgaaatttgaaaactgccctttccaacattaaacagaatgaatccatatgggtaatctttgtttctatatcctctgagtgtttccatttgttggatatctggtaggtaagtccagtgttttgttttttcttttggaaagtggattatttttcagaaaaccttatccatgtaaatgcattattatctaccgtgttgcctatgtcagaaacctgtcattcttgatgacttgtcctcctttgcatttgacattcaataattcaccaaatcctgtcaagtctacctccaaaaatatatatgggattttttattttgctgtatcccaaggtttcttcactacccatgcccggaggttctatttggtacagtaagaaatgtgaatggtaccctgcacagaggaagtttctcaataagtattcatagaatagaagttacaaaagtgttgctagacaatttctctctctcagtgctcctttcagttcacagtagaaacaaatgttcaattgttgggtcagtgcacaaataagtaggtccatattcttggcattgctactgtacgtggtcttgcttccttccttcctgctgttttccacttctgcttttctttattctttctacctggcaccctcacaatctttcagtctctcaatctctggatcgctggacctcactgtcactctctctttttctctttcccttttcctcccagtttcccttaaagtagttctgatttactacataaatattatgtgccagcactctgatggaactttcacacgttctcattgtttcctttcatttgtaccataatcctacgagggagggactgctattagctcatactgctgatgagaaaactcagtctctgaaggcttatgttgcaaattcagggtcacacactgaccagaaaggtaactgagatgggtgtgagcagtgtgagagtagaggctggggcgccagttagctatggcaatattctgggcaatagacaaatcaaggtcagaattagggtagtgtcagaggaaatatacataactgggcagaaaagggactcagtgaaaataaattctttcaaagtactgatgggcacactttaatgaaaaccctcagggcctcatgcatactgggagcatattttactctgaaagcaacttcctgtgagattcaagtcaccagaagtccaaaactgattttaaattagttttcaagattcgtagattcctgctatgttccagccaaggcattcttacttgctgcaaggactttcagagtgcccttcatagctttctatgggaattccatctagataaaaccatcttttttaaaaaaggctttttgctagagtaactgactgtgtttgacgaggatcaaaatgggtttgtcttcacctgaaggtcactctggagagagtaaggcagaatgtcagtgtgcagtaggagatgtggagttaaaaatatgataagtttatgaaatgtggcttctgagaaaaattggagtggtgggcttatcaacctctttttttcctgtttcctcacttactactcttgtacgtctacagtggagaaaacagaaagcagtgttttaatggatcccaggaaaaggctaacaccacatcattgaattggacatgactatcccaggcagtttggagactggccagtgacaccctttgttttaaatcaattaactcttttccatcaggtttacttggcaaataaataatttttatggtgatcaaagaggggatggaggaattagaggaagctaaattttatagttcttattttttcccaaatatgaagaaaactgaaattattcattgattcggatagaacactgcaagtgataaggattaatttctccctctcaagtaataaaaggaccaaaagtcaagtcacagctactagaactgatttttcaaaagtcaaaggtcatgtgttaagtacttttaataaaaatcattgccagggttgcctatgaaagctaggttgttttacaaaaatgttcccgtaacagcaacagcttttggtggcttgctgagggaatgggaaatgaagtctgaactactgggcagtggcaaaataggtctcatatagaaaataagatgccttataacattaataagaaaagaatgcctgaatgctttcatttaacttcctaaaacacaatataatttggagcctccagctgtatcatctactaaagaacctaagaagaaagaatctttgtaatctgctgacgcttgaagtcaatgagaaagcacaaaagatgctaataaacttagctgctacctacagatgaggatgaataaaactgataataatcacttccaaagatgaataataaccattcagggggtttcactcctggtgtgttgagtgtataactgattatattaattaattgctgcttggcatcgatattaaggtattggctatgtgggaataatttaagcgatcactggaaatcctcaaatgtgataaagaaaaattgtcaaaaactattacttatgtaatcattagtataattaagttctccaggcttatcaagtgatttacacttggtagacatactaagcacaattgttctctctttttcagtatgtacatggagattcagatcacttattagactcataactggggatggtggctcactcctgtaatcctagaactttgggagggtgagcgggtggatcctttgagcctaggagttcaagaccaatctggacaacatgacaagaccctgtctctacaaaaaatacagaaagtatttagccggactatgtggctcctgcctgtagtcccacaggaggtggaaggatcacttgaacctgagaggtgtaggctgcagtgagccctgattgcaccactgcactccagcctggatgacacagagagaccctgactcaaaaaaaaaaaaaaaaaaaaaaaaaaaaaaggcttgcagaaggtcactcagcaaagtcacagcaaaacaataattggaaattaaaaggttctaattcttgttctaaggtttaatatctacatttgtattttccttttcaacttgaatttatttttgactttaaaaacagctgtagtcttcagaaggtggccctccttgattttccaagggctttgtatgggaaagcttattggatgtattttaaaagaataatttaaattatttaaattctagtttttaaagagaataggagaaattagatgagtataattgccaagtagagtccctgtgattacttattttagtgtgaaataatgaaaggaacattagaccccacagttgggaagtcttccattgatagtgccaggtgaccttgggcctatccttcttttaactgtgtcccaatttccttctttgtaaaatcatcaatggtgataatatctgccatttcaccactcaccactaagatgagtagtgaaacataaaccatgactattcttttaattctggttttctttcctagtttctaaaacactggggagtaaagaatatgtccacacatgtgcacctacatgtatgaatggtggggaagaagggaatagatgggcttgtgtgtatttaagactatgagttctttgcagccagggactctacactattattttatgcattattttatctcctaaataacttagccaaatgccttaaatgaacacattaatccagccttctctctcttttgcatggtctgaaaaattttgtaatgtttttcccaatctacctttccttttccttatcctatatatcctttgctttagccactaagagactacatgagctttccctgaagatgcttgacgttgtccttacatcttgagcttgttcttgatatttcctgttttaaataccattcccaacccctccgtgaactccaaatcacacttgaaggatgagttccttgtaaagtccttttggtcatatgacatagaattaatcactcttggacattctactataaaccttagcatgttgttttttcattattagttcatatgtctctttcctcagccagaatgggtaaatcatgacttatttacatgtttaccacatcaagaatgtagttgatacatgttgaatgagtaacaactaaatgaattagactctcagcctcttgaacttctcataggaggcaatattaagcagaaaagaatgtcctccttttgactcatgttatctcagttaaaattctgcctattgttggatacatgtctattttatttaaccattcttgtcccagtttacctgattttacaaaggtcatagcaatagaccttaactcacagagtcataatgagcataaaaatataaataatgcagagtgcttagaccattgccaggtctaaagtaagtgcaaaaaatatgttaacaaatagtagttaagagtggtgcttaatttatcacacttaaagaatagtggaaacaaagtaaaggatctcagtgcgatagtattttgaatatattctaccaacttaatcagatcaattgtatgtaactagattcctctgaaattagtaaaagatttttattatataagtacagttgatcctcattatttacagattctgtagttgcaaagttgcctgcctgcttgctaaaatttatttgcaactcaaatcaatacccttggtgctttgtggttatgcttagagcagggtaaaatttgagttgccaaatgtccacgttcccagctgaggttgaagaaagagatgctctgtcttcttgttttagccctcatactgtaaacaagcaccctttttgaggtccatttggtgccatgttttttgtatttctgtgcttttggttggtgatttttctgtttaaaatgatcccagagtggagtgctgaagcactgtccagtgttcctaagagcaagaaggctgcgatctgccttatttctcgcattaaagttcaaagttaaagagttgacaatactgtcatattaaataaggtatcattaaatagaaacacacataaaacaaggttgggtacccatcagttgacaaaaatattgtaaccagaggcttgaaggaacctaaacctatatttcccctaggagcaatatttcagtattctcaaattcagtgctggggtgagggcagctatacagaaaataacaaagtaagttactcagcaagtaaatgcaaatttagattatattttttttcttctctcagagaaacttatctgcagagcaccagctaatttgtggtagatctggaagaaggaggttggatttctatctccctggagagtctagctctgcctctgctccatgactgaagcagggacagggaggtcctggacaaatccattatttgacgttggttctggattcattctttctttctttctttctttctttctttttttttcttttctttcttttcactctttcttttctttttctttttcttcctttcctttcctgtcctttcctctcctttccttctttctttctttctttctctctttctttttccgagatggagttttgctcttgttgcccaggctggagtgcaatggtgtgatctcggctcactgcaacctccaccttccgggttcaagcgattctcctgtctcagcctcccaagtaggtgggattacaggcatgcgctaccacgcctggctaattttgtatttttagtagagatggggtttctccatgctggtcaggctggtctcgaactcctgaccacaggtgatccacctgcctcggcctcccaaagtgctgggattacaggtgtgagccactgcacccggctgtgtctggattctttctaacagcctgtaatttgtttctaccacctcaaaaaaaaaaaacaaacaaaaaacctctgtgtgcttattttaaaacttaatttaaatattttcagagtattacatgcacattattttttaagttaaataatactaacaagcctataacaaaaacaaacaggctctttctttcccctccccaaaccctgcctccattccctaaagactgcctttttttttctgacatttacctttatgtttctcagtaatctacttatttagatgtctcttagtttaccagttttaattcatcatttgtagatatcatctattggtttatttttatgtcaggatttggtgctgacacacttccatcctcattttcttctccaatcttttctcttttttctactgctgcttctcctcctcttccttattttgttgaggtgtaattaaaataaatgaaattataaatcttaagtgttcagtctcatgaatatactggtattctagggctgccataataaatactgcagactgggtggcttaaaaaacaggcatttattttctcacagttagtgaagctagaagtccaagatcaatgtgttggcagatttggtttcttctgaggcctcgctcacttggcttatagatggctaccttcttcttgtgtcttcacgtggtttttctctgtgcatatctgtgtccttattttcttttagagacaccaatcatgtcatatttaagacctaccctcgtgaactaatttaaacttcattacctccttcaaggacttatctccaaattcagtcagattcttctaagatacaggagtaataacttcaacatatgactcttggtggtcaaaattcagcccataaatatgtattttgacaattgtatccatctgagtaacaaacatgacatcaatatgcagatttccatcaccccaaaaagtctactggtacccatttccaatcaaaacccagaacaactatttagactattctgacttcgaatactgtagattagttttgcctattctttaacttcacataaatggaattaaacagtatgtactctttcgagtctggtttttcatcatattatatcttttatcacattacaattttcttcattgtcttcaacgctgtttgttgtgttttaaatatttttttttcagactgcactcttttcctggaacacatctttcattagcttcctgttaaggaaaacacaaatagatatcttagaaaccatgtatatctgaaatatccctatactgtccttagcatatattcttatacttgtgctatattatccttatgcttgcttatttgactggacattaaattctagacttagaatcctagattagaattgtatgattcatgttctgttgttttctaatatcgagtgttgttgagaaatctgatgccattcttactgttgatcatgttttatgtgacctgcttttttccccttcattctggaaacttgtggatcccctccccactctccatgaggctctagtattttacagcaatgtgccttgaaatggatctgttttgcatttattttgtttaatattccacaatctttttcagactagagtctcaagtattccagttttgtaaagttttattgggaaaggggtcattttatcatttttgctaattttctaccttttatttttcctgcttttttattctctcctcaggggtgttggaaattgagaaccaaatctctaatttgttaccttttctctcccatttcatgtgataatttattcccactgaattttgagagatttcttttaattcatcttccaacttatttattgaatatttaatttgtgcaatcaaattatatttgtaataagtttctaaaaatcttttaatattcttgtgtttttatcctgttgatggatggattatcatttcttagattaccagggtattaatgacgtctttttggatttcattctttgcattactgatgtttccttcatgtgctgttatcttcttatgtattactttttccacttcctttatgctaagggccttctttgatgtctggtaatcttaaattgtcagtttacattaaaatgaagtatgaaaaagctgattttaaactacaaattttagcacttgagttggacttattaagtagtgaaatgggagaattacttgaccccccttgcaggatatgtgacaccggtgtggcctgtctgtttggctgctgcaccctcaaaccccttatgggacagggagcatgcagacaggcaggagctagggtgagcacttttggtctctgagcccacagtagcatctaggggttgctgtctgtgactcccaaatccccagtgagtgtgctacagtgctctttcagctctgccatctgcagacagcttaagtgttaaccagctcagtgccttcttggtacctgggttcttgtccagcatccaggaagaatcaggtcacatgaacaaattgaaggatggtaaatgtgggggattttattgccagatggaggtggctctcagcaggatggatgggaagctagaaagggggtggagtgggaagatgatcttcccctggagtttggtggtcccatggctgatctcctacccgactatccccagctgaactcctctcgatgttcagatgctccttctcttctcttcttttctgccacactgctcttctgttcctctcctcttctgctagtctgctcatttgcttgtggagcctggggtttggggttaatatgggtacaggatagggggacatggcaggccaaaaggcaacatttgggtgtgaaaacaggaatgactgttctcatttagggctgtgggtttccaggcttgagggtggggccttttgccagagaaccaccttcttttacccagtatttccctgtctcctgtccatatcagtaggagcctcattgttggggaattgatcagggatatgactgctttttttttctctagggcaaagataataattttctctagagaaggattatatgatattctacccaagaagcatatacctggttgccattgctctaggtatcatatgaaggaagaagacatgggtagctcatatctttgatttacttactcttgcctacatccctgttctctcctgtgtttaatatctctgaaactttggcctctgagttgaatatccccagaggataaagctaccaacacctccaaggtcagggagggttagtagcctggttttactgggtataggtagaaacctgatctgaatgactttcagtccttcccctccttcaggactatgcttggaagtcctaccttccaagttatataagcaggaacaatgtctaggaatccctgacttttgatgtgcttttcattgccttgcttttttattattgtctcttaaaaacgtatttagttttccggctctcttctttggctcagtcaacctatgatacggtttgactgtgtccccacctaaatctcatcttgaattgtagctcccataattcctacctgtcatgggagggacccgttgggaggtaattgaatcatgggggcaggtctttcctgtgctgttctcatgatagtaaataagtctcacgagatctgatagttttataaaggggagttcccctacacacgttcccttgcctgctgccatgtaagacatgtctttgcttctttgcactctgccatgattgtgaggtttctcagctatgtggaactatgagtccattaaacctctttttctttataaattacccagtctcaagtatgtctttaattagcagtgtgagaacagactaatccactatagctccctccgatttgcaccttccaaatattagttgacatctctcatgcaatataaccttattctctattgttttgtggctttataccatttagaatattttactgtcattttagcagtgtatgcaaaggagaggtgataatgcattcaatcaatcaaaggaaatgtgtatttttgttaaaaccagacaaataagaatgctgtcagattataagaacgaatttaatttgtctctaagtggcaatcgctaacacttcttgcttctctgctttcttcacacttacgtttgggttacttctttgaccctgtcccattgtcctttctttcttcaatgttttaatttacacctattattttacagagtatcaaagttagctggctgcctcctccatcaggaacacaaaatggatttattaccggctataaaattcgacacagaaagacgacccgcaggggtgagatggaaacactggagccaaacaacctctggtacctattcacaggtcagtgttcacatggtgtagtcttgcaaggttttgatgaattaaatgctttaggaataaaatatagtctcactccaaaggaacattgattttcttcctggcatccaggcaggtgacatctattggctggaacaagaacaacctttatatttttaactttacattctctataatgttttcactatatatttctctctggatcatcgtcttaatacatgtatcataaaatttttattcatactagtttctcagcattgctgattcaacaaaagcatctgttatctaaaaacttaacattttaaccagtaacttttaaaagtcatctaatgaaattgttccaatttcaatcactttgattcccctctaccaatattcaggggtgagaatgggttgaaaactgaagaaaagggtagattgtaaaacaaagagagagattattctaccttctgccaatataaagtaaattcacttatgcagcaatattgatagaattcagagtagatcaaccttctctatgaaaactggacccagtttgcatgtaaagaatatatttttttaaattttataaaataatcatgtatttaataactacaacctttaattcacaacagctcaggttcctagaaaacagaatgaggcgaggctttcaacgtaatacctttaaagttataagttcaggaaaacaagaaggagagaacaaggaaagcaatccagggaagaagagaaaacagataatggtggtacattatccatctgtggtggccacaacttcggggcaaacacagcacttgctaggtctcctgggtgtctcttgagaagccacatgaactatctcacagtccatggatagaaggtgtgagcagttgctctcttgtttctcactggttgagttcaccaacagcttactgattactctgcacctcccaggcagtccccagtgaagccagagcttctgatgactctgcagacacataggtgtctttttgtcaatcaacattttatgtgatggtggcttggcctagggtatgatcagagctcagggcttttcaaacctaggaatatcttgagctactgccagaaacttggcaagcaaagcatatagaatggctcatgacacagctgggtagatgaagttgagcgactctgaagtggcacataaactgggtcaggacaacatacaaaccataaagcacatgacttacaatttatagatgaggtaaactaccattgcaagtgagaaaaaagaaagtaatcccttatgtattccttttctctacgccagatactcagcgaatttccatttgaaatcatgactcacacacattataagcttcttgttcagcctacactcagagacttgaaagtaacttgtttatttattttttcttcttttctctcaggttgtcttttatgcctatataattttagcataatggccagagcacttccaaagtagattgccaaaaatcatgttttaaatatggacaaaatctctgaggcagggaatggttgaatctaacggaaagtttaacatttaccatatcattttaaaagattttgaaaagccaatatcctatgtttttctttttcccctgacaaaataatggggaagatggtaaaaataatcaaagtgaggaacatgtattcattaggatatttggtacaatatgacttttactttgagagaaatcaccaaaattgaaaaatcttgctaaaaatattttagtatggattctaagatttaatattagagtagaggagacactaaggataatttaatccaagctcttccagacatagagatttgaagcctcaaaactttatcatcattgcttttgcttctcaaatgataaacattgagaatataaaattaatttcttactataaaataattaactaaaggattaatattccaataaaaaagctaatgattggatgttcaattcacagaactatacgcagccaataaagatgataaaatgttcaatctcattagcaaatagagaaatgcaaattaaaataaaaatgagttagcattttcctttgattaaagtaataaagataaaaataaatgagggcatcccattctggaaagcatatgagaaatgtaaactctcatatactgcttgtgggacagaaaatgtccataacccttctggaaagcaatgtgtgtgtatgtatatatatatatatatatatatatatatatatatatatatatatatatatatgtattttatacgaggtatatacatgtgtatgtggatgtatgtctgtacatataattttcttttcataaagatatgacccaggtttccaaattctacgagtttatcctaggaagcaatcatatttttgcaaagtttttagctagatgcatattgtcatattattttaatagctaatagtgtttttgaaaacctaaatatccaactataggaagttacctagaaaactcagacacagttgtatcttggaatactatatgtctaatttaaatgaaatagtgtaaaaatgttaaatcatatgtaaattatgattatttaaaacatagtaagcaaataccccagttttaagtcagtattagtacaagagctcgtatttattaaaaaaagcattcacataaaaatatttagaataatatatatcccaaattgttgaccgtgaatattgcttactttgtaacaacagtatgatatgtatttttaattgcatatgcaaaatgaaaaacaataagttaaaaatattacaatttttgctttcaaaaattgaagatttcttcccactaatgctaactcaatatcatctgaatggcttagaaagcagtggtccagaaaacaaatgaatagtagcctcatggccagtagaatttgctagcgttaattgcttagtccttatgagttattttggcaaatggaagttaacacattcagttagtattttcaaaccaagattctgactccctaaataacacatttaggactttccctctgtttaaggtaaaatcattgaaaaaacgcagtacggcaactattagctttctcaccagcagagacccaaaacaaaataccacgaatttcgtaacttgaaagaatagacatttattctcatagttcaggaggccagaagtctgacattaaggtgttggtaggttcagctccctctgtaggctctgagaaagaacccatcccacaagtctctcctaactgctggggttaccggcagtccctggtcttccttggcttgtagatgcattgctctaatctctgcctccatctttttatactttcctctctgtgttctctcctcttccttttttatttgttttgtttttttgagacagggttttgctctcttacccaggctggagtaccgtggcatgatcatagtttactgcagacttgaccttcgggactcaagtgatcctcctgcctcggcctacggagcagctgggactataggtgtgtttcaccacacccagctaattttttaaatttttcgtagagacaaggtcttgctttgttgcccaggctggtctcaaactcttggcctcaagtcattctccctccacagcctcccaaagtgctaggattataggcataagacactgtgcctggcctctctcctcttccaattaggacattagagatagagcccacttgaaatccaggatgacttcatcttgagatcatcaactaattataactgtaaagaccctatttccaaataaggtcacatgctgatccttcagacatgcatgaattctagggggataccattcaaactactatagactcctttttaaatttttcctctcaaggacaatcattttgaattgtatcttctaataaactttacttactcaaaaataaataattcagttctacattttcattcatctaaaatatgtgtgacagttagaacttctaatcagcatgaggtaacccatcaccactctggtttattatcattccagccaaaagcaaagtgagatgaattaattagttattaggaacagctcacaaatgcccatttgcatcttcatagagctgtaagaatttggatccaaaatatgtaggctttattcatattgttacatcttgatttcatgagttataataaagcatttaggaatgcaaacaaaatatgagcagttatatgtgcgactatgcctgagatttactgcaaacatatatgtgcgtgtatatatatatatatatatatacatgtatatatacgtgtgtgtatatatatatatatatactctttctaaatttgaactaaagcaataaaaagagttaatgaacagcatcatatacttaaaatttttttgagtagctttggaaaatcgttccctcctctcccctgctctgtgactgggctacagaaacacctgttgcattgctagatattatgggaatatatgtcttcaatgctacaaaacattaaggaaccagggagcgctacatacttgtagattggctttggtttagacatgtccccaggatatatatagcacttacacactttgttgtaagcagaagtaattgattttccatataaatctacagcactgtaaaatgtaaaggatttgatcctatgattttaatgcctataagatacatggatttattgatttggctgtttaaaaaattggaaatttcagaatgctccatttgtatgttataaatattcaggtgtagatactcaaatttttttttacaatcttctatttgttagacaggtgttttttgtgtgtatgtgtttttttaatgagaataatgagacatctgcaataacaaagtaattcagagttataacaagaattgaaatcactgctatcaggtttattgtgagaacccacgtcaactaaattttaaaacgtttttaatttttgactgctcttcagggaaggttgtttgaattgaatttaagagttttcttgtgtttcatggtcaatatataataaacataataataaagatgcattgatagtttatggactgaaaaattgaaataatagcatagcaattttataacagggctaacattgggaaattgtgttgtttgaataatatgccatctcttactagaagttctaaaaattagaaatagaacataagaattacaaagcttgaggacacttagcattcaggatagaaacctgcagagataatcaactttcaacaactgaattttttacagctatgaaaagcattgctagttacaccgtactacccttacaataaaggtatacttagaagcatctaggacacacacacacacacacacacacacattgagattgaactttatgatcctgacaaacatagcaggaaacacagaattcgtctcatccaaactggttgggttttattttatttcatttatttatttattttatttatttattttttttgagatggagtttcactcttattgcccagactggagtgcaatggtgcaatctcggctcactgcaacctctgcctcccgggttcaagtgattctcctgcctcagcctcaccagtagctgggattacaggcatgcaccaccacacctggctaattttttgtatttttagtagagacgaggtttcgccattttggccaggctggtctcgaactcctgacctcaggtgatccgctctccttggcctcccaaagtgctgagattacaggcgtgagccaccgcacccggccatactgcttattttacagaagaaataactgaggtctggagggtggtatggctaaggtcctccactagttaaggagatgatcccaggtgaattgtgtgttgtctaactcctcattatgtgctcctttcactatgcgtgttgtcatctttagttcactttattgtgagtgattaaggctgttatataactttgtaaaagataattaacattaaaaacaatgtttaacatttacaacaataatacccatattattacttactgaactcaaatcattcactatgctaaaagctatatgtgtgttttccattttaatctttatgacagtttttatttatgtatccccattttatggatgagggcatggaagtaaacaaagaggcctggtttttcatggtcaaccagctaataagtaatggaatgaaaattcaaacctaatactgcctgaatagaaaacctatattcttacctcttaaactgtaaataatgtgtttctcaccgtaggcaatgcattcgtgattgtatcagtattaaaagggataggagaaaaacacaaggatggaaaaagatgtctattggacaataaaacttaaagattaccatacagtgggtagggcgcggtggctcatgcctgtaatcccagcactttgggaggccgaggcgggcggatcacgaggtcaagagatcgagaccatcctgtctaacacggtgaaaccctgtctctgctaaaaatacaaaaaaaaaaaaaaaaaaaaaaaagaaaaagaaaattagcctggtgtggtggtggcgggcgtctgtagtcccggctactcaggaggctgaggcaggagaatggcatgaatccgggaggtggggcttgcagtgagccgagattgcgccactgccctccagcctgggcgacagagccagactctgtctcaaaaaaaaaaaaaaaaaaaaaaagaaaaagaaaaagataaagattaccatacagctagaggagctgactaactctagaacatattaaataaaagctttcctggccaaattatttaaatttttaaaaatattcctattatcccagttcaggaactagatctaagataacagcttttcaaaatatacatacaaaaaaaaaagcttttaattggccggacgtggtaacttaagcctgaatcccagcattttgggagaccgaggagggcagatcaggaggtcaggagatcgagaaaccccgtctttactaaaaatacaaaaaattagccgggcgtcgtggcaggcgcctgtaatcccagctactcgggaggctgaggcgggagaatggcttgaaccggggaggcagagcttgcagtgagccgagattgtgccactgcagtccagcctgggcgacagagcaagacactgtctcaaaaaaaaaaaaaaaaagcttttaattacagactgccttctctttactccacctccaatgaaagagagagaggaagggaaagggaggggagaggagggaagggaaagggaggggaggggagggaagggaaagggaggggagggaagggaggagggagtggggagaggaagggaggagggagggaggagggaggaaggaagggaggaagaaaggaagggaagaaggaggaaagggaagaagggagggaaggaaagggtggaaaggaaggaaggaaaaaggaaggaagggagggaaggaaagaaagcaacattgaaagatcttctgatatcagctatcagagttggggcccccaaaaattgcttggtggtggttattgttggtataactctggaagataactcttttctctaatagggtatatttatttatttattattgttattattattattttgaagacagagtctcgctctgtggcccagggttgagtgcagcggcacgatctcgtctcactgcaacctccgcgtctcgggtacaagtgattctcccacctcagcctcctgaatagctgggattacagacgtgcgtcaccacgtcaggctaatttttgtatttttagtagaaacggagtttcaccatgttgaccaagctggtctggaactcccgacctcaagtgattcgcctgcctcggcctcccaaagtgctgggattacaggcttgagccaccgctcccggccgcatttctaagcaagagaacaaattaactcttcttgagactgaattttggatattactgatttcttagcttgatccactgtcaaaaataatagaatcatcaattttaacctccctacctgcctattattcaagtctgatgtagtgatcatagatagatatttcttccatgcctgcatagtgctttaaatttgttgctaatgtctctcttgggttctagcatagggcatgtgggcctttgaaggtgcccagcaagagacagaacagagtcaagattctttacccaaggatagtccaagctttaactaaaacaccataatacgttagcttaatttctctgagccttattcatgtctctaaaatgggaccaatcatgtattctgcgccaaaatcgcagggtatttgaaaaatcaagaaagtaacctggaaatcactgtgccaatgtcagttatcactacatctatgaaacgcttgattttataaatcacttttacaggcaatttttcatttgaccctcacaagaaacactataaagtggaagcatgtattattacttaatcacgttagataggaaatagctattaaaagagcctccagtacatctaaaattttcccaaacaaatcacagcatagaagcagggccacctgaaacctggaattctaaaggtaatgtccagactgcttctctgaaaagtcaaaatttctgcttctgctttatatcatgcacttacttgggtataaaaaaaggatcgcaagttaaattttcttgataaaggtttgataaaaaagttaccgaatttagaatccaaagtcttggataaacatgttttataggagaaacttaatttgtttttatcccactaggataaaactagtgcagtctatctgtaagtgatactatggtaaatcagattcagtgcaacctaaggaagaacttttctaaaaagcaaaacttgaaggtgagttatctccgttgctgaatttctcatccaacaaaagtattcctgctttatttacagggacactttgttagatattcagcattatatgagccatttgactagatattactgaagattttctttaataatgggattctatacatatctaaattttttttatacttaacctagcttttttaggtgtttgtagttagattccacagcccagcaaagttgaaggtgttttaaggataaaatataatacttcaaagacatttggcaggattttcagagtgacctgaggcactaatctctacaggatgctaaaacttccctgcagatgtaatagaaaggaagatatgaagagctcccctactgtatatggttggaagggatactctgataaatagtatagcctggccaggtgagatccctttggggaaatacttacaatacactagatggcctctaaactgctttctttttattattattataacttaagttctggaatacatgtgcaggaagtatagatttgttgcataggtatacacatgccgtggtggtttgctgcacccattaacccgtcatctacattaggtatttctcctaaagctatccctcccctagccccccactccctgacaggacctggtgtatgatgttcccctctctgtgtcaatgtgttctcattgttcaactcccacttatgagtgagaacatgtggtgtttggttttctcttcttgtgttagttcgctgaaaatgatggtttccagcttcatccatatccctgcaaaggacatgaacccatcctttttacggctgcatagtattccatggtgtatatatgccacattttctttatgcagtctatcattgatgggcatttgcattggttccaagtcttggctattgtgaatagtgctgcaataaacatacatgtgcatgtgtctttatagtagaatgatttataatcctttgggtatatacccagtaatgggatcgctgggtcaattggtatttctgattctagatccttgaggaatcgccacactgtcttccacaatggttgaactaatttacactcccaccaacagtgtaaaagcattcctatttctccacatcctctccagcatctgttgtttcctgactttttaatgatcaccattctaactgacatgagatggtatctcattgtggttttgattagcatttctctaatgaccagtgatgagctttttttttcatatattttttggccccaggaatgtcttcttttgtagtagtattgtctgttcatatccattgcccactttttgatgggattgtttgtttttttcttgtaaatttgtttaagttccttgtagattctggatattagccctttgtcagatggatagattaaaaaaatttttctcccattctgtaggttacctgttcactctgataatactttcttttgctgtgcagaagctctttagtttaattagctcccatttgtcaattttggcttttgttgccattgcttttggtgttttagtcatgaagtctttggccatgcctatgtcctaggttttcttctagggtttttatggttttaggtcttacatttaagtctttaatccatcttgagttaattttcatataaagtgtaaggaaggggtctagtttcagttttttgcatatggctagccagttttctcaacatcatttattaaatagggaatcctttccccattgcttgtttttctctagtttgtcaaagatcagatgattgtagatgtgtggtgttatttttgaggcctctgttctgttcctttgctctatatatctgttttggtaccagtaccatgctgttttgtttacggtagcttatagtatagattgaagtcaggtaggctgatgcctccagcttcgttgtttctgcttaggattatcttggctatgcaggctcttttttgaaaccatatgaaatttaaagaagtttttttttttctaattctgtgaagaaagtcgatggtagcttaacaggaatagcattgaatctataaattacttttggcagtatggttattttcatgatattgattcttcctatccatgagcatggaatgtttttccatttgtttgtgtcctttcttatttccttgagcaatggtttgtagttctccttgaagacacccttcacatcccttgtaagttgtattcctaggtattttattctctttgtagcaattgtgaatgggagttcacttatggttaggctattatcggtgtataggaatgcttgtgatttttgcacattgattttgtatcctgagactttgctgacattgcttaacagcttaaggaaatttggggctgagatgatggggttttctaaatatacaattaggtcatctgcaaacagagaccatttgacttcctttcttcctatctgaataccctttatttctttctcttgcctgattgccctggccagaatttccaatactattttgaatagggatggtgagagagggcatccttgtcttgtgccggctttcaaagggaatgcttccagcttttgcccatgcagtatattggctgtgtgtctgtcataagtagctcatattattttgagatacgttccatcaatacctagtttattgaaagtttttagcatgaagaggtgttggattttatcaaaggccttttctgcatctatggaggtaatcatgtaggttttgtctttgtgacaaaatatctcaaaatattgagataatcatatggttctgtttatgtgatggattatgtttattgatttgcatatgttgtaccagccttgcatctcagggatgaagccaacttgattatggtgaataagctttttgatatactgctggattcggtttgccagtattttattgaggattttcacattgatgttcatcagggatatcggcttgaaatttactttttttgttgtgtctctgtcaggtgttggtatcaggatgatgctggcctcataaaatgagttagagaggagtccctctttttctgttgtttggatggtttcagaaggaatggtgccagctcatcgttttacctgtggtagaattcggctataaatccatctggtcccaggctttttttggttggtaggctatttctgcatcaattccagaacttgctattgttctactcagggattcgacttcttcctggtttagtcttgcagcgggcagggggcatatgtgtccaggaatttatccatttcttctagattttctagtttatttgcatagaggtgtttatagtattctctgatggtagtttgtatttctgtgggatcagtggtgatctcccctgtatcatcttttattgtgtctatttgattattctctcttttcttctttatttgtctggctagtggtctattttgttaatcttttcaaacaatcacctcctggattcattgatttttttgaagggttttttgtgtctctatctccttcatttctgctctgatcttagttatttcttgtcttctgctagcttttgaatttgtttactcttgcttctctagttcttttcattgtgatattagggtgtcgatttgagatctttcctgctttctcctgtgggtatttagtgctataaatttccctccaaacactgctttagctgggtcccagagattgtagtatgttgtgtctttgttctcattggtttcaaagaacttatcaatatctgccttaatttctttatttacccagtaggcattcaggaccaggttgttcagtttccatgtagttgtgtggttttgagtgagtttcttaatcctcagttctaatttggttgcactgtggtctaagagactatttgttatgattttcattcttttgcctttcctgaggagtttttttacctccaattatgtggtcaattttagaataagtgcgatgtggtgctaagaagaatgtatattctgttgatttggggtggagagttctgtagatgtctgttaggtcctcttggtccagagccgagttcaagtcctgaatagccttcttaattttctgtctcattgatctgtctaatattgacagtgggtgttaaagtctctcactattattgagtgggagtcgaagtctctttgtaggtccctaagaacttgctttatgaatctgggtgctcctgtattgggtgcatatacatttaggatagttagctcttcttgtttcattgatcactttaccattatataatgcccttcttcgttgggtttttttttttttttttttgtgatctttgagaaaagcaaccccaagatacataatggtcagattcaccaaggttaaaatgaaagaaaagatgttaagggcagccagagaggaaggtcaagttatccacaaagggaagcccatcagactaatagcagatctctctgcagaaacactgcaagtccgataatagtgggggccaatattcaacattcttaaggaaaagaattggcaacccagaatttcatatccagccaaactaagtttcataagcaaagaagaaataaaagcctttacaaacaagcaaatgctgagagattttgtcaccaccaggcctgccttacaagagctcctgaaggaagcactaaatatggaaaggaaaaactggtactagccactgcaaaaacataccgaattgtaaagaccattgacaccatgaagaaactgcatcaactaatgggcaaaataaccagctagcatcatgatgacaggatcaaattcacacataataatattaacctttaatgtaagtaggctaaatgccccaattaaaatatacagactggcaaattggttaaagagtcaagacctattgatgtgctatattcaggagacccatctcacttgcagagacacacataggctcaaaataaagggctggaggaatatttaccgagaaaatggaaagaaagaagaaaaaaaagcaggggttgcaatcctaatctctgataaaacagactttaaagccacaaagatctaaattgctttctaatgataacttcaagttgttagcagactttgctttgcttaaaacaggtatatcagtcagattttcaccagagaaagaaagccagcaggaaatacatactaagaaaagtattgcaaggaattggtttaagtggttatgatggctggccaggcaattcaaaaatcactgggcaggccattaagaggggcaggctggagctctcaagctaagtccacagccatggcagggcagaagttctgcctcagggcagcctcagttctgcacttaaggtcttttatctgaatgaatctgggccatccaaatagattacggcaatatctcttagttaaagtcaactacatatggacttattcccatcgacaaaataccttcacagtaatacctcagttagtgttggattgaataactgggtgctgtagccacctaagttgatacatataactgaccatcacagaggatatttcaaatcaatcactggagacagtattgacatgattgtttattcattttaaagaaaaatgaagttaaacttctacataacgcaagagtacttttttttttttttttttttgagatggagtctcactctgtcacccaggctggagtgcagtggcatggtctctgctcactgcaagctctgcctcccgggtccatgccattctcctgcctcagcctcccgagtagctgggaccacaggcgcccaccaccactcccagctaattttttgtatctttagtagagacggggttccaccgtgttagccaggatggtctcgatctcctgactttgtgatccgcccgcctcggcctcccaaagtgctgggattacaggcatgagccaccgcgcccggccaagagtacatttttgatggattagaactttattttaaataagagcattatgaaagtcataagctgttatgagtaggtaaccatttcttctcagagttctctccctattaattttttaatttcccagaaaatctctgtaacccctctgcctctgtaatcaacaacagtgcctactaaatggtgaaaaagatgaacaaaattagatcaataccatgttaacaaatcaaagtgagcacgagcctacttaaggaatgacaaaggccttatgttggaagcatctctttgccatcttgttgatgtggttgaatgctgtatattaacctaatgttttctttatgttaagttttagttttagtggatttttcaagtattgttttgtgtgtgcatcttccctgcttcaggtactattgtgggccctatgaatatgcaattaaaacctgaataatattaataacaaagataagagcaccaatgatagtctcaatatatgtcttcatggagcttctagtctattttataaaattagaagcttctttagaggacagaaatttgtgttatagatattatgtaggtgaatttatcaaatggtctaatagtaccgtctattgaaggcaactgtttgttccttgacaataactaatcctttctaaccattatttaaaataccatctcctattagtagtaagtttgaattccccttactactaagtattcatcttcctatgcaaaaaatcttcaaatatgtaattttgtacatgagcgtaattacttttattatgcatttttttcttgacaccaaatatttgcactatttcagatgaatgggggataacagttacatttttatctttatcagcgttgtttaattccttgaggtttaaggacttgatcatttagtctgagtctcaaaaatgtcctatggtcttttcacaaatatcatttattttacaataatttatcatgttaatgagctactttcagctttttgtaagaggaaagtcacttacatcaaaaattttcatatatcagataaatgatccatgtggtctctctagtttacctatgttctctgtgcgttttgaaataagccctaatgtgatcattgtgcacaatattatgccaaaatcatcatagggattgattttctatatctcttgtgtggaagctaatgcaaaacaaaatattcttgaaagatggttttaagagacaaaagccctaatattttcttctgaagtgcattttctttggattcttgatttttggcctaaagaaaacataatcacagaccttgaatgaatgatggagacataaatttttagattgactgttcttgatttatagacgtggatcttctgaacagtaaggaaaaattatccatgtaatttttgattatttcttcatcatttatattttatattctgcatctgccctgaggctatttacatggacacatttttataaactggaaaaaaactcataagaatgtataaaaattaatttgatttcttgctatgatatttctacccttttagtcaaaataatcattaccacaacagtcacaaacaatgtaaagcatgtccactattgttacaattttgctgaagcttttggaaacccaggtaggaatacttggtgcatagtaactttcttcccccctgtggaaaattctttcataggactggagaaaggaagtcagtacagtttccaggtgtcagccatgacagtcaatggtactggaccaccttccaactggtatactgcagagactccagagaatgatctagatggtaagactttttcccagttactatcactctgattatcttcttgttatctcagcttcaaaaggtctcttaaaaaaggaatgaactccaactttggggacattgattcttactatatgttcacatgcaaaacacaacagggaaacattagtgaatacatagtcttcaacaatgccatgtaaataatgccagaccatgaatgacatagcattgattatgcaataatcatggtcctcaaaacaagttacttgttttcaagatcatctgaaataagatattttctatttattttattttgaataactgaccttaaccatttcgttcacaagaattagtgtaatttataatagtaatcatgaactataactatataatatagcttctcttgcttttttatgaggcttttgaaaaacatctatatgtatttttttacttgcttatgatattatcattaccttttcttggtataaaagacaacttactttatttgcttagctgatagttgtcctgaaacatttatcagtaggatattaggattcatataagatttatatattaataaattaaatataagcataatcctcaaaattagcaaatgagaaattgctctggaaataaaaacatcatgactaaatttttaaaataaaatttaaaatgaatgggtaatgaagtgacagaataaaacattaaataataaagcagaaatatatagaattagagttagaaatttaaaaggtaagaattcataaaaatgagaggtccttggaaaagaagtaagatatgataagtattcttaaatctaagtaatcaaaactagtgtcaattaaaggtagatgtaaagataaactcgtatgtattgaaaatgtgacagcacaagataattgcctattatatctaacaatgaaattctcttactccttaactgatacatctgaaattattccagtaaaaattgagagtaaaaactctatattcctttcttttcccttccgtttttaaatctctctttccatgtcttcctcactttaactcttttcctagttcttgtattactttctcatgtcatccttcctctttcttgaactcctccatctcattctctttctcctttgtcttcctctttttctctttttgaatacctcactatcattaatgatttttctatagccacaaatttggttttactaaaataattatggtagcattaaacaatcaacagttgatatttccataataatgttaatctctgccatgtgactgcatattaattcaaagaatgtttatagaagtcttactaagcatcaggcaccatgctgagctttgatacaataataactaagaaacacttggttcttttctcatggagcttggagaatagcaaagaaagacagacattttaggtgaagtataggaagttgccattgttgtagttaaaacctgattgggtacttgaaaactacagttcaacttaggatgggtggatggatggatggatggatggtggttggttggttggatggttggatggttggaaggttggaaggttggatagatggatggatggatagaccatcaggcaaacagacagacttgcatttaaattgagacctgaaggatgaataagaattaggtatgcaaaaatacattggcgattgaggggaaggaatagtgagtaaggtaaatgtggtttttaaagtcaagacaatgatgctgtttggggactgaaaaaggccatcaagaatgaaacacagagttggcatatgatgaagtttgtaagataagcaggttccaaatctgacaagacaaagttaagaattttaaacattgtctaaggatgtctaagtcaataacttactttgttttaagcaagtcctcaaaggttgatttaaaaaaatagtgaattaattagaattgcattttgtagagattactctggctgaagcatgcacacacaaaaaagtattctaagtaggcaaacccaggcaatgactttaagacaaccctagaggtaatataggagtttaaaaaaagtaacttgaggcttagagatattatttaacttgtcttaggttatataattgaaaagttgtggagctagaaaaagtcacatttcacagagttcatacccatcactaatagcttagaaaactttcattcatgtgtttattcaacttacatttcttattaaaggtctatatatgcaagatattaccttaggtactagagataaaacaataaataaagtctatacacccaaggagtataagttgtattcagatggaggtagatagtgataggtgctctgaagaagcatggtagaggggatagcaaggattagaaactactgctttatataaggaactgagaaaatctttctgtttagatgaaacatgaacccagactttaaggaagtgaaggggaagccatgcgaataggtcagactagagcccttcaagtagaagaaaaatcaagaacagtcatcctgaatagagcctaattggtgattgagatatatatggcaagaaggatgccaaagtcatgaggttataatttgtcttatgtaaaaaaatagaagagtggtcacaataaactatataaatagttatttttttctattttaacttatttacctaagaattaagcttcaaattttatagatttatgttttatcctttcatctacccttatgaagtatacattattagccttattttatgggagactaagttaagctatgaaaatttaactaacttaatcaagtagtcagctagcaactgtggagctcaaaattaggttttgaggccaaggcaggtggatcacttgaggtcaggagttcaagaccagcctggccaacatggtgaaaccccgtctctactaaaaatacaagaattagctgggcgtggtggtgcatacctgtaatccctgctactcaggaggctgaggcaggagaattgcttgaacccgggaggcagaggtagcagtgagccgagattgtgccactgcactccagcctgtgagacagagcaagcaagactccatctcaaaaaaaaaaaaaaaaaaaaaagttttatgctttgaggtccagtgtaggtgatcagagaaaagcctccactaatcctgtagaaatgacttgatgaccataaacacagtgattcaaggcaaacaaacgattctaagaagtgagatcacgttatttacccaaacctaaggggttatatctcttactggaaggagagaaaataaatgaagcagaggtgctgaaggtcttacaaaatatccagaatgaaacagacgctctacttgacttatgtgctctttttcctgactctgaatgagtcacaacttaagtagaaccaaaatataaagtcaccacttattagaagacacaaaatttttcatttaactccatgtttttcatatcaatgcagtctaactgtaatccaatttatacatctatttcaatcaagaatctctatgccatgctcatgagagtcttaataaatgcttttaattggatttgtttgaacttttctatgctcttggcttaataatggccctcttgtacatgcaacattccttctttttctttgggtatggttgtaattattacaaaatatggtttaagaatttaccgtgtgctgaatcatggggagtacaaacatgaaaacagcaagaacagctctattgagaaccagacagataatggctgcactgattagaaaagatttcataaaaacacgtagaacttgaactacaaacttcagagaaagggggttctgacagctaggattgtaaggaagtgtgtgtaggacagcatagaagacatttttcaaggaaatattgccttgagaaaatgatttctgccactattaattcaaaatgcatcctcactcatccaactgttactcccttaccagtcaattgtcaaaacatatttccacacaaatatcaacttttttctcattctcttatgttttcttatggatgagaattgcaaagacagtcttatcctttcctgtgatatacacataagcaatctgaaaaagataaataaaaaattaatagaagaaagacagtagaattgatacttcttgcacaaaatgctgttacacgttatgatttgagattgttcacatttagacataatgaaaactgaaagccatttcagagcatttaactgcataaatatgtgggatgtgtatgttttacttgctgtaaaaaattgataataccaaaggccttctcaatttattgatccatgatcactttcaactgtgatacttcctcaaagtgattttggtttcctttctttccttctggttttcttcttttgattgcaccattcatatattaaaaagtgtaacccttgatggaaattaatatttgaaggaatgaacaagatcaatagtggtcactggtaggtacaaaagaacattcaacctgctagtttgctctatttttaaaaagatttccttaaatattcatctcattttaatgtatttgtgtaaatgtttaaatcataaaataaggtataaatgacttgcaccaaaagtttcttggctaatgttggaaagctttgggtcctaaattttgagtcctaacactctgaagtgagaaatttccatatagaattgctttgatctcccaaaaattaaggataaggagaaaaagcaatcattttaaaccacatgaaatgggaggcattctttgctgtagctgaagatatctgtgttggaaggtaactgcatcattaggcctctctggatgcattatgttgtataacttacccccctgcttcagagcctgatggtgatcgccaagagaatgatctactcattactgcataactctgagccctgcaagtcagctaaacagaaacagtgctatttgcagattgttaaaggaaacccctgcctcctgtgacttctgtagttcctcttgccttctcaacttggcttaagcattgtgaagataactgtagcttggagaaataccccaagtcctcttggattgcccttttaattagatgttttgttaaagtaattataaaaccaaaccacattgtttgttcagcgttccctggaaagcacgttgctattactgacagctgggaagttttaaaatatttattttgtgcctcaaaatttcagcttaaaaaaaaaagcaaaccaagatcattagaattccctagggttttcatgtaaatgtcttgcataaagaaatgagagaatttgtgatagagtgatagagttcaacaaagtatccttcaagaaactgagcttggaaatctgtttatgatacttttgtttttggagtgaagaggtgaaaattgctatacgctatcaataatcatgtgatttaaaatcgactctctaccctgaagtggaggagtttagctatcaaaagtcggcagtgcagacttaagaaagtgcaacagtgatgcagcaaaaaaatgtgaatctaggagctggccctaatttcttgcccccaggaaataggtaatcagccttattaacccaaactggtaataaatgggttcgctgcaaattcatttcatttaagaattggggtaaggagtgcgatttacaccagtgagcaaaagaatgtgttcttctggtgatttcacttgatgctcatatgggatttggtgtgcacagaggagtgaaggtggcatgtcatagaatagattttctttcttgtacttttgatagggaccatttatgatattctgtgatttatgatatgctatgatttatgataattgacagataggcttggggaatttgatggaccagtggtacagtagctattccactgtgaaatttaagactcagccccttattaccattcaagtggatttcatcttacacataaggagcatagcaggcaaagcaaaaactgatttttaaaagcaatatggtatctgtttcagttccggtgcaagtggttgttcagaatctcaaagttccactgtacaaaggatggcacaggttgctttgacttagataaaagttcagtgaagttgcaagtattttacttggttataacaaactttaatgtgcccatggaatgtctgatccttctatgagttgcttgacttttttctaagtaccatgtaaaggatcaggtgggttttgcagtcttaatgactaggtttggatccagctccatttaccctatattcttgggcaaataactttcccatgccttggtttttctcatgtgtaaagagggcataacaacagtatccatcacagtgggtttttgtgagaattaactatgataatggcaacaaagtgctcaacagtgtgttgttcttctgatttttctggttttgatacataagaagatctcagactttgactgttgtgttgttgttgttgttgctgctgctgttttagacagaatctggctctgtcaccaaggctggagtgcaatggtgtgatctcggctcactgcaactttcacctctcgggttcaagtgattctcctgcctcagcctcctgagtagctatgattacaggcatccaccaccatgcttggctaatttttgtatttttagtagagacagggtttcaccacgtgggccaggctggtcttgaactcctgacctcaggtgatctgcctgcctcttgaactcctgacctcaggtgatctgcctgcctcagcctcccagagtgctgagattacaggcatgagccactgcacctggccatgactgcagttctttctgacagtaatatgaaatactcagaccattggttttatgaaacttctccttgttcatgatggtaaagctttgttgtctacatttagggaacagatgtatccatttctgttacaaaaggagagtgtacattcagtacatcttaaaagcccatcatctaattaaggtataatttaatggggcatcatataattatagcaatagattgaagagggcgttttgtggaattaggcagttttttaaaaaaatattataggaatataagcaagctttcaaaattgtattgtttttgcaaaaaactaaaacattatgccaaatggtaaaatactaaacacatttgttttaagatccaaacaagcttaaaaacttcctacaatttctgttattaaagaagatagaggttttggcaagaaaaactttaaaaattcataacattttattacaaaaggaaagaaatcttattattataaatggtgttattgaatatttgaatattacaagacactgcactaaaaacctattagagctaataagagaatttaataaggttgtatgtttcaaaaacatagcttttctttatagtagcaataattagtttaaacattgaaaagaaaggcatttataaagcaacctaaaatataatatctaggactaaatttaacaagatgtaaacaaatgtatatcataaaaaatacaacattttactaaaaactataaaagacatgagtaaatagcaagttacatatgttcctggatgaaaaaactgatcattattacattagttatttccaaatcaatgaataattttagacaattctaatcagagtaaattttaaatgattaaggattttctggggtggaaaaagaaatttatatggaagaataaatgtaaaagaatcccaagaaattttggaaaaggataataaaaacgtttactataaagcctgatttagaatcagcatagtactatctggcattggaatggacagataaatgtaacagaacatagaaacagcccctatctaggtatatttgagaaataaatataaaaataaagctagcttctcaagctgcagattagttactaaatagtgtgaaactattgccagtacttttagcagaacagaaaatgtttttcttctcttacatcaaactagttgacagtggttgattctggtgatggaactgaaggcaaaggagggtaaagtcatcacatcttatataattcaaaactggaaaggccccaggtggctgtaaggattttgtcatcattttttcttcaggtatttttaaatataacaaagatgggtgactcaaccacaagtctttttatacaattggaggttttgagctgatctttcaaagtatcatttcccttaagattgattgtattcttcactttgtgactagtaccaataatcacttgtcatccaagccaaaagcctccctatcaccctcaactccatttcactccctgtcaatatccattcaatcaccaagatctgtaatttctaccttcagaatggatttggaatccatcctcccttctccacacccaccaccacactttatgtcaggctcacatcatttgtcacctgaaagtagcctcaggtttgctatttttctggatacctgtttgctctccctcctctctagaccccatagtgttgtcagagtgattttttcagaaccagatatgacgatgtcagttcgctgctcagattcttctccatgtggtccttccctcagcctcaagtgtgacatcccatcctgcctgcctacctgcactgccctccaggttcacttcctcagctgcatcctggatcaagcctttggacttagcaagctctttacccaagtgtattttcacatatatttcacacctgcttgtcctttaaaactcactagatgttttacttctaggaagctttctcttatctgagtttcactcagatgtcttttctctaaacacattttgacactcttctcaatagacttgaaacaaagaccatgctttgtcttgaacttctcgatatttcacacagtgcctgctacatagtactcaataataagtggatgggtgaatgtaaaatattcatagctgggtatttgtgtgaaatgtgtaacacttacatagtttgattcttcactgattttcatccttacatacgaactctaatttcagataaatgagctagaaacatccattgctctctgttgtattttttcataaatgtagaatgcatcctattatgcttatatacaatatgaaaatgaaaaccctagctttctagaagacagcttggcataagattttagagttacaatggtgtttttgtttgtttgttctgagacaaaccaataggtctgtagttttgagagcatacggtttgaatccacttcaaggaaaatgagcctaaagaattcatttagcataccacttggcaaggactaagatctctgcctccccatacagaataaggtttacggtttgaatggccatggagattattcagtgtaaggtagctgatcaaatgcttcatggtagaatgatacaaagttctagtgaggttttgcaatagttgaagctggtatccttaaactctaaagtgagagaacaatccccagatattgaagggctggtgtctgcagctgctccttgaaagccacatcaagagtatttgctctaacagtcaggattaggttatctcagtatttcaggaagttggcagtgtttaaataaaaccaaacttcattgtattttctctgtattgtgttggacatgccaacctgctaccctaaatatgtatcttaactccctggtgattcttgtcaaatcaagaacttgatagacagagaccacgcttgtctaatttttgggccaaaaaagggctgaatcctatctgtaatctggaattgggattctgcagctttgctgagcaagagaaaatcaaggaagggaagaatcttgatggttttgttaggataaaccttgggcatggcattgagggtctcttccctaaaaaatactttacatttttccctctttttccttttgagttataaccaatgtgaggcaaaggcaagtgtacaaaggtgcagagaggatgtggattctggtgaattattttagcatctacgtttcttttcactaggagtaagcgtgttgatattgggaattggaggacatgggagaagaaagattctccatccttagatctaccagtttaattggcttagatttaggagacacatattttcagaattacaattcattgttgtggttttcaagaagtagagctgtcaaaactcccttttaagagtgttggctaggtattcatcgactcctgttagacttctacattctttttctatctaggcaaaaaaagtagctaaaaataaagtaaaatatgaaataataagattaggttgacacaaaactattaagataaatagaaaacacatattaaaagtaaacaaaaagacaaaatgcagttaaaaattacaaaacaatgttgaactgtaaaaacttgtggtagtaacaaaatttgtagaatagctaagagtacaaactatatgtgaaatgctacatgagcaaaaatttgttaaattgatgagtatgacacatgcataataggtctccataaagtttagtcattattaggaacaagaataaaacctatatggtttgaaaatttttaatgatacaaatcaataagtaaatattagtaggaataactgattttccattcatggaggggaaaatattaatgttcattattaaaattaataatgagagattgggggagggcttgactataaaggggcagcctaaggaaattttggcagtgatgggatttttctgtattatggcaggagtggtggataccaaaattttacccatttatcaaaacccatagagctattaccactaagtaaatgttgctgcatatatatttttaaaataaattaaaaatgaatattcccagcctgggcaacacagggagaccccatttctacaaaaattttcttttaaaaattagccaagtgtggtggtgcatgcctgtggtcctagctactcaggaggctgaggtgggaagatcacttgagtcctagaggtcagggctgtagtgagctagcattgcgctactgcgctccagcctgggtgacagagtgagaacctgtctcaaaaaaaaaaaaaaaggagaatattgacaaaatattagaaataggatggtaaaagaatacaaagtagagttcagtggtgaatagaagtggttgtccactatgataaatacacaaacagcctttaaagtttatagaggtgagcggcctaagggaagtgatgtcctttggtgagaacaggccctgtctatagaaatgaacacatttgtaagcatcagacatgcctggaaaggcagagtgtgggtatatcaattgccttatgtagtttgctgtaaagaaatataggctattgaggactagaacaaaactctaacaaaatgatccataaaatgcagcacgctaaatggaggacaaatgtgtgaatatttgtcaaaagttccaactgcctgacacaacttgacagtgccatctatagcaggcagtatgtggtggcgactgtttgcattaccaagatctggcacagacaaatcttgctgtcccctaagaggaaaacaaagtatccagtgtagagtagatggctggagtgaggtgaacgaaggcaaaatgacaggtgaagaaggtaggagataagtggagagagagagagatcatttatggccttttaggccattgtaaagaacatggcctacaatgtggtttgagaacaccttggggggttttgagcagagcaataacatgatcttaattgcagttttctatatacatgctcacactatatctgtattcatacacatttattttaaataccacatatatgctgatggcttccacatctgtgtatatctagccatgacctttcaccaaaatcccagacttacatacccaactacttccttgagatagccacaggtttgactaataggcatctcacattgaacatgacccaaggaaatctcacctgtgtttcctcatttcagttcatcaaccaacagttaccaagtcaaagacctatgggttatgattaaatctcccttttcctgcaccactcacatctactctatagctctgttaactacacattacaaatgtcctaaatctatccactttatatcatcttcacaacagccatctagacaagagcaaaagcaattttatggtctccatgtttcattctatgcttcctctccaaacttctttttcacccagaaaaatagagtgatctttcagtaatatcaatgagaccacacttcacacctccattcctgccagtcaagaccatttaagatcttctccttctacttagaataaaacctaacttcttacttatcttgacttgccttgcctatagtaacctggtctgtaagtgactcactcttttttttctgtttttgtaattgtttacaattatggaaaaatagacaaaaccttaaatttaccatcctaacaatctttaagtatacagttcagtggcattaagcacattcatgttgtcatgcagccatcaccaccacccatctccagaactcttttcatcttgcaaaagtgaagtgctgtacccattaaataataactgccaacctccccaacccccagcctctggcaaccaccattctcttttctgtctccatgaatttaacttccctgggtacctcataaaaggagatttacacagtttttgtcattttgtgattggcctatttcatttaccatatcattgccaaggctcctgcatcttgtagcgtgtctcaaaaattcaattgtttcctttttagaggccaaatactattccattatgtgtatataccacattttaaaaatgcatttatacattggtggaaactttgatttcttccaccttttggctattgtaaatgatgctgctatcaacatggatgtacaaatatttgtttgagtccctgctttcaattctttttgcatttatacttagatgaggaattgcaggatcatatgttaattctattttaaatttcttgagggacccttatatggtttctttatagcaggtatactattgtacattcctactggctgactctctttttatctttttcattctctctcttacccttgatgttccagatgtgatgatcctctttggtttctctgaataccaaactcatccctgcagtacagcatttgcagtagttgtttcctctccctacagagctcaccactctgatgtttgcttgactggccctttcaggtcatccaccttagactcaaatggggagaatttcctggatgggtcagttattgtcccatcagcatagcacttatcaagatctcacgattgtcttatttgtttattaggacttatgttttgtctttcctctcccaccactatatttttagtacctagaactacaactagtatataggagatgcatagtagttgttgaaatgtcacagggattaatataatacatgaccgagtatgctgcatgtgaacattacacattagtggaaacctgtgtaacatgtctgcattcatgttacagagaataacacgtctacatatattacatatgttacaaagaataacatgcctacatacatgttacagaaaataacatgttctttagaaccaaactataccaagagagaatccataattcaataatataatcaagagtggcaattgacctagttatttgatcattcagactctagtaaaaatttggggccttgtattagtctgttttcatgctgctgataaagacatacccgagacagggcaatttacagaagcaagaggtttaatggactcacagctccacatagctggggaggtctcacaatcacggcagaaggtgaaaggcacatctcacatggcggcagacaagagaagagaacttgtgcagggaaagtcccctttataaaaccatcagatctcaagagacttactcattatcacgataatagcacaggaaagaccgcccctgtgagttaattacctcccaacgggtacctcccacaacacgtaggaattgtgacacctacaattcaagatgagatttgggtgggaacacaaccaaaccatatcaggcttcattaatttaaatatttcaggcaaaatgtgctctttggtttcaaattaactcaataactactctactattcctctgtgcttcatatgtgcaagcagcatcttagagatacttgtaaaatgtttcatgtacttctgagcagcaaatttcagttgcagactccaagcaagtaatagtcatattatatatcttccacagcaaattttctaaattgatgttttatagttcattccagtagtaaccactttcctaatccataaggtcatctatgttagagaaaaatcactcaggtagcataaaaggaaaattgttatttctgcctttgtattaagaagtgagtgggcataaattggctatcatggattatgaacaatctcctggcgtagttatcatgatgatgaggccatatattatgaatggcttaggtctaatactaccttgaaggaactgtccttttggtcctgtgagcttaatttggtgataaagggtcattaaggctgggcatgtagactcacatcgataattccaacactttaggaggccaaggcaggtggactgcttgagtccaggagttcaagaccagcctgaacaacatagcaaaactctgtctctacaaaaacataaaaataaaataagtagatagataaatacattagctgggcgtggtggcacatgcctgtagtcccagctactagggaggttgaggtgggaggttggcttgagtcagagggttagaggctgcaatgagctttgatctcaccactgcaatccagcctgggagatagaacaagatcttgtctctctctctcaaacacacaaaactaattaggatttagatgaagaggcaacatatcttcttacgtactaacattttttttctaatgttaaaaattattttgaggcttgcctctaggattgaaacattttcatgcagtgaaggataaagtggagtcttacgttcttcaagagccagttggtgtacacattacaatgatatgtttaaagctccgatgaataaaattgtgtagttactaacttaaccaatttgcaagagaactattctatggtttgcagaaatattaagaaatagttactgttctgaaaacatttttaacagttgaacagtttttccttttattctaaaagatgttaaatattgtcattaaaatcattatgatttcatattgcttttaaaaagtcataaatgcagaagatctagtttattttcttagtgtacgattaggcagattatcttgttgttttaatagttagtgcaaacacttcaaatatgctaaacagaactgactgagagtccattacatttcaagggcactggtgagactgtggcagtagggttgaaaactattaatccatccttttcatctcttttattacttttacttagagtttatattaggaaatatttcacaaacattgtgtttctgctgttaaggcttatatccacgttttgagacataatttttttatgatgtctttgcatattatatcataggcttttttagggcagactaataatagctttccctttttgcccacaaagggccatctttgggggaaaaaaaagcatctttagaaaattctgtcgatgtggcaactttagaatcttttgaaaagctttagaatcttttgaaaatgttacctattttgaaaactttaataagaacatgcttctatctatcacttaagctagaagtgggaatgctgcatatggataaaagtggagggggctgtgccagtttttggtactacattaaggagaaaaatgtaatattacctctagtcatcagatttccttgcataatttggcatatgttaccttcagagattttctaaatcactggacacagacatttctggaacataaataatgaacagaatcactttaataaaattcaaatcactgatatttttgagtacttattaattgccaagaactgtgttaagcacttattgaagtttggatgggcacattctttcttacatatctttgcataatacttccctgattttcaaagaataggttacatgtgcttgtatttagccaatcaaaatatttaccataatctatcgtagctgcctttttacttgcctgtttctcattagactataaactccaatagtgcaggtttaatgtctgccatatttgttcttcctgtatcctgaacattacaggcacctaggctcacacctcaaacataatagttgttgtataaatatttattaattggctgggcacgatggctcaagcctgtaatcccagaactttgggaggccaaggcaggtggatcacgaggtcagaagttcaagataatcctggccaagatggtgaaaccccgtctctactaaaaatacaaaaattagccaaatgtggtggcaggcacctgtaatctcagccacttgggaggctgaggcagagaattgcttgaacccaggaggcggaggttgcagtgagccgagatcgtgccactgcactctagcctgggcgacagagtgagactccgtctcaacaaataaataaatattaattgaataatgatcagtgtccagaaaaaaatatttttttaagactaggaaacagcgaagaatgacaacataaaaatcagaacaatttattattaaaacatattaattttcaacacacaatccctttaaaagaaaatatatgtcagggtggcatgcacattctctttttaatatctagcaatatttgagaatttatttgctactcataatgggtaagtttgcatgaattatctcattaaatcttttcaacaccataccttcattctacaggtagggaactgaggcttagagaggataaatgatatctcaaaatctcacagacagtgagtatacaatacaagtttgaactctgctctttcttacttcccgagctcaagctttgagtcaatcaatatttggaatgccaacttaatcagaagggaaactcagagaagtgaaataatttcatgaggacacagagctggtaaatgacagaacgtggcattaaaccaaatttgcacaggtccaaaggttgtgaggctttaatccaggccactgtcttctttcttttaataataaatgcatttttcactgatttaataaaccatgaatcaagtaccatcctaatcatgctggacagatcatggcccttaactgtttctcctgacaattacataagaaaggactggttagtttgttattgtttttagctaaatcagagtaaataattattggataagacaacattgacattttattttccagtctattattcttacatctgccttggttttcacccttcattaatgatacctaagaagagatatgtaaaaagaaaaaaagcccaagtaagacgctattggaataaagatgcattgatgctacctaccatgcccatggaaagaactcggtattcttgtatgcttaagaaattttgtgaaagtcaaatcaaacatagaaaatatatcatatgctaaaataaagagtgacttgggcaataggtgatgcattatttatgcatctatgaaatatgatttctcttgcttaaatggtgttctgccgtgctacattttctgttatgagacatgctgatgatgcctctttttgaatgctagaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttaggtgagtatctgtgattttttttattctattaaggggaattaatgatttattttgaattattgtatttcttggaaaactgttccctggtatgatggtttcaacttacagcatgtattagctctgaaagcaactgtctatctacacacacacacacacacacacacacacatacacacacacacaggcacacatatacatttctttgaatttgggatttcaggaatttgatctagagagatctgtaatggcagttgctctggtgtgtgcccttgcttatgggttataggatacaaaaagtgcgttgggccatttttctttttccagtggtcaatggaaacttctgatcctaataatttctataaaaagaaagtcaacacatttttcatctttgttgttgtcactgggaaaatgttctgttaatttttctttaaccttgaaatatctagtcatagtgccttctttaccgttaacattccaaatatgaatgttaaaggctgtgtcattatgactgcaaaagaagatgaaagaaggaattttcagtcaagacaatacattagaatgataaaactccatcctgcatgtttccctgcccctaccaatctaggttctcttattgtactcaactcaacctcattttttactgaatacaatacttcagttgtgatattctgaattcattgaaaacgtgttcattcagagaggtctaatgtgtgtaaaagtgttcatattcattttagatctgatttcccatagtgctgtaggagtttgtattattaacacagagaaataaagtaaatataatatatcaggatgccagtaagttaaacaattttcataaagcaaaatgtaagttgattctacctgttgatttaataccgtattacatgaccccactggaaatgcagcttgattgggcaggcagggtgtagggggtggggggatctgctacttatttgcagtgtctctcacaaacagaacatttgtgatgagaagcctgatttgaatttgaatagctaaaatgcagtagcaagaaaagattttctcagtaaaggaagaaaattgcactgacccattctctctataattgcttcaaacactaataagagaaacacctactggaaatctccacaatttatttagcttggcgtttagaaataatattctttccatcagttcctgagtttgaatgtaaaggcaatcacaaaactcatattttatggctatcaagcctatgtcaagggactctcacttatccattattcagcatccaccatctttgacagttcatcttgatgccactcaacagacagagggagggaggtgcccatggcagtaaatggctcccaggcaatgagaatgtgctgcaaactcagaaggaagtcaggagggaaactgcattgttgaccctatcctttttctaatgattctcttcgttaccaaaaaaaacttgccagaggtctccaaatttagtcaagttgacgcatttgggagattaacgttggcaaatctccccaaatgcttaacaagaaaaacagaaaactctggaaaatatattctaaagagctaggaatatttttaaaggtaaattgggatatgaacctgtctcagtaataattatgagtttgcactctacaacttacctggaaagagtaattacatacacacatagataggtatgtaagttctactagttgatactcttttaacatagtctcatgtgttaatatgaaatacagtaattagcatgttgttgttcattaaatatcctcatggttatgcaaatgaactgctatttttccaatatgtgttttcactatttagccaaagtgtgtgtgagagacataccctaagctctaatctttataaagataaggatttattcaagtccacgttcatgctgcaaataaatcaccaattgttttatttattctattgagcattaaaatcaacacatcagtttccatagtaactttttgagaaggtatttataactttttttaatttttaaagtttttggaaggcaaagctctctagtcattacatatacataataaagaaaatgaaattttatgttttaaggactgtatgacagttatacaactaaaagtgaattaaagtaagtttaattcatttaagcatagggtcagccataacttcaagtatcatggttgtatattaaactataaaaaagctatttgttttataattgactaataaaccccttcatctatttcatgagagagcaagacttctaaacagcattttatttgcagtttagacaccagacactgtgatcagcttcaggactggaaatacaagaacattttgagtaatatctaatattacctaattaaaagcaaacaaacaacttgcctgctataggcatagagcttcattaatcaatgactattaaatatttataattaatctattgacattttactccttttagttcaagagccctagtgccagacttgaagtatgatatagacccaaaattaatttgaaaccaaaccacttttaaaactcactatctacctaccaattgatctatttatctatcaatttatctatctttatatctttattcagatattatttatatacagtacattgtgtacattaaaagtgtactttttggcatttttaaaagagcattattgaggtataatatttgtttaataaagtatatctttataatttctctaatttatctcagtaatattttatagtttcaaatgtaaaggtcttcaatgtttatgttaaacttattcctaaatacatatgtatatgtaggaatatacatatattagaaatacccaaatatatatatatatatatggatataaatacatatatatttggatatatatatttgaatatatgaacatatatttaggactgtttaaattatgcatatatatttgaatattcctaaatatatatacatatgtatattatatatatttgaattattttaaatagaactgtttttaaaatttattttaaataaatttttactatagtggatttatagatgtattatataatgtatatatagatgtattgtggtatttataaatgtgtagaatacaagagattttttaatgctaaccttgtatcctaatatctgctaaatttacctatatattccattagttttttagattatctaaaattttctgtttaatcaaacatatctatgtgaacagaaagttttatatttagtttctgatctctgtcccttttatttctttctgttgccttatttcagtgattaggatctgtagtaaaatactggataaaagtgctgaaagcaggtatctttcctttgtgtctgatcttaggagaaaaaaatttagtctttaccatgaaataggttattacctctggtctctttaagccttttgtgagattaaagaaatgctatactctttctagttttctagaaattctggtcatgaatatttgttgaattttattagataactttctatcttttgaaatgaactttttttttctttttttaaaatacggtgaattacattgattgatttttgaagggtaaccaaccttgaatttcctatataaatcctgtgtggccatcatgtattatccttttcttatgttgtttaatttgatttgttaatgcttattaaggattttttgtgcctatattcagtaggttatatatttgtctacaattttcttttcctatagtgtctatatactgtttctcttttactccagttagattggctcataaaatgagctggatagtatttactccccttctgttacagaaaatttgtgtaaaatggattttatttatttcttaagtattttatagatttcactaatgaaatcatctggacctgagattttttttataggaaggctttgataatagatttaattttttatacagatataggtctgatttgcaaactttcttgtattgattttgctaagttaaatttttaataaaatccatccatttcattttgtctcttgttggcacagttattcataatgttttctttatctgttatctatggttattaactgatttttcatttctcatattggtcttttcttgttcctgtcttttttttgtgatatctagacagagatttactaattttgttgatcttgtcaaagaaagagcctttgacattactaacttttctattatctatctattttatttctttcatttctactgttatcttgactacttccctcctgatacttattttagttctggtcttctcttctatttctaatttattgacatatgaactttataatgtatacatccattgttgttcctctaggtatcattttacttgcattccacaaattttgatatgttgtatttttattaccatttagttcaaagcatttcctaattttcctgtgatgtgttattctccctaagttatttagcaaggtgttacttaattttcaaattttgggattttcctagttatcttgttattattggttttcttttctttcttttcgtttttcttttttttttttttttttttgagccacagtctcactttgttgcccaggctggagtgcagtggtgtgatcttggctcacttctacctctgcctcccaggttcaagcaatctcctgcctcagcttcccaagtagctgggattacaagcgtgcgccatcgtgcctggctaatttttgtatttttagtggagacggggttgcacaatcttgtccatgctggtcttgaactcctgatgtcatgatccatccacctcagcctctcaagtgctgggactgcaggtatgaaccaccacacccagcctaaatttgagttattaatagcactttagcaatatgtctgatattgcatattgcagtaagattatattgcatattgcagtgaggttgcagtgagccaagatcttgcctttgcactccagcctgggtgacagagcaagactctgtcttggaaaaaaaaaaaaaaggaaagaaaagaaaagaaatatgtcttataagagatcagctgactttttctataatggaccagagactaaatactttaggcttcacagaccatataatagtctctgtcaccactcctcaactctgctattagagcatgaaagcagccaaagacaatacatacacaaataaacatagctgtgtcctaataaaactttatttgtggacccaagaatccataatttaatataatttttatatattataaacttttatatgttataaaattctgtcttttttaattttagcaactatttaaatatataaaaaccattattaactcatggtctatacaaaaacagtggcccctcaactataatttactgattcctgctcttagtgattgctctaggagataccatatatgtatttaatctttcccactttatttaggctaacattgtagcacatcatataaaacatagaaacctgcaactgcacaggtctctttatcatatggactattccttttgttgtaattgtcatatgtattacatgtacatgcattgaaaatcccattagacagtcttatatatttattgtattatgcagtcatgattttttttaagacataaggggaaactatgatgttttctatttacccagatatatgacatttcttatgcttttcatttgtacctgaagatgaagttcttatccaatgttatttccctttagattgaaaatcttcctttaccatttctttgtagttcagtcaggtggcaacaacttttcttcgttttgctttatctgaaaatatcttaattctactttttttttctgaaggatattttcactggatatagaattccgcattgacagattttttttttctttcctccagttctttcaagttgttgtctctctgtattcttgactctatggtttttgatgaaaaaccattagagttttagaccattgcaatttaatgtaattatacatatggttgaattttatttttgtttactgtttgtcagattgcttttttgtgtccctgttttccctttcctgacttcttttggattatttgaatttttttgttttaagttttattattattattattttttcctgagatgacatgtggttctgttggccaggttggagtacagtggagctctcatggctcactgcagccttgacctcccaggctcaagtaatcctgctgcctcagcctcctaagtagctaggaaaacaggcatgtgtcaacatgacattcaaaatgttgttaacctgtagtaatatatacttttttatttttttgctgggtgcttttaagacttctttaaaatatttgatttccagcagctagattatattatatagaggcatagtcattttttactatatcttgcctgtgtgttttatgcttattaaatctgtaaatttatgatttcaccaattttggtcattttgtcttcaaatatttttccccactattcaccacattccctctgagactataattatatgtattttagacatttgaattttatcttatacattctcacaactgtgatgttttctttcgttttttaacctttttactcttttcttgatattgagtgatttatcctgttctattatcatgcttactgataaattccttcattacctctatctcattgttaggctcatatggtaaaggtcattatattttaaaacattgtcctctttttaatattacaatctccatttttttctacattttctactactctgttgagattttctatactccttgcaagtatactttacctctgagagcatagttataaaagttactttagcatgtttctctgataatttcaacatctgcaccatttgggttgggcatctatttgctttttcacttgagaatggactatatttaccatttttttggtatgttgtataattttagactatatgttaggcattgtcaatgttaagttgtagaatctgagttttattacaatccttgaaaattttttgatatattggttttagaaggcaatcaacagttagattcagattgtgagatctatcttgctttctcttcacagcaattaaaatcttggttaagtttcccaaggctttgctctgctgttagtgtttaggctgagacttaggcaagttttaactcagaatcagaacatctctatctccagaactcctttttgtatactttttgtaaactgtttccctcatcccctgaaactactttcagtgattcttctggcacaaagtggtgagggtttctactggagtgacagctgacagtactggggtgctttccatactgcaaaattttcttggagcaaaacagaaaactaattccaacgctggtcgcttcatcaagatcttacttaattccaaaatccgcctagttttgtaaaatactcagacctcatatagttgggattttggtttttggggggattgttttgtatcttgtttagagccagtggctgttatcagtgagatggatgagccaaaaagagcttacaccatcagagaataattggaaactcacagtcccattttaaatatttttgggcagctgttattgtgaacattcttgataaaaataagatgacttcctgggcagtgtatttaacatctgaattacatttggcactatcgcacttatttactaacaacatgtgttagaggaactaaaaatgactctgaaatatataacttagttgctatattagtctgttttcatgctgctaataaagacatacttgagactgtgcaatttacaaaagaaagaggtttaattggacttacagttccatgtggctggggaagcatcacaattatggcagaaggcaaggagaagcaagtcacatcttacatagagggcaacaggcaaaaagagagcttgtgcagagaaacgcccctttaaaaaaccatgagatctcatgaggctcattcactatcataagaacagtgcaggaaagacctgttcctataattcagccacctcccactagattcctcctacaacatgtgagaattgttggagttacaattcaagatgagatttgggtggggacacagcgaaaccatatcattctgcccctggcccctcccaaatcatatgtcctcacatttcaaaaccaaacatgccttcccagcagtcccccaaagtcttatttcagcattaactcaaaagtccacagtccaatgtctcatctgacacgaaggaagtccctttcgcctatgatcctgtaaaatcaaaaccaagttaattatttcctagatacaatgcagggacagacatcgggtaaatacagccattccaaatgggagaaattggccaaaacaaagggctataggccccatgaaagtccaaagtccagagggacagtcaaatcttaaagctccaaaatgatctcctttgactccatgtctcatatccaggtcacactgatgcaagacgtgggttcccatcttcttgggaagctccactcctgtggttttgcagggcacagcctccctcctggctgcttttataggctggcattgagtgtctgtggcttttccaaatgcacactacaagctgtcagtggatctagcattctggggtctggaggacagtggccctcttctgatagctccactaggcagtgccccagtagggactctgtatgggggctctgatcccacattttccttctgcactgccctagcagaggttctccactgccagaaacttctgcctggacatccaggttcccaaaccccaattcttgacttctgtgcactggcaggctcaacactacatggaagctgccaagacttgaggcttacacccactgaaaccatggccctatctctacattggcacctttcagtcatggcaggagtggctggaacacaaggcaccaagtccctaggctgtacacagcacagggaccctgggcccagcccacagaaccactttttcctctgaggcatccaggcctgtcatgggaggggctgcactgaagacctctgaccagccctggagacattttctccattgtgttggtgattaatatttggctccttgttacttatgcaactttctgcagctggtttgaatttctcctcagaaaaatcggattttctttgctatcacattgtctggctgcaaattttgcaaacttttatgctttggttcccttataaaactggatgcctttaatggcaccaaagtcacctcttgaatgctttgctgctgagaaatttattccgctagataccccaaatcatctccctcaagttgaaagttccacagatctctagggcaggggcagatgccaccagtctctttgccaaaatataacaagagtcacctttgctccagttcccaacaagttcctcatttccatctgagaccacctcagcctggactttattgttcatatcgctatcagccttttgggcaaagccattcaacaagtctctaggaagttccaaacgtttccacattgtcctatcttcttctgagccctccacactgtttcaacctctgcctgttacccagttccgaagtcacttcccacattttcaggtatcttttcagcaacctccaactcctggtaccaatttactatgttagtctattttcacactgcttgtaagacatacccaagactgggcaatttacaaaagaaaggggtttaattggacttacagttccatgtggctggggaaacctcacaatcatagctgaaggcaaggaagagcaaatcacaacctacatgactggcagcaggccaaaagagagcttgtgcatagaaactcccttttttaaaaccatcaaatctcatgagactcattcactatcacgagagcaatgcaggaaagtcctgcccccttaattcaatcaccacaaaccaggttcctcccatgacgtgggaattgtgggagttacaagtcaagatgagatttgggcggggacacagccaaaccatgtcagttgcaaaaatagaattttaaagcaatcttctcactaaagttgaacttctgactagtaattttaaaaaactgaatttggcttaggcagttaaataatcattttataaagtatagtgttcaacttcttaaacaatggaaaagataaaaagtaacataaaatacatttacaattcatgagaatcagaaaaaaaacagattatatataaatatacagacacagccattgtttttccaactgatattaaacaaacatggcaaatattcctgtgaggatttatgttcttccaattctaattagtccatgtaaaactatcatgtcttaaggaaaatgaatcgaactcgttcaccgccattgatgtggattaacaaagatgtatcgggaattaagttcttagaatttagcattgccatagaaaggaagactatacaattaaaacttttagggttttacatctgttactcctgaaatattttaaccatagtacataaataacataggttatttccatgaatactcaattgtaatttccttttattcttatcatcctttcagtgatgcttactagaagacattgtcttagtagactagcaatttaaaaacataagctaagcatacaaaaaagtaaataaatatggaattaagtggaactcttaatctgagtgtagatccatattttttgcctctccataatgtttaatactggaaaagttttttgagctctggctttgtaatagctcagtaaaaatagaaaacaaaagatgcttttagtccctgtatcatggtatcagagggttaacagattttgaaaaaagtcactagaagttggaaagttggtaattcaagagctgtaaatgtcaaactttatattgtggtcattgcaataatatgaaaatttaattagtattaatttaaaaatctaaaccacacagtgatgctcagtttgatgtgaaagacaaaaacagaaattcctagttttaactataatattctgattagaaaatcttgactgacagaattacattcattcaacatgagtactacttgctcagagagaagtgagcggggataagaaaaggtcactccatgagatcattactcagagtatatcaggaagaatggattttctcttttatgatttttttttgagatgagtgtcttctaaacctatagctgttttcaagaagtctttaaggatagccacagggtgattcattaataatacatactattctatttgtaactgttttcttactttctactccctgaggtccaaagcacaggaattgtcttatacctggtgaattttctaaagctatttggaaaaactccattacaaaagatactagtattgtatattagcattgaacaggagaagaaaagatcttctcattgagtacagtatatatatatatatatatatatacactgtatatatatatacagtgtatatatatatacacagtatatatatatactgtatatatatatacagtatatatatatacagtgtatatatatatatatacacactgtgtatatatatatacagtgtatatatatatatacacagtgtgtatatatatatatatatatatatagtgtgtatatatatatatatataattggaatatatgtgtcattggaaatctccaaatagaggtgtcttcatcattttccttttgttaaaataacactttcacattttattttgtattttataatctgagttgttatttgtaaaacaaaccggtgaagtattatgtaggtcattcattctaccaacattaaattcaagcattcaaagaataaaaataattttcttcatcatctctgtttttcaagaaaatgttttatctgagtcagaatagcttagatctcattcttaattcctcacgtcagtgtttacagacagcaacttgctgtgtttcttctaagcacttcagaaataacaaatctatttcttcatccccctcactatgtcaggtattatcccaattttaaaaattaggtaagacagagaaataactaagtaaataggaaaagcccaagctattttgttaaattttttcaaagttaaatgttactttaacaccatcagataaatattgtaataaacagtaaagacttgactcattagtataaagaaaggagcctggtatcaaatcaaaatctgatcagaacttgcagatagagcactctattgcaggaaaatccctctttctatagggaaaaacaaggtattttagcaaaattaaatatcttcaattcaccaacaaaataatataatccagctacataggacacagcctaaagtttctgattaaatacaagtgatagattcagtacaagtgccagagtttaatcatagaggtatttattatttgttctgtgagctggattcatagccaacttggaggaaagagacagaaaagcaaatgctgtatctgggcattttcctttattaaacaattgatttgtgtgtttttccttttaattctatcagatgcataattatttaggattgttatgtcttgttgatgaatactttatcatttatgaactatcccttttcactagtgatactattgtttactctgaaatctattttgatgttagtgcatccactccagactatacatttttggcttttgttagcattatacatatcatgctataatgggtacatatattcattattttactttaaaactatgtgtgtttttataattacagtgggttttttgttggcagcacacacttggagttttcatcatatccaatctgtcaatctctgacttttaatcaaagtgtttagaccatttacatttaatgtgaatatagatctggtttagtttataactgctatcctgctattcatgttttatgtatttcatctgttgtcccacctttgtatatgtgtatgtgtgtgtgaatttttttctaagtttctgcatttttatttaatatttttaatcattcatcttacactctttctggactcattagctataactgttttgcttcttcagtggttgctttaaaatttatattatatatcttgaccttaccattattgaccttaagtaaatactataccacttaataatacatggttgttattacatttaaagtggggtggtttgaaagagttttattagagtggagaaaataatatgtgagttcgagactggcctgaccaacatggagaaatctcgtttctactaaaaatacaaaattagccagatgtggtgacacatgcctgtaatctcagctactcaggaggctgaggcaggaatcacttgaacccagaggcagaggttgcagtaagccgagatcacgccattgcactccagcatgggcaacaagagtgaaactccacttgagaggaaaaaaaaaaaaaggtatttgataaaatataggagccaattctatttttttaaaaaaactataaaacccaccaacgttatattcaacaagaaaatgctaaagctatttcattaaaacctgagctaagacaaaaatagataaataaatatcctttaaaggttaaaaaaataacgtattgtctaactacacagttagcaattttggtgctcttcagtccttcttgttattttagatatttaactggtgtcatttttttttacatcttgaaggacttctttaatgttaaatatttcttgtaacatcattgtgctggtgattaattttccatctttgttatgtgtgaaaaagttttaagtttgctattaaaacttattttcactggtcatagaattctaggttgataaattattttctttctgtatttttaaggatgttccaccattatttcatatattaccttgtttccaacaaaactattgcacttgttctttttttttatttttattatactttaagttctagggtacatgtgcacaacgtgcaggtttgttacatatgtatacatgtgccatgttggtgtgctgcacccattaacttgtcatttacattacgtatctctcctaatgctatccctcccccgacctcacgacaggccccggtgtgtgatgttccccttcctgtgtccaagtgttctcgttgttcaattcccacctatgagtgagaacatgcggtgtttggttttctgtccttgcgatagtttgctgagaatgatggtttccagtttcatccatgtccctacaaaggacatgaactcacccttttttatggctgcatagtatcccatggtgtatatgtgccacattttcttaatccattctatcattgatggacatttgggttggttccaagtctttgctattgtgaatagtgccataataaacatacgtgtgcatgtgtctttatagcagcatgctttataatcctttgggtatatacccagtaatgggatggctgagtcaaatggtatttctagttctagatccctgaggaatcgccacactgtcttccacaatggttgaactcatttacagtcccaccaacagtgtaaaagtgttcctatttctccacatcctctccagcatctgttgtttcctgactttttaatgctcgccattctaactggtgtgagatggtatctcattgtggttttgatttgcatttctctgatggccagtgatgatgagcatttcttcatgtgtctgttggctgcataaatgtcttcttttgagaagtgtctgttcatatccttcgcccactttttgatgggcttctttgtttttttcttgtaaatttaagttctttgtacattctggatattagcccttttcagatgagtagattgcaaaaattttctcccattctgtaggttgcctgttcactctgatggtagtttcttttgctgtgcagaagctctttagtttaattagattccatttgtcaattttggcttttgttgccaatggggttttctaactaaaacttttggtgttttagacatgaagtccttgcccatgcctatgtcctgaatggtattgcctaggttttcttctaggtttttatggttttaggtctaatatttaagtctttaatccatcttgaattaatttttgtataaggtgtaaggaagggatccggtttcagctttctacatatggctagccagttttcccagcaccatttattaaatagggaatcctttccccatttcttgtttttgtcaggtttgtctaagatcagatggttgtagatgtgtggtattatttctgagggctctgttctgttccattgatctatatctctgttttggtaccagtaccaggctgttttggttactgtaggcttgtagtatagtttgaagtcaggtagcatgatgcttccagctttgttcttttggcttaggattgacttggcaatgcgggctcttttttggttccatatgaaccttaaagtaggtttttccaattcttgaaaaaagtcattggtagcttgatggagatggcattgaatctataaattaccttgggcagtatgaccattttcaggatattgattcttcctatccatgagcatggaacgttcttccatttgtttgtgtcctcttttattttgctgagcagtggtttgtagttctccttgaagaggtccttcacatcccttgtaagttgtattcctaggtatttcattctctttgaagcaattgtgaatgggagttcactcatgatttggttctctgtctgttattagtgtataagaatgctcgcgatttttgcacgttgattttgtatcctgagactttgctgaagttgcttatcagcttaaggagatttggggctgagacaatggggttttctaactataaaatcatgtcatctgtgaacagggacagtttgacttcctcttttcctaattgaataccctttatttctttctcctgcctggcactcgttcttatttttgtaccactgcctctgcacataatatgatttttatttctcactgctttgaagaattatgtccttgtcatggattttatacaattttatttttatatactggtatagttttcattatgcttcttctgattgggaattgttgagatacttcatcaaatttaggagttttcagttattatttcttcacatagtttttctttctcccaatatcactgttctcaactcagaactgcaattaaacagataccttattttattttattcacttatttatttttttgagacagggtctcactctgtcacccaggctggagtgcggtggtgtgatcatggctcactgcagcctcaaattcctgggctcaagcaattctgctgccttagcttcccaaagtgctaggatttccagtgtgagctatgcacatgctgtaccactcagtctctcctctaccttcttgaatatatagaatacagtcataataacactttcattgttcatgtctacaaattattttatctgtctcatttccaggtctgtttctatttattatgtttttttcttcattatgagttgtattttctggtttttatgtttttattttgttgggtgctagagatgttcgtgtttttaaaatattcttgcattttgttctaacatgcagttatgttactttgaaatacatcaacaccttttaggtttgcttttagtctattagatgttactagagtactggggatagtttgtgccactactgagacaataccacctgagtacccaaatttctatgagttacatggttgtccatctggccggatggagtcctgactcagcaccaaagatgtttaactttgttactattgaatggttttgtcctcagccttgggaagtgtcctcatacacatgcactgataagtactcagatgatgacttaagagggacaaaatatctgtagacctccagagctctcctgagaatttctgttctctgtggtattcttccccatcaaactcttgctgctttaagtcacatcagactttcaactttgtgtcttcaatttagggaaactgctaggctgggctccttctgagttgctcttttctcttttgcagcctggaaactttccatataatcagataaagaaatcaaagtgctcactttatttttcttctcttagaagtcgctgaagtgatcttcttcatatccaaagtctcaaaattactgttttacatattttgtctgtttgctttttaagttgatccaggcaagcgggatacatccactccctattaatccattttgaccagaagttggagttctttaataagtgattaaacaatcattttatgatttcagtatgccaaaacttttagctttttaaaggtaccaaaaatgccaaactgcattatatctatttcctgatttctgccacaaatctcatcaagaatgaatcctaactgtcatattgtatttttagagggtaaatttaacctgagtgcttttagaaataggtcttttatcctgtggagaaatgaacctttataactcccagagtgcattctaagttcagtgaattcaatgtaaattacaatgttaacttcagcatctccccccatcaaaaaatcccttcatgcatggaatacagaagttttaagtttatgaaatgcaaacatttaaaattggaaaaatcaatgcactttagccgactcaagaatagctgacatacatgaataaaaaatgaataagtaccatgtagagaacatttattattttgaaacaaagtgcatcataagtattggttaacaaaattctgctttgtattttttgaagcagtttaagaagaattatgtagaatgatgtttgacctaaaatttagaaagcctgatcacaaagacctcactgaaagaagtcatttaatggtaaatgaaattagaaaggagggtagatttattccctgctttttcccaaagtatcttactgagagcatttatgtacagtgcagcaatagtgaacacggacttcagctgcatttcagactgcgggatcagaatagttcattgaaaattcatattgtgtgctgtataagccattctagaaggaaattcatttaccttgatattattttataatttcacgattcacacagagaatccctgcttattcttaagctaataacagtaatttctgagaatataattttattcctagagttttaatgtgtgggctctaaaatggagttttatctcaaatttgattgtaaatgcttcttatttatgttgtttattatttctgtgtgccaatagtttgtccaattactatattctaaatgtgagtagaatatggaatctaatgaatccaaagaaaaatatatcttgtttttttagctttcataaatgctttgaaattcagtttagtgtgtttcggtgcttttattttataaatgtagatgaattcagtataatataatgcattattatctgagttacagttttcttttcaaatgttcttgatcatttagttgacattaatcaaaacactaaatgagtaaattttccatatggcaggcagttgtttacttacaaaaaaaatttcttgtaatagatagtaggcttaaagaccaaatgatttattatttcttaccaaaattattttataaaatggcttattgagtcactttaagcataagaaaccatatttaggaacgtggaggatactaagaaatgtaagacatattctctctctcttttttttttttttttttttttgcgacagagtctggctctgttgcccaggcatggtctcggctcactgcaacctctgccttccaggttcaaccgattctcctgcctcagcctcccaagtagctgggattacaggtgcctgccaccacaccaggctaaatttttgtatttttagtaaagatgaggtttcaccatgttggccaggctggtctcaaactcctgacctcgtgatctgcccacctcagcctctcaaagtcatgggactacaggcgtgagccaccacacccagccataagacatattatctaacatattctaggctaccaaagacctatgtaataaatataagattatttcatgaaaagaataagtgtggtcacatagtttctataagaccagtgattgcattagtagtttgaaagtttactttggtatgaggttgttagaagatttttcctagaaatgttgggtggagaattttgacttaaagataaagtaagattcatcctcatgggacgatatgttatgtactgtgtataagactgcagagtcaaggaaaagcaaaagaggctcaaggttcagtgaacaaactaattgaaccatgaatgcaagttcatataagagagttgcaggagttataaatagagagataacttgagtgcaggttttggaggttcaaaaattgtgacccatgatattcttggatttttctcttaccaaattattccaagagtccatgctgtatatttaacagccattttgctgcagtactgaatcacaaatactggggacttgcgtgcaagtcattaattaagctagttagacttacctgtcacctaccctttattatctttcttatgcttttttgtttgttttagccttctcttctcatttttcacatatctatttttatgagaaaaaaatattctccactgttaaaactcctggtaaaacaagaatccagagttaaaagagaagctgcagctacattgtagttgtatttgaatagactaagcctttctaagatgcagtttattaataggagatattagttactcattattttctgaaaaaatgtgaataattattgttaaatgcctcttcccctcttcacaatgtctgctctaaagaatgagccatgaaaaggaaagatgattaatctgttattatttaattaatcctagttagccctaggaagttctgccctacctcttggtctctttctttaaatccagaattcctcaaggagaagccccttctagttttataatgacatccagagcctaatttctgatgctcttactttggagaaccctgactcagtacccatttcagtgacccctgacttatccatcttcgaggcttgtatcccatcttcttctgcataatatcatttcctgtatctgtgtggctcagaatgatatgaatcctgttcccttcttaggactagtcatgtccgggcatttaaattgttttgagggtgctgggagaagagcaagatttgggccagatagttaagatttatatataattaatatttatatagttcataatttaaagaaattaacctttaaaagtggcaaatcactttataagatagtttctgtaagaattttttgtttattaggtattgtgtgtttgtgtgttttaatcagtactttgttagacaaatgtggaaaataagatactgtatatcttatatatactagtcatgtgactggtacagatatatttggcaagttaaagacagcaatagaatagagttgattacttctagcaatgtctattctgaaacattatcagttaatcagatagattattcatatgtgagttatttacatattttatttagttagcataatcatttgagagaggtgagtgggtatatacagcccaattcttagaaaagtcttttaatcatacttagaaatattatatgttgtctcaaattttgttcattcaataggaatgacatttccctaaactaggcatttactgtctcattgaaatgagaaaaaaaagtggccatacagttcataaatagcatgctataaatcatttaaaaaatagaagcttgtatgtctaaagctccattgtaaattaacttgtataaatgagaagtgcaaacagaactacaataaagcaggcctttacacccttacacgtcattatgtcatttgtcatgtctttcattaggacaggttaaatctttgtgccgatagcatagaatattactgaaaagtcatagtgttatgacataagggatcattttcttctacaagcatttaggggaaagtcaacatagcctccttcataattagcagagaagtgacattttagaaattttttatttctgagatgcttctttaaaaggtgtactggtttgaaggggagcctctaagacggtatgtgcatgttctaacctccagaacctgtgactgtgaccttagatggaaaaggggtcttagcagatgtcaataagttaaggaagtctagatgagatcatccttattaatcaggtgggccctaaatcccatgatgtgtccatataagaggcacatggtggagagatacaagaggagaaggtcatgtgaacacagacacagagatgggaatgatacagtgacaaggaattaggatccagaaaaggcaaaaaaggatcctctcataggccttcagggaccgtgcggccctgctgacacctcagttttggacgtttggacttcagaactgtgaagaaacgatttttgttgtttaagtttgtgtatttgttatggcagctctagaaaatcaatacaaaaccgtagttgttggactttcccccccaatctcctaaacattgttttttaatttctgaaccagcatttcctacttaataaagcagcataactaacaaatatatttttaatgaaaacttgagaaataatttaacacaacactattggagaaagaaagcattagagtgacagggaatgatcacattagaagactctaggcagtgaagttggatgaataagatggttttacctttttagtcaaagggaatattacctcagctatccgaaagaactgtgtcagtcaattgttggccagtcaaacacatctcttatgttagtgtacagcagatacaaattagaaacaataccaatttcaaattcatcctatctaccttttttgtaatgtggcaaggtttttgctttccagaaagaagcagaaaataaatgtgaatggaatacaatgaatactgcataattttttcttgttaagagaaaagcatatttacagcaaagaaattatgtattttttttaaatgtagagcctggaattttaaacacaagagtaaaagtagatgatttttctttatgataatctagttcgcaaggcttgcacaacaatcatttctgagcagacattagggaattctataaaagtattggacaaaacagtacttatggaaagcttgaagaaatggggcagaaaggtgattattttcttttatatttggccctcttcttatcattatctttttctaatatgttacttcatgatggtaatgatacaataataattaaattctcaactgttactttctattttctcaagtctcttacattattgccataccatcttttattatttgaacttgcagtaaaactttggggacgattattttgatcacaactgtaggacttgtgcctctgttgaatcacatacagaaatcaaaagcatggataaatattttgtcaaataaaatttatttaaagaatatttggtaatgagtgacaaatgtttgcaactctgggtaataatagagttatgtgtccattttttcttttggtacatttttcacttatctgaatgggagccggaagtgctttaaagtttcagaatgcaagtgcatgcattgcagtgatttttctgttgttggtcaagttacttaaacgctgtgtcctgctttcctccatctgtcgaaggaacataatggccactcatggccttcacaagaaaaagtgtaggaagagaaaacagatcttgtcagtgtggggtggaggatgaagttatttttaaagcaagtatcttgtaccttcaggaagcaaaatctggcttaaggtatttttttttcttcttttctgaataggctatcatcatcaacattttaaactgctttttaatgtgaagactatacttttgttttctgtgagttatattttattattagacattgaggagaaaacaagaagggacccttccaccgccttacaaatagtgttcactaaaagaagtagatattattacttacgctgctgtattatctacacctaggaaacacacttaatacatgcattatgaacaatggaaggcttgcatggcccataataatggtaatgaataacacttattgaacatttactctgtgccaactctatgtattgtctatgctctgtctcctttgctcctcacaatgtacctaaaaggagggtgttctgattgacgccatcttacaatgcattaacaccaattacttcaagttaaactgaggcttagaaggtttaagggacttgtaccaaatcccttagctagttaagtgatagaaccaggactcaaacagcctgactcaaaagcattccttacccactgggctgtgttacattaggtgacgtacctttcacatgctctctcttgaaaggcaaatacagctttgaaaaatatctagcaagtggagccaattctgctgaaattctatagcaattttctcctgtctgtcatttcttcactggcatttagcatctgaaaaattcttcagagattttcttttctctaaaattacagaagtttaaaattaaagcaagcacaatattaactagtttccaaaaatgaaagttctaaccagctttttgaaagtttgtgataaaagataatatattcttacagtcatactcagaagaataaaggtatgcaagggacagagtggtcagtgaatgtgctcatgtgggagctgcgttcttttataactctccattctctcccgtggccctctctcttcctcaccggcatagacatttacacacacatatggtcgctttgaacttctcccacaggcttctttgtccactgccatttctatatgttttcttcccagataaattccctacctcagctctccagagtctcccatagtattgacagaatgtgtacgatttgttttaggtttttcaaatatattgaattgagtagtagtgacttgtaccacaacttttaagtagaatgatttagtctctctgaaaacaagttgcctcctttccaagtatgagtcttcagtgttttgcctggcttcactgagagtcagtgagcagactaaggtttgaatattactatccatgagatacataccagaggtgcaaaaatcataataaatgttcaagatcattaacgttataataacaacaaaatagatttacttggataagtctgttaagttaattagagttattggagcattaatgtgtttggagtttaatgccataaatcagcaattcaatcaatatgtatcaagtgccaaagaggaaatcactattgccaattatggttgaatagaaagagccgtacacttggaataaaaattgtaacctagtatctggtccttctttttattatctgggagatcattgacacataatagactctctccagtcctcaatttccacaccgtcaaattagggatggaaataagatttcttgaggttgttacaaagattaaataggtaaagtatataaaagaacttaatatttctatttttttttcttttttcataattagcaggaaattgcccctgtttttttcagggaaacatagctgcaaagtcaactgggaaatgtagtctaattctaccataacattggcccagcaaatttttatggattttctcatgagaaagaaatgaagtatgatcagagagagaacactgtgagtttctggcactatattcaccatagtacaaaatgcaaaatgactcacagaattcaaaaattacaaccttcatcgaccattaagtggaaacttaatgaaaataaaaataaatgggtaaatggggatggtgactcgggggaaaaataattttatatctgttccaattgactcctaccttctctttttcatacatgtataaatgaagtcataacatctctattttccagattcttatttatcccctggctttccacatacattatttcataaacttgaaatttatgaacattagacatcatcttggggcttgtaaaggtgtcctaaccatcccacaaatgtacatgtgcacatgtgcacacatgcacacatacatacacagatacgtaacatggaaagcaaaatggctttctatagatccttaccacgatgttttccacattgatggaaattttttcctatgttaaatattcagcaaactatctctgaattctatctttaaggatttgaaaaaagcagcaaactgcgcccattaacttgtcatttacattaggtatatctcctaatactatccctcccccctcctcccaccccacaacaggccctggtgtgcgatgtcccccttcctgtgtctaagtgttttcattgttcaattcccacctatgagtgagaacgtgagatgtttggttttttgtccttgcaatagtttactgagaatgatggtttccagcctcatccatgtccctacgaaggacatgaactcatctttttaaggctgcatagtattccatggtgcatatgtgccacattttcttaatccagtctatcattgtcggacatttgggttggttccaagtctttgctattgtgcacaggtaccctagaacttaaagtacagtaatatatatatatataaaagaaaagtaaaagcattttatgatttcatcccactgaaaaaaaaaaaaaagaaaaaagcagcaaactttttattttctgagtgagcataaatacttaaacccatagatgggagcccagttagttcattaccaaatttaatggttttgaagatatctgtccaaaaattgttatagctgttgggtaaaggaagagacgaggaatgtgtgagtgtctagcattgagcactgttaaaacatccattaatcacatgttaatcctccaatttctagtcataagcaaaaatgcagcacactagaaatgagccttcttattagaattattaatttgagaatcagtcaactacatacttctgtgacatcaaaaaggctgagagaacagtggttgattgctcaggaaatttatgagaccaacatgaatatctttcacattccacaaaagaaatacaacaaatcctttgctgacaaagctctagtcattacagattttatgttctcgtttacagaggaagagcttctcaagccggtggtttgttttatcacaggaatgttcttgcaggagattcacttacaacaaaaacttcaagtagatttgggttgaatccttattctaccagctataagctgtttgctctttgacaaaaatacttaattgtttttttttttgagacagggtttcactcttactgcccaggctggagtgcagtggcgcgatcttggctcactgcaatctccgcctcctgggttcaagtgattctcctgcctcaacctcctgagtagctgggattggaggcactcgccaccatgaccagctaatttttgtgtttttagtagagacggggtttcaccaggttggtctagaacccctgacctcaggtgatctgcccgactcagcctcccaaagtggtgggattacaggtgtgagccaccacacccagcccttaatatgttaatatcatttttttacctttaaatttcatcgtttagctagtcattttttcattcagtgaataaatcattttaagttcttactatatgccagaaagaatggtaggcactaagaatattataaaataaaataaagaaatggcccatgacttcattgtgaataaggacactcatttctccctggtgggatgttcattaaaggagatagcatgtctaaacagttttcaggttctgaaacatcctggaaattatctcctcttctggaagaaattttccatggattgtctcttttgatttcctccaaaagcaattactttaataatagactcgcctatctgagttttaacaagacacgtaaccacccagctaaaaatgggtttcatggccttctttatggttgtgcatggttgtatgactgagttctggccagtgaaggtgagcaaaggtgccaatgccatcctccggccttgcccactcacagaatgcagtagaacgtgtgagcactcagggtccttccctgttattgcaagctgggagatgacaaggacttacacccagagatggaagccacaggggataacagtgtcacatgaccaacactggaatgctcatttctgttttatttaagctgctgcattttggtgtttctttattgtcacagctttgtctgtaccctaactaataaaatatgtttttgacacagtttatgccattatttattgtattgcacacaagaatggacaagtatgtgaagattcatcattgaaaaatatgttttaactcatttttgaaattattacaatattgttcaaatatatttctctaattatgtatcttccccacttaattatttttattttgagccacattatcttataataattacaatgtaagatgaacagcttatgcttcaaagaaaaaaatgagtatagccctctcatttcaagagacgttcaataaaataaaattcttgaaaaacaacaaaacaataagagtgctctccttaggatttgagttctttaatatatttttacaatatttttgaaatttccttagtcttaagagcacccaggaagttttgaaatataacaaagtatagaagtggtatttacataagtcctacatagatatcatttttttccatttttaattatggtataattcacatgacataaaatttattttcttaatcattttaaagtatacaactcaatgtcattaaacacacttgtaatgttgcgcagccatcgaaccgtacatctctagaactcttttaatcttgtaaagctgaaattctatacccattaaatgacacctgcccattctcctccctccctgtccctggcagccaccacactaatttccatctctatgattttgactactctatacatcacatattagtgaaatgatataatatttacctttttgcaactggcttatttcacttagcataagggcctgaagattaatctgtgttaaagcatgcaacaatgccctcagaatttccttctttttaaaggctgaataatatttcattgtatattgtacctcatacctgcttttaaggtttgagagtgtaatactcagaaatggaattgctagatcatatggtaattctatttttaattgcttgaggctctaccatactgtttttcatagcagttgtactattttacattcccacaagcagtgcacaagggttcctatttctctacaaccctgccaacacttgttgttttgtttttagtgttcctcttttcaatagcagccatcctgataagtatgaggtggtagctcattgtagttttgattttcacttttctaataattagggatgttgaactcttttcttgtacttattggccattgtatatcctctttggagaagtgtctattcatgtcctttttctgcttttgaattaggctgtttgtatttgatgttgagtttaggagttcactatgtattgtgcatattaatattttatcagctatataacttacaaaccctttattctatagtatgggttatctttttactttgttggtactttattttgatgtacaatgtttttaaattttatgaagtcagaggcaaattgcctatttttccttttgttacttacctcttctgttggtgtcatatccaagaaaacattgccaaatctaacatcgtgaatttttgcctgatgttttcttctaagagttttatagtgttacatctgacatttaaatcttttaccattttgggtcgattttttgtagtggtattaaaaagggtccaacttcaaccatttgcatgtgaatatccaggtttcccagcaccatttgttgaaaagactgtcctttctccattaaatcgtcttgaaatcttgtcaacattatttgactgtatatcgcaagggtttatttctgggttccctattctattctgttgatttatatcactgtatatatgctagtaccacactattttgattactgtagccttatagtaagttttgaaatcaaaaagtatgcgtcttcccctttattctcctttttcaaaattgttttggctatttggactcctttaagattacatatgagttttagatgagttttctgttctaaaaaaaatcactagaatttttaatagagattgcattgaatctgtaaaacacattgggttgtactgacttcttaacaatgttatagttcttctagtacgtgaacacgggctgcgtttctatatatttaaagtctttaatttcttttgcagtgcttaattgtttttactatagaagtcttttatctccttggctcagttaattttgaaggattttattttttgtactattataaattgaatgctttttgtaatttctttttcagattgttcattgttattttatggaaacacaactgattttttgtgttattttgctaaattcgtgtatttgctctaaaaggtgttttggtttttttgtacgtgtttctgtagaatctttacacttgattttagctaaaaactgaaaagttatatttgcaaaatcttagggttttatatgcataagactttatcatctgcaaacaataaaattttacttcttttttttccagttcagaatccttctatttctttttcttgcctaattgctctgactaaaactttcaagtactattagagtagaagtgttgaaagtgggcatccttgtctttttcctgatcttagaggaaaagtctcaccattgggcattgtgtttgctgtggctttttcatatatgacttttattatgttgagataatttcctttgattcctagtttgttgagtatttctactgaaagggtgttgaattttgtcaaatgctttttctgcatcaattgatgacgtggtggtttttcttcactttattagtctggtggattacattgattaatttttgtacgtcaaatcatttttaccttccaggaataaatctcacttggccttaatataatatatgctgctgaatttggtttgctagtattttattgtggattttggcataaatatttataggagatattggtctgtagctctctttttttatagtgtctatgtctgactttggtaataggaaaatgctggcctcatagaatgagttaggaagtgttccctcctcttcagttttttgaaagattttaaaaagaactggtactaatttttttaatgtttggtagaattcacctacaaacccatgaggtcctggacttttacttgttggggaatttttgattagtgatcaaatctcctaaatagttgcagttctattcagattttctattgtgatttagtcttggttggtagtatgtttgtaggaatgtgtccattttatctttgttatccgatttgttgatgtacagttgtttctagtactctgttgtaatccttcttatttctttaaatcaggaatggtatccccattttaatttctcacttcagtaatttgagtcttctatttttcttagttcatcaagccaaaggtttgccaatttggtttatcttttcaaagaactagctttgggtttcattgacattctccattttcctattctctatttatctctgctctagtctttgttatttccttccttctagctttggatttagtttattattttttaatttaagcatttacagctgtaaactttaccccagcactacttctgctgcaactcatgtgttttggtacactgtctttttattttcacttggttccatgtattttctaatttcctttgttgtttaagagtgtattgtgttatttaatttccatacatttgtgattttccagttttacttctgttattgatttataacttcatcccattacggccagagaagatactttatatgatctttatctctcactatgcattgaaacttacttaataggatatggcctatcctggaaaatgggaagaatgtgtatgctgttgttgttagagtgttctacatatgcctgttaaatctagttggtttgttttgttaagtcctctattttcttatttatcttatgattcatgcttaaccaacaaaaaaaaattttaccgaaacaagtgatgttctctcgtctaagatattttcttagaatactaaacacttctaccagtgatactgctgttaacaatattttttggaaattattgttggcaaagtcttttagaaattatagcatgaccttttgaatttctttattgatagaaatattttatcagtggatttggtttaatacaaccaacagtgattcaaggccaaatcttataagatgagcaacaagttataaagtaacatttcagggtatcttttaaagaaaagtctaaaaatgacaagatcatctgtctatttgcagcttattttaaactgtgtttctcccttaaattatatactcaaaatagttgggagtaaacagcagagacatctcttacctaaagttattctagggctagttcatcttgtcagaagtataatcccagtccacagttttcaaagaagtgggactggtgagtgtcagaaaaatattatcactagtcaaaagcatgattgcatttcctcttgtaatctgcaaagtgtcagaggaacagttattctcagtgttattgcataggcatggaagtggtaaagaaaaaatgtttttggtcacagctaccctaggatgatggttcttgcaggtttttaaaagacagaataggcatcagagataaattagggccctaaaataaaaagaaaatgaacaaaactttaattaaatttataatgaattgttatgagaagtgtcagccagtacagatcataataataaaacaaataccttctattgaatgttaacccaatatctagttgttttaaaatattatatcaactattttataattataatgtccagaatttacaagaaaaaaagcccattaaaaagtgggcaaataatacgaacaacgcttttcaaagaagacatacatgcagccaacaagcatatgaaacaatcctaagcatcactaatcattagaaatatgcaaatcaaaaccacaatgagatactgtcacacaccagtcagaatggccatcattaagaagtcaaaaaatagcagatgctgatgaggttgtggagagaaagaaacagttatacactgttagtgaaagtgtaaattagttcagttattgtggaaagcaatgtgacagttcctcaaaggacttaaaagagaattaccatttgactgagcaatcctattactggaaatatacacaaagaaatataaattgttctaccataaagacacatgtgtgtgtatgttcattgttgtacttactattcaaataagcaaagacatagaatcaacctaaatgcccatccatggtagactggataaagaaaatgtggtacatatacatcgtggaatactatgcagccataaaaaagaatgatatggcctttgcagcatggatggaactggaagccattatcctaagccactaacaggaatagaaaaccaaatactacatgttctcacttataagtgtttgctaaacagtaagaacatatgaacacaaagagggcaacagcagacactgaggcctacttgagggtaaagggtagggggagggagaagattagaaaaaatacccattgagtactatgcttattacctggtaataataatctgtacaccaaacccccgtgaatgctgtttacctatataacaaacttgcacacgtacccatgaacctaaaagttaaaaaaaatcaactatatatgtattaaataaaagtgatataatttacatttgcaaattacagaagacaagcatatatgaaacctagagaagttaaaaaatttttcaagaatagtagttgaaaattcacttctaatgctggtgtgtctaatcccaattccacggccttccactctcttgtgcctccttagggagaaatctgtcctgaaataattctgtacttctgggccttgatcctcagaactctgtaatacccactgaaagtcagagaccatgtgatttcattagagtcataaccccttctaggtttgtagccccttttaagtttgcatctctgtatttttctctggcttcatatcttcttcccacttctcactaaacaaaaggctaaagaaagctgagcctaaccacatgtttgcctctccacaaatgaataagttgctattcatcattttcttttgtttgctttcctttatcagaattttccaaacatgcagctgtattaaaaactaggtcaatttaaagcaatcatgcacaaaattgtttattaaaatacaaatatacaccagtaatgttataattgaatgtatttttctgggacccataagtcttttgtgcctttgatttctctggtttcctcatgtggatagtaatttttaccaagaattttactatgaatagatctagtgaatattcctgcggatgctgacatttggtagcttcttgactcatttatgttaagtccatttaattttttctgtttttatcccctctctctcctctactcccccgaaataatccaagtgagcaactaaaatgctacttgattttcttgagaactttggccagaagctatatttatttataatcacatgtcctaatgctatattgtttgtacgactcattattgtagttattattctttaccagttgtttatttttacataattattctaacttcatttcatcatgttttattaaagcacaaggttaaaaatgagttcagttttactgtcatcttagaattatcattaacttaatgtccctttttgttagttacaatttttccacctactcaggtgttcatgagttgagtatatactcaaatgcacaacaaacccaaattttagagcacagaattgaaaatcatgagtttttgaaagtttcatgaactgaggcaatcttattgccattgccatgaggagagaaattgattaggtcatatagaaggaattgaatgagataaggcaaatgctttatttttgttatcttcaagtgtgatatatgtatgcaaactattaaactcctacccatgctataaagtcatagtatgtgtatgtactgacttactttacatttgaatataaaacagataaatagtaacaggaatcctttacactgaatctgcttcatctgcccttggcattgtccacaggctgtagcaactacagcaatgccatgggaggcaaaggtaaacagagcttttatgtaggtgtgctgtccagtgtggaagctgctgtccatatatggctatttaaatttgaatgaattaaataaaatgaaaaaaaaatagatccacatttcttctactcacattgtaagtactcaacagccacatgtggccagtgactaccacattggacagcaataatacagaaaacttcatcatcacagaaggtaccatggggcaatgctgttttatagtatttagtagattgccttaattgggacttagcctctgaataatgaaaaaagcagaagcaacagtgcacaaatagatgacatccaagattttaaataaatacacacatatatgcatgaaactatgtattatttgtgtgagcatcatctaactggcatgctgggtgattaggttagcatttaggtaacaaaagatgtcacccattgaagacaagatcctgagcaggctagttcaatgcacacattcatacacacacgtacacactcacatacacacaaagtcttaatgcttgttgagtgaaaaggcaaaataaaaatataaaagatagtcaaccatgacatatgctaacatactatgatgttaggagaaaattaaatggtattcatacacgtacccacacacatacacacagtctcagacacttgttgagtgaaatggcaaaataaaagtataaaagatagtcaccatgacatatattaacatactgtgatgttaggagaaaattaaatgttggttaatatttattactaaagagttaaaaatgcaatctgcactcttcttaaagtgaggtatggtaaagcctccagattatttctgtcttgtcattatttccacctttgcatttcaaagagagtgtaaaccatttgggcctacttgctgtcttactcagtgtttatcctgcagtgacccatgggtggattggaaagtaggacagacctggcttggaatctgagcactgctacttaatgagctctgttttctcatctcctgaatggggacaatcactgtgcctaccttttagggttcctacgaagataagtgcatcagagcacttcaggattgacatctggtgcaggaagtgctcataaacagggactcaggttcatatactaacctctgatcttccttcctagcctctctgtatctttatctttatagttctttctgttcatgtcttctgttttaatgctctgctatgtctttgatcccttgccctcactcagaaacccaaaggaatgaatatggagattaagaaagagaaggctaccagaaagtaaagtaaaaggagaaaggaaatgggaagaggaaggaattacaaacatctataaaaagatatgcttcctctttttgttcctgactaaaactcattttgttttattttgttctctttatgctaaagagtcagtttgactgactttttaaaataatgatttgtttgcttgaattaactaaatgaacaatatttatatttcttaataattgagtccttaggtgatcatacaatgttaccaccttatatttaattctttttttttttttttttttgagaaatgtgaacaaaaagaggaaaacctgtgtgtttggttataaggtctctggttaattttctgatgtaaagctttactgaaaaatcatttcattaagtgctccacttgtgagctgcttgtagtgctttgtaatctaagcatttcttcagtcatttctctgactctgagggctctctgccaaagcacggcttaccaactggagcaggtaaggaatgtttattttgctgtaattggtgaccaaaggctgctctgcataatggctcagaggaaaactcagaccttctattcctgacactatggaggagaaaacctgaacttaaaaaggcactcgggtcttacctatatcttttttgatgaggtgattgcaactggacctcagccttgccatttctaaaatagggatgatcattcctactctatctattttctaacgttgttgagataattgatacaaatattattttaaaaatcaagccagacgcggtgacgtgtggctgtaatcccagcactctgagaggctgaggcaggcggatcacttgaggtcaggagttcgagaacaacctggccaacatggtgaaacactgtctctactgaaaatcagccgggcgtgttggtgggtgcctgtactcccagctactcgggagactgaggcaggaaaattgcttgaacctaggaggcggaggttgcagtgagccaagatagcgccactgaactctagccccggcgagtgagcaaaactgtgtctcaaaaataaataaataaatatttaaaaataaacaaacaaaaagcaaagcacagtatgcatgagtttgctttttctaaatgtgatgatgaaagctatcatataaatttggtagtactcaccaacgtagagccaacaattctaagcagcttatctccagtctgagtctaaagaaccctaagacatctagttaattcagtggtaacaatagggaagcaattatttggaagagtgtctggagtacacgtgctgctttcctgagctccaaagaaagaggccaccataccacaggtttttttacacaattcttacactatgaccggagcccaaggcagacagtcatctttagctatgctgccctttcttccctatatcaaatatgacagcagaaatatcttttctcccctcttgacttcctaatactagcaataactttatctcattatcaaactcaaaatttaagagtcactcttgatttttccctttcttcattgagtaacaaattatgttactcacgtccattgtttgctcttaatttatactttaccacctcagttcaggcccctatggtctttgcccagacaattgcaatagcttctgtagtattcctactttcaatatcttttccactttccctggactgcctagttctgaggaatcaatttccctaaaagtgcagtttgaaacttgttgaaaatcttcttcaactcacatctcttattctataaaaggtagataacacagaggatacaaggctgagctttaagaattagacatgataccactgtcttagtctattttgtgatgttataacagaatatctgagactgggtaatttacaaagaaaaggaatttatttctcacaattctagaggctgagaagtccaaggacaaggagctgctgcatctggtgagggacttcttgctacattatcccatggtggaaggcagaaggacaagaaaagatgcatttgagagagagagagagagagagagagagagagagagaggaagaaggccaaactcatccttttcaacaggaacccactcctgcaataactactccactcatacaatagcagcattaatccattcatgaggccagagcccttgtgaccaatcacctcttacatgtcccacctcacaacactcttgcactggtgattaaatttccaacgcatgaaccttgagggacacattcaaacaaaccatagcaatcacctacctataaaaagaggacactcatctattcaataaatatttatggagtccttactgtatgtcacactggattaaggtgagaaataaatgaagtaagggatgggaggtagttaaaaggcctaattaggcatccaacaaatgttactattaggaaaaagagaatgaggaggagttgctgttattattgtcttcaagtttgattctaatatgcatgacgcatccacaatgaactgtgcccttgcatttgcttgtttcactcttttccctcagccattgttcatcaaaagattcagcaaaactgccaccttcacagagaatgctctctgattccagaaggctttgctctggtttatttatttattttaattaattaatttatttttttaagacggggtctggctctgttgctggagtgcagtggcgcaatctcagctcactgcaacttctgcgtcctgggttcaagtgattcttgtgcctcagccttcacagtagctgggattacaggcacgtgcctccttacccagctaatttttctatttttattagaaacagggttttgcctgttggtcgggctggtctcgaactcctggcctcaggttatccacctgcctcagcctcccaaagtgctggaattacaggtgtgagcccgaccctgattttcttttaaacctccaacacaatttttttattaaaaggttcattagggaaaataatggtttttgtttttgttttttaatctttatgtactctagagagcttataaaatacataatatatcttacagaagatgttcaatggcgattgttgagtgtccctttgaatgaacaaatggaaggatgaagattgaatgtgaatatgcaagtgagagaggaaaatattataaaatatctttggattcattttttcacacacctactggtatcagtatgtgcagtttaggatcaggaaatctgagttccatgatcaaattgattagggacttgctattcaaccttcagtaaataatttagcctttctgtgtctcatacattcagcaattcaacaaatatttgttaagcaccttctatctgcccagcactgaaacatttctcactaagcatgttttgacctgattttcttcccggtaatacactttagtagaagattgaaaatgtaccctaatttttcttccttggagtcaaatactttctcacactgagtaggtgagtagctggtatctgcaagactgataaatgagaaaacatgtcataaactgaccattctttggacagtatttctagaaaagaaaaaaagaaaaatctttatcaggatgccattagattagctattaattacgtttataaaggagtatatgtaatgaagtagaattgaatgcattatacaaatggcatctttctcaaatatgtgttgctcatccttttaagagaccaatgcaatcatccatattgtctctccacccactacatttaattaaacagtttgggtccagtggggtcaaaggtgttcagtaacatttaccgtctgacagcaatcccatggcctatattctgtgaatgtggaagccctggttcattgcaatgagcaggtatctgcgttagcaaagcagctaccactctaattttctctaattgacttgttggcagtgctaacagagagggcaaaagatgcaggaacatgcagagtgggccccgacaagaacttggcatggatgaggccagtgagtgaagtatataatctgtaatgaataaaggactctgggctgtcaatctggcacatgccactggcatttaattcacacaaaatattaattaaaaataatgatgttctccccagcttttgtcgccaagtacagcatcttggtctagccctgaagagctgtctacaggtttcttgattcattccctcagccccagagaaagacattcatctcttaccttcagggaagcctcaaaaaaagctcttagaataatgggtctctcacctaccaagtctcaggggaaggagaacccaggcttttcctgattacccatttcttgtctttttcaatctctgtgatcaacgaatgtgcatttattttctcctttcctggccacagagaatatactggccaagagccatctattttggatgctcaacgagttactaaatatttcttcagtttcctttatcccaaactgaggtgttctacaagaaaggttggccaaacaataatgaaaatctgatcaataatttcaaatctgctaaataacccagaatattcttgatttaaaagaattcccgtggacttccaaattattatttggaaatttattttcaaattatttcagtatgattaaatcacagtaaattcaaagaagaaaatactgctgagctttattttgcagaggcaactgataaatttttaagcctatatatttgcaacattttagcaagtacaaaaaaatacacttactgtcatgattgtcactaagtgtattcctgcacaatggggtctggccataattaatgattaattcatttggaatcatcatgataatattaaatgtgtttaactcatttgatgcttctgtagagggagcaattctaggcaattcttttgtgatttactggttttaaagtttaagagctctgagcatgtgcaggaaaatagttccacattgctctccagtggcacagtggtaaattacacccttcttacatactggtagaaaaccctcattctctcttgctcccaattcacacttaaagcatctttcctcttccatatacattcaaacaaaatacctccatcacaatataaaaggatatcaaagcactatagcccacttgttaactaataaatgtacaatattttcttgttttttgttctggaagatcaattattggatcaaactttatcaggaccggaacaaaatcctattgtttcctcagtaggtccagaatgcagtttggcaagagcacaatacagaggctagactccccaaaagatgtttatgagcagttaaagtgtgaaaagcataaaagaaagctcctggaaaaggcagtcaaaggggttgtggagtcttcccaagcctttattacttaggtagttctgcattactttagaaaaaccattgaccttacctgagcctcaagttactaactgacgataggaaaacattgagccaaaacatcttcaggactcctagctctatgggatattcttataccagttacaagtccattgcaagtgtgtttactttttacggggctaagctgttaccactttttgtttaagtgtaaggttgatcttctctaagatgtgcacagcatagtaggtattggtgaaatacagtgattagtataattcattaatccaacagagagtaaattataaagctctcgactcagcatattctataccatggctaaagatcaagtgaaagaagctgtcattactcagatgactcgagatttggtaggtatcaatattagcaagagtctgttttggaatgacagttacctcaaatttatgggggttaggagatgaagaaatgatgactgcttcagattaagttaaaaattcaaaccaatacaatgagaatcttgtattctcagtaccaagtaaggtatttttaattttttttcttttttaaaaaagaaataatatacaccctgaaagactgaaaggtaataatccagtaatgttacagaagcttttacagagtgcattttctatggagctataaattaagcatctgggtggtgggaacagaaaaatgaagacatgaatttagtgtctcatggactatgctgaccatccataagctacagctgttaaccctgattaggaagtcaaaggcttcctattaagtagaacattctttgaatcctaatccaaattggacctgtgaatataaaacaatcacttcaaatctcctagcataaacacctgtttcattcttttatatttaccccccaccccccccccaccaccaccttaccacatcatataaagtttctagtttgttgttgctctaaaggttgacggcttgactatggaagaccagacttcagtatctatttttccgggattatatgtatattggcatgtagttgggtatgtaggaatctgtccaaggttatagactaatgaccacaggcttggattcagtccagagagatagtttttccaggataggaaatttattgtatttattgtattttccaggacaggaatttattgtatttatttaaattatctgccaacactgaaaaatttgataatttctcataaaaatctggatttccagataatctgacaaaactgggactaccttccatacactaatattatcttggacctgaatagtggctccactctttagatcaatcatatactttccaagatcctctctgacctagtggctctcatacactgtagccaaatctagccgtttttcttttctctctctctctgattaaaaacaacacacacacacacacacacacacacacacacacacccctacctcctaagcacttgagtgtggaatttctgatcactttttcactcttttgataaacacttagatagatgcaaatacggagatgtattcaaattgcgaatggaatttgaactgcaaaaaggcaattttaaatggctcaagcctaataaaaatgtttacatttttggtgcatagatgattcatatatttgaaatcagacgtagtccatcctgcaataactcaaaagaatatatttcccagtggaaaaaaaagtgtactttttgatctacctaattgtattttcaccattttttcactgaaatgttttcttcctcctatagtgcttcttagtcctacccttattcacaagccctagttcaaagttcatatattccaaaagtcttctttgatgacctaaatcctcactaatttttcagacctctaaatgtatagcattcataagctatatcacatactttattgtttaattttacatagtctttcattgttttctctgcccagaattatattagtaacctgacagaaattcatcttctccaagtacttggatctcaaagcgcatttaacacttgttgattgattactttcttattaggaaaatagcttgacaacatacattttcaaaaaagaaatattcccttttggagggaaagcaattcactgaatagaagccctttgactacattagatataatcttattttattcttcttgctgtattatagctcttgaatccatgtggtttagagtctcaatatctttaacattaatacttaggtcacatacaaattttatgaagaaaactcaatcagatcaatttttatagatgtctatcagagataaatacactcatttttaaggcttttttattttgatataaaacccagatacagaaaaccacatgcaacaaatgtgtaatttaatgaagtattataaattgaagttcaccatgtttccttgctctgttttctgcaatctgtcatttaggtccagaggctagatcagactaagtaggtttgatccctttggcaaaactctggagagtagtctgttctttcatcaggaagcacatactgtctcgttgtctctattttatcttagcaattattaatgcttaatgcttagatccattcattaatgggggctgtaaaacagcaatattttaattttactgttttgtttttatttgttagctagaattatgttctgatttcacaacctcagaaatgaccaactgttattctttaaaatacctttatcaaattatgcatttatgtatatttggtgagtttccatacatcacagcatttatgcttttctgtttgcagattatccttatctctggtctgagggagtctcttcaaattgactactgaacccatttgacatgattttattagttgcttccgttctatctagtatgtcaaaatatttcaggttcatttggcatgttttctactttaagaatcaaccagttctgcgagaagctgcttctttttaataggaattaattttcccccaaactgcagtctgtgtattagggatggttattgctaccgagtccaggtttccagacattttttagcagacagagctggaagagagaaaaagtacaattttgagttcaaacttatttttccaattcaattttaggaacacagactttatttaaccttttctgtattacatctctaggtcttttcatctacaccaagaatctggttctcagggacagaggggatgatagaatatctcatgtttacccatttgctttattccatattacattagtctcaaaataataaaagtgtcaacatcaataataattattgaagtatttatctttgcatatactgtcattagtctttaattttgttttatgattgtaccatatctataatatcaaaacatttagccattacaaaataaaatatctttcctttaacttagtcttagtttattaaatttttattcaccagttagctattaaatcagtatctcttctggtcatcgtatatgcctaaagctcatttactagtagttctggggatcagggaacaatattcctgagtacttgcaagtggataagtttgtaccctttatgtttaaagttaatttttgttgactataaaactttgaattacattttcttatgttgagtatctaaagttactctaatttcttctgccgtaaaatgttatataaagcctgataatctaatttttttttctaagtcatatattatttttgtctggatgcctaaaacattattttaaatcagcagattttttatttagtgattctgtttttattttcctttggattttcctcatcaaggactcctattatctgtacgttagatcttccttctctaacttcaatatttatcactttctcctgaatcctttttcagtcttcttaatttcttttgttatgtttttgcttttgacttgtattcatctagttaccgttcatgtctaaaattttttaatttacatatatctattccttgagttatgccacctcatttctgagttttctgatttatgttactttttcatatctggcattttcttaatgtagtttagttcattttgaaatcataaattgcagttttgatctatttttcttgggtgttttcttctactttttatccattttctgtacttttctataggaatgatattctcctattttattttttcttgtgctaattttgtaaagaagtttacctcaataatttttttttcttttttttgaggcagagtctcgctgtgtcgcgcaggatggagtgcaatggcgctatctcggctcactgcaagctccgcctcccaggttcacgccattctcctgcctcagcttcccgagtagctgggactcgggcacccgccacagtgcccggctaatttttttctttttttttttttttttgtatttttagtagagacggggtttcaccgtgttagccaggatgctcaatacatttttattgcttacatttatgtaatttgtttttcctgttctttcagaaattcagagagctcttctcaatacatagagctccctgtcctgttcttttcaatagacagggttcagcaaactacaggttacaagtagaatctggagcaggtcttgttcttgtatggacccctgaattataagtggttcttacatttttgaagtgttgtaaacaaataaacagagataaaaattgacagaaacaatgtgacattcaaagctaaagtatttactctccgggcctacgaaagcttgccagctctggatacagactgaaaactatggcagcttgctttctgaattttcatggttcttcttctcccctacttttaactggactttctctccccttcatcaatattgtttcaatcttggttatatcttacatcagttcacaggaggttgtccccagtttgggcccagtgctagagaggagactttgcaggtcagttttgagtgtttaaatttgttgttctggaactgatctgctgtgctttccagcattagctgatacctattttagaattatcctgtttttaggtttgatgcttccctttgatgtttcttacacagatgcagacaacaaacagatgatgaggctgtcggttgtttattcacacccacttgtatattagggttcgagggcacacatcatcacataggtttgcagcaagcagataaatgctttcggttttctacctagtagttcagtatgttttcatatggggattgaggaagatcaaaaaaccctactgctaccacccactgccactttcctttctgaatccaactcactcattcttaaacaatttaccaagtagattatatgaaatttgttttgaggaaaatgtttgccttgagtattttgatacattaaatatatcaacacgttcatattgtttctgttttttctccagagtcaagttcccattatgtaatctccctaaaagcttttaacaatgccggagaaggagttcctctttatgaaagtgccaccaccaggtctataaccggtaagtgaaattgttaatcttcctctgacaaagtatatttgatttatggtgaaaaaagaaaaactaaaataaaatacaaagaaacaaaaatgaatatatcctatcattatcctctgataatcctcagagaataattatcctctgagtctgataagtacatatgtatacttgcacacatatgcatgcatttttttatttctttggttgtcgaaattaagtaggaggaattcagtttataaatttgcacatggacttagagaatatagatctctcaatctgttccttcccaatagcatcatggttttggtgccctgataccatgcttccatctcctgagcagtttgtctcaaatcaatgccatctttgtccctgcataaaggttgccaaatgcctaaatagacacttgcttctccacacagggtctttcaaactaagatgacaaggaagagctggccttctggggtggtttgcattaggctgagtgacatatgtggtatcttcctgagctgggcctccaggtcaccccagcagtgcccagggcctcaggaccttaaagggatagctgatttaaggccttgtcacccttaggaatttttctgttagttggactgtaaaggcagtacataagagtgaaagggctcaagatactgagaaagaaatgggtaagatggtgagatccaaactatttatggaggttatttgttagcatgtgtaggcttagtccaaaatacaataagcaacacatttgtagggctattcagagtccctggaaagtcacttgactacttccccaaacccctgccacagacttatgtctgaaatctccaagtaaaacccaagttccctctctaattaatacattgaatctgccccctcacacccttcggacgtcgtttaacttgtcagatattgtccccttaacgaaaacagaggatctgagatagcaagcatcggagaacgtgagatgttactgatgtttgaaatttggatgagttggaagaaatggttataaaataaatagtggaatcccgtggcttctactcctgcccaaatttatgtgaacttagtgcagtttgtttgccaaatgtacaagcttcattcatagactatcttaagaatacagttgttctttgaattcataattgttatgtcatggcctttagaaaatactgtcactatattgattttagtagtattatttaaggcaaagttgctattgtagtctctttgaatctttgaccattgtttccaggtctacaatctgtctaaagtagaatgcaaaattttgggcagatgtcaatatgtttatttatctgtggagacagtatatatcattcattgtataatcaaaggggttcatgacttctctaaaagagtaaataattaccccagagaatatttactatcaaacgtgttatctccaaatatagaaagatgagaaaacttgaggtttgggttacaaactaagagctaacagatgggtgtctgggattttaactttattcccttgctctgctagcaacaagattctttgtgagcaaacaggccactttggctgcaccattgtgtctcataattttcctttagtgaccatctctgtcctgcctatggtaaaagatccccagtagccgctcattgccatggtgacttggcacttgtgatcaggccatgcaaaatgatactacagtcggtcttttcaagctcttattctcttaccaaagctaatggccccaaggaaggaccactgaggtggcaaataaaaatcgcttttcaatcagaaactggaaaaggtgaaagaattcaaataaactgaaagtaagttgttcagaaagaaccactggagtcattatcagcttcattcttcttagcatttgttgcattaattctagcatatgacattcccaaggtggtttcaaaaacaccagtgatccaggcaatttttattttctgatgactcagatcttaaaggaactgagaattgaaataatactaaaagttggaatttgtgtgaggaattttcttattggagaaaagccagttaaggggttcgagaagaatgcgtgattccagcccttttcaaaaaggaaagaaaacactttttctggaagtggcagaattattttattttgcttccacatgtcatggagaacaaagaacaaataaatgaaatcaaaggttaaggaaactccattaataaaagtgtcagtgccacatagacggcatcctctatctctaagcttctgcaaaggcataccatggacagtctcgaacaagggcccgtgtaaagtaactacaaaatatatcacaggcaataaaacctcaagtcagaataagcatcaggctatagagttttctgcacacatgtgctcacagatgttggtgagctctggagcctcatcccatactgggaatatcagcattagagctgctgaaagtctcacgtggccacatgcattaagagtctcatttttgctgtaaagccctttatttcttgttgtcttaaggacaagatatcttgagcctggagaaggaaagaagatgaaaagaagaagactaataaaacacgctgtttcattgatttattctcaactgctttatcaatgttaaaatgaagtacaatccacatgtaaaattgcatcattatttttaaagttcattttttttgagatagggtctcattctgttgcccaagctggagtgcagtggtgcagtcatggctcactgtagacttgacctcttaggctcaagtgatcctcccacctaagtctcctgggtagctgggactgcaggtgtgccccactatacctggtattttttgtttgtttgtttgagatggagtcttgctatgttgcccaggctggtcttgaactcttagcctcaaacaatccttctgcctcagccttccaaaatgctgggtttacaggtgtgagtcaccacacccatctaaagttcattttgaatgttagtgtaatgactcaacattcatgggcacttacaaaaacacctgttaggaattgaacggatttctttctcagcaaaagtttggaggctatattttgtcttttactaaattttttttcaattctcttgaatgtaaccactcagagtcagcgtataaatcacccagtggtaggaagagaaaagaaaaaagttctgtagcaacaaaagaatgtgttaaattcaattattcaaatattaatagtttctgacctgagagaaaaagacaattaatatatgcaatatgtattaatagctgtgcttgctgtgcacgataacgctctgctttgctggaaatgctctatatctgcatcagacactaggtttttatagcaatttaacacttgaaattgcctagtgctacacaggaagtgaattttttgttattctaatttatttaaacttaactagttcatataactagtggtcattgtactagcacagctctggaggaagtgtcaagaaggatgacaagccacacctgaaaaaatattattccataaaatgggaaagaaaaaacttggccaaggatagaaatttctggactgtgtaagtccatcaagaaataccacccaacacccttgcttgaaatttcagagaagcattctggaactgactccaagaaactcagtaagaatggtcatgaatagtatacccatttaagatcagaaatagcaggattgactatttccatttcttgaagaagaatcaccctatttcaaaacgttatgtatggcacctgtgaaaaaactatacagttaatgtatgtttaccaataaaactggattaagaaaacagtaaaataggtcaaaagaggagtttgtaaattagaaaacgtcccatatgtgtatcacgttcttcttgtaaagccagctaaaactagaaacaagtaaaacaaagtagcacctgctttaatttggcaaaaatgtcttccactgctacacaaaccgatgaatgattggaatccttgtggagactgcaacgtcttctctttccccttcatcgttttataaatctatttgagtttaaaggatcccttaataaaaagagacatcaaataaaatacagaaagcctgggctctgtcattaaattttaaacacaactctctttctctttctctctctctctccttttatttttgtttttgttttcagttttatattttgctccaaagaccacaaactagtaaactactgaataattcattggaaaacagagtgatgaataggggataggcatttgaaatgcagtggacaaagtgaagtaatcatcaaaaccagccagcagtcactccactttaaactaggctgttgaaaaaaataaaccctgtattatgctgctgtagacacccagcatattagtaggtctcatctccccaaatgttatcatatgcccagcctgagagttatattatcacatattatttttcttagaatatgcactacataatataaagattttttaagtgtaaatgtcttaagtacaaaatcaaatgctcaaagttaggctgttactgtggccacaaaatcagcttctcttattctgatatcacagcataaacatgattacaaggtgttttggagaattttgtaaaaacacacacatcattttgcagattcccattatattatggatcaaagcatgtatatacctcagtgcaaatctcataagtctgtaggtagttaatcctgtcttgccatccaataatataaaattgtaggaatgtgtaatatgggaactcctaccaagactaaaaacttagctaattactctgtgagaatgtgggtaaaatcacacttctacattttcaagggtttcagtctaagaaagcctgacaaaccaggtgctgtctgaaacttaattatcaaatatataattgatccatgggatcatgtgtacctggtcactctggttttgtgcaatcacagccacacacaggttgctgtggatgtcagggtactttgttctttattatttatttgtttcttgcccaggaaatgtgtttgcagatataagctaagcaacaatgaaaacagagaaaccctattaagttagagaaggaggagaaaataaacaaaaaattaggtattagataagcaattagctttttgtaggcagaaataaactggaacccccatttttatcttattattttaaattatatagtaataaaactgatcgatcctgtaactagatcttttaagaagcaatgtgcaacatttaaaaaatagtctttaaaatatataagcagaagtgacagtcaaattgataaaaccactctaagagaatgagtaaattatagaaaatattcaattacttttttgcaatatagcaatactgtttctaatgtgttttccgattgaattaattacatttttttctgttcttctcatgttccctttcatcattattgccatgcatttaactcattgtgatgtgttaccactgatatttattttttaacgcttttatttacgtatttatttgtttgtttcatttggtgggtttttaaacccagatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaaggtgaagttctaattgatagcatgaaatttaaaatgaactgacatttgtttaacacattgttttaaacctctcctggactgtcatgagtcgttttgctgctgtgtatctatgtagaaaaacaaagcattttaataactcaatatctaagattaacatgagaataattgtattttaggaaacaattctaaggcaaggtaggaaaacatcaagtgctgtaaaacgttatttgcttttcaccagatgctgagtttgtataaatgatttgattctgtgcaagagaatgccattgtccctttaaaatagcagagatctatgttaattttctggattttggtatcttttttttttttccatttggaatctagattgatttacaaagcgaccctattaatgtcacagagactcatctttcagtgaatataactgggaatagataagttgaagatatttttttgtaacctcagcactctaagccattaacatctacttcatttagccttgaaaacacactattatggtaaagaaaactcacaatccacactcccatttagctaatatgaattcaccagctctctgttcttgtccttatcacagagttatctgacaacctctttaagagctcctcagagatacatatttgagacagtcattaccagtttcaaatctctatcaaccagcctcagggatcataacaacaagttatatactaagataattttgttacctcctaaaactgctatgatgttagtatatatagacaatatacaaatgtagacaaaaatgagaagatcaacaagtagttgtcaagaacctactatgtacctagaaatgtactacaccatagagatggtttattttgaaagaaaacatggtgtagtcattgttacttactacatataattttaggatgaattatacactcagctctatggataaacttaaaagaattcataagttatttgagagatataatgtataaaaacacatttagaacttaaaacttcacaagatactgattgggagtgaagaagtcagttttgaaaataagagcataaatgccacccaacaactaagaaatcaaatagttcaaccctggctgtcttcttcctactccttttgtgttctcttaaccgcttgattggggtagctcttgaggagattttaggtctccttatactttagccaatgttcttttcactgaactaccatcctcctgaatccagcctcaagctagtagtgattttggggggatgaaaatatttcgaggatgttttttaaccccaatcctggagctatagctaaatcccaccaccaatcctgtaagcttgcttctctctccccatagccatgctggatcttcctgtggtgtctttcaacttttaaatggcataaaattcacatttcatcataaatcagattttagttgaaaccatttaaagacagttttctttggtactgctgccctgttaggtgaggtatttggaagaactctccaggcaagtctaaatagtatcattgttataaggtatgtggtaagtaccctatccatctccttacagtagtagatttaagattcagcagaactataaataaagataacattatcagaaaagacaaccaatgaaacatatgagaccattaaagaatgtctctttttatatagattacccaattctctaagtttacttttagaaggctactttctccactttaaaaattttatgtcataattgctgtactttgtagatacattcatttcacagaatggccatggcgactttgccagaatgtgaaatgttctaaggaaaaatgattgttttcttcagaatggtttgagttccaaaatttcctgaagcaaattatttcagttgaatagttactacagcagacatggaattactgaatctcacaaagagtgcctgtgaggtgagactcagcccaaaaagattttaactgttcctcttcccttcatcctccctgacagaaggctttcaattactaatgtactattccctctctctctctccctctctccctccctccctccccctatatatccataccctgatatgaggagggttagagaaaactagaaagatataaaacaaatttaaattttacaaataatggtgatagactctttgagttttcactttgtacttttcaagccaatgtcatatctttacttcatctcacttccactacagctttaaaaggtaggcaggacatacacacaataggaaacaaacaaaatgtacatggagccacatgacctgggctcatgggttggctttgcaacctcctgtcatgaaacttaacctgctcagtctcatttttctcatctatatgatggaaatatccatacttactgtaaaaacaatgagattctttgtagttaagtaggaagacagaggtaggtgatataacttgacagaaattcctcattaaactagagcaggatctcaggtgacccaatggcatcatccagggatttccccacaagagtgtccttctagttccatttactcccaaatctataatacagatgctcatgttttgattgtctaaaaccctgtattaactttcctgatcaaatggagacattttctatatgtttttctattaaagtatttaatcatatgatgttttatatgaatttctattcaaaatatatccatcgagtgttgactagtgcttactagatataatatggatgttacagaggatatgaagttgtgcaggactcagtctcagctctcaaactgcatgcaactcaatgggaggagcatataacacatgcttaaaattacatacaacaagagacaatgcatgaaataatgtagttaagatttatttaatactttctctgggccaaacgctatgctttacttgtcttagtttgcactttaaataatgctatgaagtcagtgctatggtcgtctccattttacacacaagaaaactaaggctcaggctgggctcagtggttcacatctgtaatcccagcactctgggaggccgaggcgggtggatcgcctgaggtcaggagttcgagaccagcctggccaacatggtgaaactttgtctccactaaaaaaatacaaaaattagctgggcgtggtgggggggcggggcgcctgtaatcccagctacttgggaggctgaggcatgcgaatcacttgaacccgagaggctgaggttgcagcgagccaagatcgtgccattgcactccagcctgagtgacaagcacgaaactccatctcaaaaaaaaaaaaaaaaagtaaggctcagacaggtaccatctggttattctgtgctcacaaagataactggccatgttgctccaaagtatttctaggcttttttaagataagctgtagctttctatgaggttttagaggaaactcagtaattcatggtatttatagaatgcaaaggtgtcagtctagaacacaaagacgatcttacttgttggcctctcaaatgccagtggtgtctgtgctcagaaactgtttttattgagatatgatctttccctcttacctaaaatacttcttattgcctcatttctcccttttatttccatttctaagacttagagttgttcatgatcacgaaggaaagcaaaaatggaagtaatatatctgcatgtcagatactagctgaccactttgtgttttatttgatggaatttcatcttcctgattataccaaaaatatttacatttatttagggcatatatttttacaggtttttcttattttttatttttaagatggagtctcgctctgtggtccaggctggagtgcaatggcctgatcttggctcactgcaaccttcatctcccaggttcaagcaattctcctgtctcagcctcccaaggagcttggactacaggtgcatgctaccatgcccagttaatttttgtatttttaatagagatggggtttcaccatattggtcaggctagtcttgaactcctgacctcgagtgatccatccgcctcggcctcccaaagtgctgggattacaggcgtgagccacagcgccaacctacaattatttttaagaagacttctgataaatatttgaggtcatcactttaataggctggataggcaaatcaccgaaatgttattagtacagttacatatttatttggtggtgtaatgaaatatacaattttcataactataacctaagaaggattcgtagtagaattaaaaaaaaaaagatatcccttccttcagtagtaagggtaagatacgtatgatatgagtgggggaaaagagcttttcttaattattttagacataaatagataataaatgtaatgttttaaaataaaagtatttaacttcgaagaacgatacctcataccaagtacaaaatcatatttataagaggaatagtcccattttttttgcttatatggaaaatatactttaatggattaaaccttgcatcatgttttttctttattacccgttttggtattttgagtaagcaataaagaactataatttactttctactaaaatatctctaacttgtcatttaaaagacaaagaatgaattcagaagacttcaataataccaacaccactttaaacaccaatgtaatcctttagtatttatccaaattgctgttccttccttgatcaattgctccagttaccatcgttaaatgtttgtttaatgtgaagtctacacaaagaatgaaaaccatgtgactcagcattgcttttgtctcatgttctctataagatgtaaatggattctggaagcactaaaagtttaaaccttaaaggctttttgagatacatgatgagcagtagaactctaatcaattaacttcgttacaagtggaaaataataacaatggtctatttaaaatatacaacattaaaacttatgccaaaaaaaccacagattttgattataaatgaattaagttcaatgcagaaaatttcaaaaattgagttgacagaaggaagtggaatttgtcctgttgttctggttctgtaataaaggtaagtatttaactttgaaaaaagatatgtaaataccaagcacaaagtgatatttataagaggcatagtctcatatgcctgatcatatggaaaatatgctttaacctattagacctttcaacatatcttacctcggaaaattttctatctagtagcccctttggacaaccataatacctaattttattggttatattgtaaatgtataatcagccagcgtgaactggttaatagatgggaattcgagtcagtgctatgctctactcctctgctgtttgggagtagattacttttgtgttagcttatttaatagtctttttatatgtcttgatttaccaagttgatagagtttattttttatctctttgctatttcctacttgtatagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcaggtatgtgaggaaatgtctactttggacccttgataatggtgtttcccaggttctgtggaaattagaacatgtgttccctatggtgtctcaattataccttatcctatataaaatagttcatcctctatagttcatagcacttttatatctaagagtattctcctcacactagaaaaaacatgaatctccaatggcttaagtaatctgctttcatgattaatacacggtttcttcagggtgttaactcaggggatctgactataaatcttcttttcactacatttaagtaaagaacagaaatccatccaatgaacttggtccaaaacagttgtgtctttgaacaattgtcatggtaggtatttctcattttgaaaaaaagaaaaatagatgcaaaagaaagcattgcattacaaccgaagtctcatggatatttactgtgaataaccttggctggatatgggaaggagtttccaggtggttttgttcactcctgggaaatggggtaacataatagaagacctttatgcaattttaaatagttcaaatctagggtaatgcaattcactgtaatttttactggtcacatttactatggatcgtaaatgtagagtttataactttaacaaggatgcagtgtacttgacatttatagttcacagaaatccaacttctgaagaatccagggcttaacatgtttttttgatgggtttcataatatatcatatttgtgggtaaactgcaccaattttcaaattttaaaaaaatgctaataaagctgtttcctgggtaagttgaatttatctttccattagaatttgtcccatgggattgcagttctaatttttaactccaactattattttaactattagagttctagtgagaatatttttacatatctgtggatacttctttcaacaagaagatttctagttgacctaatttaattttaacatcctatttttctattttacctgttattatctcttcttctcagaattccaccctgaatgcacaatgttcacagcttcttagggttaataagaccagccggatgagatacatactattggatagagtaaacaagtaaacagtctactcttcctttttacttgaaaggagatgaatgtagataaatgtgaaatagtaagaaatttggccttccctgtgtgaaagagaagtagtagtattttcatcttaatacaagcaaattcattcatttttttcctctcataaacataaaatgcacaccaacatctgacttgatatatgcaccctattgatttctcatcaaccgcctagccttgtagggacaccagtggtgagacccattgctaacaaaaagatactaacttttagaaatgtggttagtagaaaaggtaataatctggacaaaggtgtaaatagcacatggataggatccctgagtgatgatgagaagtaagaagtaattcacaagtgtctgcaggtttataactgtgagaaggaaattcagtgaataaaataactctaaagtttgcttctagttctgcagtaagataaagaccatatggggctacaccattatgtgttgaaatggcttgtgataaagatacgagtgactggaaattttttgaaatcaagcatttcattctgtccagataatgaatccttcatttggttttggttaactgaagtaaaataaacgtgacaggaaggacactttaaataattaggccttggaaagagacaggcatcagccttattattcctaggctgtagaagtgaggaactgttggtttatcccttcaaggtgctaccatagtaattatttgactccaccttttttatttccttgtatgtagattcagtgtcacaaaagagagaatattattggcatcttttgagacaggtgatcacacagctaaggagaagatgggataagaccatggaattcccaactgatattgctaccaagctttcatgatatagaggagagcttgttttccaaagagaaaaaacaagtcctcctttaaaaggaagaggagaggatgggatgctggacagtgcaagtaacaaatgcccaatacaattcctatggctgaaatcttctgaaacttaaatgttaccttccattcatgtacttaataaagaaatggaagtataggaaaaaatgagagccaaagaaatcagagggggccgggcgcggtggctcacgcctgtaatcccagcactttgggaggccgaggcgggcggatcacgaggtcaggagatcgaggccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaatcagagggcagtgcttgtctagtggaccaagatattaattaagggtttttaataatgttaatttataattgtcatgccttgagatacgaacttggtaaggagaatatagtctatgtctttgagcgaattgtggtccaataaaaaagaaaaagcatttttttaaattcctgaagtaatatcagaaatataatcataaaattgtggacaagttaaaatcagagcaaacaaagtacagattctgtctggaaaaataagaggaagtttcacaaaataaatgaggtttgagctatggcttagttgaattatcacatactaattccagggacttccaaagaatggaaaactcatgtgcaaaaatacccaagcaggtgtcagaaagatgatgtgttaaagagatacttatgattggctcaaagtgagttgagcacagtgttcatgggacaacaaggggaatgaagtacataaaataaaacagaatataaatcctagaggtcctggtgtttatttttatttatttatatttaatccaaagagaatgggtagacaatgaagaatttctagaaatcattccaggcagaactcaagaactcaggagaagagcaaggcagaggaattctgctcgacttagtagggattattgaaattgtgagggccatattatttttcaaatattaaggaacagtgtgcagttcacataataatgctagacatttaggtcattaattccaataccaaatttttattcaccaatattcacatgacttgaggaaaaataagagcttgcacagcacctgaattagattggttgttagatttttttaaattaaataactaattcttcattgtattatattgatagctaaagttgaagaatcactttatcctttttgaatgcgtaacagattcagtgaagcaatctaatcatcctcatttgactattttctaaacaaacatcaatttgaattttaacatagttaagacaaaacaggctattttcactagtaaaaaagacaaagattttaattacttccagaagtggaaaattccttattacgtttgatgtatactaatctaagttattttgtgactatatcttagcttcctattcatagccgggaaaatatcctgaatgacctctctgtgagaataatccttctttaagacagcattgtctttttagtattttgccataatgaatctgcatttcttgcaagaatgtccggatatggtttcattaagccatatatatcatattatattagactgcatatgttattttatactgtattagtatctatgcagtctttttactaagggatcaactatactccacctatgttttcttctccttcattcccccctcctcttctaattctctttctccatccatcccttcttcttttttgaaaatgtgaatatattaagtacattgtcaatgattaaaattaagtgcacgtttggttaacctggaatcccagtgactttgaagatcacggtgttggaaagaaaatagtatgatagatgggaatgattgatgtctcctctatttggctcatatttggaacactattcaggaagagatactagaaatacagtgttaataatgtccagattctgcaatatatgaccaacagaagtacgaaagagaatagggtgaagatgagttcagaattagagactgatttctaactatcttttcctacacagaatttttatgtggagaccaggaaattactccagatcccaaacacggaacccaatacgttctgaatctgcctttgttagactaagggtagcaaagttgccgtggataacagacttgtggcattgtgagctacccagaaggaaaacttgtcttccaaaacgtagaaagtgagagagcagattggaagaagcctggaagatccttggctagcttaaccagtttgctgccacctttaaatatttaaaattgttttgagtacaacatgtgggagaagtagtcttaggagcaggacttcgtgccatcttacttcatgctggattgatactaagacactcatagttattttttacgtcttctattttaatttctcatgtgtgccttcctgttggtttagaagatgcctaatatgtcacctagctaagatattttgaccccagttttatctcattttaaaaactttttggcttttaaggaagtatagacttaggtgacatttttatttataaatgcctgcagttgtaacagaattcttctgaagacatgtaatcatccagcgtggcaacatagacccatctctacaaaaatcaaaattaaaattaaaaattagagtagtggtgtgcaacagtggatccggctactcaggaggctgagatgggaggatcacttgagcccaggaggttgagtctgaagtgagctatgattgcaccactgcactccagcctaggtaacagagcaagaccctgtctcaaaaaaaaaaaaaaataaataaataaataataaactagaaaaagatatgtaatcatcaatctcactaagtatacatttcttcattcttataatgattcttttatttttagtgtgagcccacttgaaataccagttgtacttttctcctttatattcacacatactctcttctgttctctatagtcacaccttgggaatcatttgatttccataaaaattattaatttttgtatccttgtttgcttattcaaatccttgaaataaactgtaaatggcaaaatagacatgatatacttcttgatagattctgaatgtcaacatcatgatgaaatttccaacaatgtttattttctttcacatccaatgacaaggccttatctctgtctcacctcacagcccccacctctgctcccaaggacttgacagtcattactagggaagggaagcctcgtgccgtcattgtgagttggcagcctcccttggaagccaatgggaaaattactggtaagcatctccactttctctcccagcatagctctcccttgtcctataattgcttaccccctacatgagctgctcctgcctttcgtgtggcattattctgtccctacatctcagctgactccatgaccctttttgattgtttcttctttccccttttgaccatggaattcttctaatggtgcacacacacacacacacacacacacacacacacacacacacacacgtcatttgatttgcttcacgaaagatgtgtatttcaattagaatagacctttttgtttttcattctctgaagcattaagaccactttctaatggagtgccctgagtataaatgtctataaagaagctggttgtttggcaattatgaaacacaaaagatgcttaatgactgtgtttgtgtgtgtttgtgtgtatggcacatacggaggtttggggatttttagtttctcacttaggttttagcttcttacttaaatcataaagttcacaaaacacttaatattgactgacagaaattgaacataatgaatatttcacagtgacagattttattttgccaaatattgctgataacatcaatgcctaattaaagcatccattagaagcctgtaatgttaatttagtatgaaaaatataatggagttctatcagagattttgcatttaaatgatcactttaggcttttaatagatgtctccatagcatataattattatgaaaaatattgtataactcaaaatgtgaacattatagtctaattaacttgaaccattgggttaggaacatggaagagtcactccttttttccttctttttttgcatacaagagctggatagcactattataaattaacaaagtaattcagccgtcccgtgatacagagagataagcatggaaattatactttcagaaggcacacttactttatgtaatttactttctgaattttgcaaaatgaaaagataacgtgaaaattccaaataggattgaaatttaagttgaaaatttgttttctctaggaaattgctcttagcacaatagcaaacagaatttttattcgagctgacaaatatggaaaaagaagtgaggcacaaaatttccccaagatcttatatgttcacttgtcagtgtgccaggccttttaaaactgagactggctcattccaattttctttttttccccctcattgttataatctcttttcattggttctatgtcagtagttgtgtagcttttgatttgtttatattttattttgttataatcaattatttataagcttatgggaaatcaacagtaataagtctgaggagaaaaaaacagaaagctgtctaaataaaaacaggttctgatagaaaaagatgtttttggcaaaggaaaaataagtcatattctccactcatttgaattctccactcttatttaagtaaatcttatcagtcagtgtaaacaatagaataagtttttaactctggaagaaagcttaattttgcttcttcaggaaaaaaaaaaaaatagaagtctagcccatattaagaaatgcaaatttgactgggcgcggtggctcacacctgtaatcccagaactttgggaggccgaggcaggcagattacgaggtcaggagatcgagaccatcctggctaacacggtgaaaccctgtctctactaaaaatacgaaaaattagccgggcgtggtggtgggcacctgtagtcccagctactctggaggctgaggcaggagaatagcatgaacccacgaggcggagcttgcagtgagccccgttcgcgctactgcactccagcctgggcgacagagtaagactccgtctcaaaaataaaaaaataaaataaaaaattaaaaaaaaaagaaatgcaaattaatctaagcaataaaattgtatatgccaaaatcacagtgcatataaaagaaactttgtccacactctttacttagatttatacgttcaatggatcttactattaaaaatccattctctcacagtggaaaaataaaagtatgggagacaatgcttttgcctttaaaagcctggcttatttatgaaaacaaaattgtattatcaagttgagatattcctactcaatttaacagggagcaaacaataagaacccttaagagaatttctgtgtcatgtgtattttgatttatttattcaaattacttccagaaaatagaatgataaaatattcaaaatactacaccactaagcagagggcacaaatttgctattctcagcttcctgtggaagtgcaacaattaataataaaaagtaaaaaaaaaaaaaaagaaatgagctctttctcagtgcgaccaggtagatgtgtgccaaggagggatgtgctctcatgtaacctctgtattgttttgttttcctaaatctttcatgtgtatggcaggcagtagagcaggatagttaagaactcaggcttctaagggagacacatgaggaagtcatttaacatccttgagtcccactttctcggtttctcacctataaaataaagatagtaatagaaccgcactagaataattgttgtaatacagtgctgagaaaagcccctgatacccagtgggcactgacacgaatcggctattattattccagtttgaaatccattctagggtgaggctttactaatgtgctttatacagaatccagatcatcagtttttaaatataagtactcaaaaagattaaacaaaaaaggaggaaattcagataatcacagtgcctaaattctctgatcataaactggaaacttaggaatttggactgacattttcagaagaaaatgattcaaaatacattaagcatttattatatgcttggcattcttctgagatctttagtatgatataaatgattacatattcctattattccattttaaaatgaaaagcttaggcctttcctgagtaaataacttacccaaaatcaaataagcaagaagtggcagagctaggatttaaaactcaggtttatactcttaattattacactatgttttgctccaatttattagtattctactggtctaaatcagtgatttgcagctgagattttaatttaattcatatgagaagggactgagcatggtaatttttaaaagcttcccaagtgacttattgtatagccagagatatgaaacataggcctaaataaatgcagtgcccaacactatttaagatctgagactaacacaaatagaagagttaggtctttcagagattgtttccttattaatacagtctaatatgtaaggttatattctctttttctgtgtcatttgatagcctagtttaatttgtctcccttttgtaaaatcatcaaaccacttttcttcccaccaccaggatatagcttctcagtctgatttgcagaaatttcttccacttgatattgctttccagaaggcagatctttttattccctttgttactttctctggaaaagtgtctatagtagagttagggattctgaggtttaaaaaaaaaagagaaagaggccaggcgtagtagctcacgcctgtagtcccagcactttgagagaccaaggtgggaggatcacctgaggtcatgagttcaaaaccagcctggccaacaaggtgaaaccccgactctactaaaatacagaaattagccagacatgatagcagatgcctgtaatcccagctactggggaggctgaggcaggataattgcttgaacccgggaggcgggtgttgcagcgagccgagatccagctattgcattccagcccgggtgacagagcaagactctgtctcaaaaaaaaaaaaagaaagaaagaaaaaagaaaaaaagtacaggtacagaaatgtagtgagaaaccagtacatttgttcaacctgtgtggttatatagaaatttataaggtaagcttcaataatgaatttattatctctcaaatataccaaacatacacatcccaatgaagttgcttgttttctctgaggccattttttagacttttgaatgatgaggtctgtttctattctccatctcagttcttaaattttaagaaaagggtaggcttcaccacatatataaggaatttgctcagatacaatttggaattgtcagaaactgatgtctgcaccttcaactttagtttgatcccagagctgtcatttttaaatgcttaagtgaataattttacatagattaaaaacatagtgaagacaaatattttatcatcatctgataaatgaggagactcgggaatcagtgcagttgacctgggatgggggcaaaattctccaattttccagtttcatcatgcacttaaaacagcccatgaaaatttttaacgatttcattaaatatctaaatgtaaaacttatgtacttacaggctaaaggatttcattcaataagtgactttcgatacctcttatgtgaatatgattttattagatttttggggggaataaaaaagtaataagatatggctcctgaactaaagaaatgtttttatccttttgaagaggtaggacatgcacataatagaatatatacatatatatatacaaattttatatatatcttttatatttagctgcatatatatatctccagtgatttttattctggatatatatatatatatatatatatatattcactattactctctctctatatatatgttcagtaacttttacatagataaaaacatagtgaaggcaaatatttcatatatatctataacatatttatcttagatatattacatagtaatatatggatatttatagaaatgtatactcagaaatgtgtgtatgtacacacacatatatctccagtagcagggtcttctttttaatagatgtggagatgtggatcttcatggacaagattggagactgctctggttcaaagaatatgaggcaattttattgatgtttatcatgggggctgaattacaaagggatggacacacatgagacagaaaacaactcctttatcaaacgatattcataatcccttttgaattttagaactccaagtttaatatttaacagacagaaaggtcatacaactttttaaggtttgtggaattctttatgttggtaaggcttttagtttcgaagctctcaacatctcaagatattcatattttcatcattgacatcacaacaaatgccaaaaatgtacagatcccacatatccattatgtccctgaccttgttgatcacagtaatcatttggggtgtagattactgaggttacccttgacctgtagtattagaagcctattgttgtatagcaatattatcacaaatgtagcagggtaaaactgcacatatttgttatcttatggtttttgtgagtctggaatctgagcacagtttagctttggggtctcttacaaggctgcaaattcaaatgttcacctggctgaggtctcatctttggtttcacaggggaaatagttgcttttaagcttatgtaattgttgtcatggctgttggccagaaaccaccctcagttcctgccacaaagtattctccattgggcagacgtcttcatcaaaggcgaaagaagagagtcgggtatctgctagcaaggcagatgtcatgatcttatgtaacacaattgtgaaattgatattccattgcatttcctgtcttctatcggttagaaacaagacttagggcccatctacataccgacagaaaggaatacacaagggcatgatattactagaggatgaggataattggtggccatcaaagattgtttaccacatgtattaaatcaacatatcctgtcttggggtctgtattttatgatctgtacctatccttcaggtaactattatgattacgcagatttgggaaataccaaacctaggggaaaggtgaaagtcaatacaaaatagatgtaagttttcagcattgttcaaaatttaagagaaatgggcttccagatgttggagattgtaacattgcttaatcctacgtaatcagaaggacaaaatatccagtgacgcatcccccaagcccaggcataattctataaggcactatgggattaagtgatgagtgatataaaatggcacatgtgtttttactttattgaagtgtattaccatgtttatggagaggagagcttgtgattgaggaaggtttcataggccagatataccttaaagtagaccttaatggatgagtaggatttggatggagtgaagaaaggtggaatggtgtgggaataagcgggaaggaagaagaatcatggaatggagaatagtcttcctgtagcgaaggtttgtgctgagatgtacatagtgtgcatggctattttctgagtctgagaaccctctgacataacccttaaccactgcgaagacctgtgggtgaaggtccccagtccagctgggacaagagggactcaaaaggaaagaataggtaaatcaaaggaagacacttgttcttaagaaaacgacttacaaagaatgtatttgatgcataaatagaatgagggacacttatagcctatgttatatagatagcattgaagaattgtggcagaaatggagatcagcacgacatttgtttatcaatgacacctatcatgagcgcctttacggtgttatctggcaatataatataaaagttgttgattaatgtttttaaattagagctaggtcacaaattggttaagtataatgttagagtataaatatgtgacaggaatccatgaatttgttcgggtgcatattagactatcatgactgagtacacacaactagcactcaagtaacatatcccctaacacagaaaatcaataatactatataaacataggttattaatatctgagataataactagatcatgtacagttatccagcaatacttatttctttgacaagctagactggactgggagaaatagtatactggtaaagaatcccatacatagtctggtggtaaagaatattgcccagaccttttaccaatcagtttgggtcacctgcagcttcaccgtctgtgaaaggaaagcaacaccgcccctggcaacctcactaagttgttacagtgatcaaatatcatttatttatattacactttaaacatgtatagcattttataccttccaatacatttttattaagcacaagccaaaataaatattgtttattttcatcattggactacagggaaaattatacagacttgttatctctgttttacatttttcatcatgctttcatattagaacaaactaataatcaggatttataggtagcagaaagcacacatttttaaatgtggcagatatttttacttctaacagcttattctattttctgattctgtacattgcagcaattatttatctaatccttgcattatgaaaaaaagacattacttacagaactgctgtagtttacagattgtggacatataataattattgtaaattacatttgggaaacctgggtgtttggaagcagaactgcagcgtgtaggacaccaaattaagtcacatttgtctatttatgcagcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaaggtttgaataatttcctattatgcttttcttttcctgtgggattgttataaaatagctttgcactctgtgttagaaatggccctgcaccatctctattagcaacatggctgcagtggacattcaaaataaattaaaatgtagctttttatgctcaaagccgacatatcaaagaaagatctgccatcagcacatggcaaacatatttaacatgacttttttcatttacagtcctgctagaagtttattgatgtcatgtatattggttctattcaaaatataatgaaatgcttcagccattttatgtaaggggataaaaattaaaatgtattgaattatgtgaatagcatactattgccgactttaggtattttctttcaggtactattatcccttatatattaaagaaaattttgatatgacaagacagaaagttccaaaccaaaaaaaaagtctatttattgtaaagaaccaaggtagaaactataaaaaagttgcaatatgatatctagaagaaaaaatgttcatacagagaaacactaaagctgaatagtagtgattacatcaaaatattttcatgtaagtacttactattttagagcacagtattatttttctgggggacaaatggtttgaagagtcatttaacaattgaaaataatttgaaacattcaaatgattacaataatttgaatgtttaattcatttaacaattgaataatttgtaataagtttcacaactaatatttaaagttgtatatttaaggcatgatatgtgttgttctaaagaaggataacttagctcttaaatctgtgaccacatcatacctctatatctggcagaaatcttaatacatgatagtaaagtaaaaaattagaaacacacgtatgattggcttcttctgtttgacatactaaaagaagagtcttagtataactgtatagcctattcctcaaatcttctaggaaaggtaccctagtaaataagggacttttgaattctgatgagtgagctattcaaaagctgggttttggtagcagctaatctgaaaatttgccaacaacacacaagcaagcattcagccaaagcttgcatgacagttcttaatggcggagtagaagttgggaggaaagtaggatagaaatgagttcatctttgtcatctaaattttgaggacttcatgtctaaatcaggtttcactccaaatgagcaatcaaaaggcaactcgttattcattttgtggcagcatgaaatgtaactagatagtgttttgcaaatgcttcatttttatctatagatgagtgccaaattaatttcatactcataatgtttgccaactgagagatctgaggaaaggttgaagatgacttaaggcatccaaatgtgttaaacagcagagtgatgagttatcataagatttgcaggcccacattgatagccatcccaggaattgtttaatgagctcagtatttcatttggtactgtttaccctaagtgccctaaacacatctagaaaactaagaacaagttcaggaatttgttctatgacataatggttcaaagagttatttctaataccctgatttgaagtttaatattgtctaccctaaatgtcatgctcgataatagtcaattctattttaaacacatgttgtttatatgctaaaataagtttttgatcatttaaaattactcagaaatattgatattggtcacttttattaataattttgtacatgtatacatcttacaagacacctacaatggcaaatgttctaagacaaataaattactcatcataagagatttcaagctacaacataagcattttaaagatttggtgtagagccaaatctacaccaaagataaaatcatgctattgctctctgatttaagattttcacttcccaaagctgcagcagagcatactgtgctcatcagaatgtaactttgtttgcctgagacaaaggcttagatgtcccgaagctgagaaaactcccagtactcactgggtaatgggcaagtatttcatagtaatgcttgtgccaggcaggtgtccacgaacgtcattccttcatatttagcctttgcaaggatcgcagcattttattctagaggctagcatttggtctttttgatattaacaaccagtcagagaagtacaggaaactcagtcaataatcactgtttaattaaaaggacatttgtaattagaaagggattatcttactgtaaacttatgtaggtacacatatatgatgtatctaattctttctttggaatgttaattaaaagaatcttgaccttgattacttgaccacataggaacctgcacatacccacctttccactaatcctccccagggtcccactgggatacatacacactgtcaaactattggaagacttatgtctatctctgccctatcctgtgggtttttcctgctgataaagcatgcttccccatgctggcctatcgggtaatagagaggaaggatgctcccaatggagtagaccacagaggattctggtggagggagggagtcacttcctacacacaaaagagtggtattcagagtgaaagcccaatagagtacagtaaattctctgggcatccttagtcatcattctgaaatgtgcctctcccctatccaagaatatagcactgaaagctttggaccagtatagaaaaaagttctagtcgtcaaattcttttatgacaaaaatacatgatttttcttgacaaatgatagaaacatatgatagaaaaaaatcaaggcacaaatgtaagccatttttgtctctaataaaaggtagttatgagaatccatatggtccctgttggaaaatactcttcagtagataacattttgagacattcaaaatttctcaagttctattcagtgcagctttgctagtagaaaaataaattcaaaagataaaaatgagaatgggtttgtctatcattacatgtggttatttatcccttgctaaaaatatcttagactgcagacaatgcatgtatatgattaaagataaagggcagacaaagaatggagataagggtggtagtctcgtcttttttgacataattctaaagaattctcacctaaatatgagatgctgatgaggatagtttcttaaatgtgtcccagtctggctgccaaacctacatacttcctggattgggtgggcacttatgaccttgacatatcttgtcaaggatcaggtcattcttgctggggacctgtagcacttccaacaacatactgtcctttctcaacagctgtgttaggatctcagttcaaaatcgtattcctgtccataagctacatataatgcaactgcctgtcaaaagcatctttatcaatactataataaaacactataataaaatgtatttgagaagccattaattttcaatgggaaacagaagagaaactctagataaaattaaactgtggtgattaaattaaatggctggtaaacctttaaaaatgtttgttaaatcttgacaaggtacaagatttcataaaacttatttaaagctttcagagagcaccaaattctaaccactagcccatcagagagtgtcaagataaataaattctgcagctctactatgcagcatagttcctataaataatataactgtattatgtacttaaaatttagtaaggtggtagatcatatactgtgtttttaccacaataaataataataataataaaatgggtgggaggaaactttgggagtttggggcaagtctgtggctttgaaggtggtgatggtttcataagtatatccttactctcaaattcattgaattgcatacattaaatatgggcagctttttacttttcaattatatctcaataactttttaaaataacgcttatagaattgtaaaattataaacattggccgggcgtggtggctcacacctgtaatcccagcactttaggaggccgaggcgggtggatcacgaggtcaggagatcgagaccatcctgactaacatggtgaaaccacatctctactaaaaatacaaaaaattagccaggcgtggtggcacatgcctgtagtcccagctacttgagaggctgaggcaggagaattgcttgaacccaggaggcagaggttgcagtgagctgagattgcaccactgcactccagcctgggtgacagagcaataataaaaatcctggtatatgtagtgtttcccaaagagtaattcacaattcaaaatctactacttatcaagatatcttttcatagaatatgtgtatatgttatgtttaaatgaaagaaattgtaattgatttctgatttagaaatcactcttaggatgtaatagacataaaccctgttcatctgaaaggggctttcgttaacagaatcaatatctacgtatttcagttctaaacattcttattaggcaatgatttgtgctgctttatttagaaaaagaaggaccaccacctgtagggcgtttaaggtatttttcaaatgatgattgatttgctataatagcgccacatctgatgagagactgtattatcagttgctgcctattatattttctctatgtgaattttactgagacatatacaggaagcaatcggcaagtgttgtatcctacctatcaagtttgaatggaatcaagtgagttaaatacgcccaaaagactcaaagctcaaagacggtcaagtctaggtaaaaataattctactagtaattgagggagggaagcttatgaagatctgccttggtcaaaatgccatgtaattttcagaaatgtgataatactagagatttacctcttatttagtttcatctggttagcagaaaaaaaaagtcatctttaaaacaaaatttagcaatttaatttttatatttttaaatttaaatttcaaaaagtcatttttgagactattacttgtaagtcctctgaagttgtcaacaacaactcaggagctatcttcacaagggctaaagtttatcaagatatttagattatattgtaccatatttatggttgccaattattttacccagtctatgtgagaattggtgaagttgtttaaaaaatagtcacatacaagaaaatagcttcctgaattttcttaaatatatatatgggtgataattacttggtaattgcatgcagtttttttttactgttaattctagttttaattaaatttatataattgttctcagtttatgtttagagggatatgaaaagtaagataattttaggatgaatttgtacagcaaaaacattattttcaattttttttctctgaatacttatttaatagaaataaacatgtaagtttgggtccttatcaattttatttcaagagggcactagctttgaaataaaaacttactaaaaagaactgttggtttgatatgtcagctttcttgctaggaactgtcaaagtctaataatgttatttctttttcccccgcagtggaacaccctgacaaaatggctaatgaccaaggtatggtggctcaatctgtcattttgtgttccttgaatcaatcctgtctgttagacatgtcagtcattactttatattcctcttttcacctggaccatacacctgatgaagcagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgcacttctgaataattcacattaagtataattaagctcagcataattttcaagctgctcttgcaccctttcctgagctatggattaaagttctgtagctctacagagaaaacccgtaaattatgtgtgattttcctctgcaatgagcttcttttaatatataaaatcaaagttgggtcaccttttttagggcattatcattgttcattttgaagccagaaagctcttattcagtgaatcagatgctcatttgactcacagcacagtattttctcccttttccttatttatttactaaaagctgatttgtatagagaaacaggtaaagttttacacaaaggcaaaatggagataaataagagttatccatcaacttataagtggatatgaacttactattaccgtgatttgtagactgattgataaattaggattccgttatctttacacaaaggacaattagtagaaagctgagggagacaatgaatagtttatgagttttatttttttgaggatgttactttctttccagaagagttaggaaaaactataaactggttgtagtcagtgctgtcagtatttgtagattgagagtctgcagttcatatagtttgtttccttcctgctttggacacctactgtgggcagtgcttacttgcaaacgtgtctcataaggcaccatgtcgtgagattaggggaatgctttctttcaacaggaatactttttaacttttgacaaatactaagcctctggatgctggctctccctgacagcagaatgcttcctgcatgagtagcattttcttcagtggtcctgtgtttacattcttctctggcgatgtatactatgcagctgcttaacagaacatggctaggggtttacgtggaataattgaaatgggactgtgcacagcaatggctactcagggttaaggttttcattaatctagctgctcctacttgcttccactgaaaatgttttcatacaattaatatctactaaatgagatttgtaaaaaatattaatgatgagtaattatcacttggcatgtatttacataggtaacttaaatattagtcttggtcaaatccaaatctggaatagttaatagcaccagctttattattgcagttataaaacaattgaaacaacctctcataaccttctttacttaaataaatttgaagcttccgtagacagataactcctaagttttgaaattatattttaaaataatagagaaaaagattaaaataactgaactagttgaaatgtcattattagtcacttagttgacaacaaacatgtccaggcttctcaataaatggctttccacttctctctgggtactattatattgttttttcttttgttaattgcttttagttttttaaggtaactgttttgcataatattattttaaaccaccacacatatattctgtaaattgattattttatgaaaggcaaatgagtaaattatttcccagtccctatgatcacacatcctccatggattttactttgagtctcacatctacaataaatcaggctagttctcaggaacaaaaggaccccctcaagaattactgccagtggctgagtccattaatatatttagtcagttgttctttttcttcatctaatattactcagaaggattctgtcacatatgtaacttggagccatattcagtcatggttggcatgtagttagttgatcaagttgataggttctaaattttacatcaaactcaattcacttataaaattgagagggactgatgacatataatttagtggttataaataatatcttcaaattcttacaaagaaagcatataaaatttgctgcaccctcaaagcacgttttataaacaaaatcagtcttctgagttgatgaccacatgcatgagaaataacccagattaaagatccctctaagattgatgaaaataataggaagaggctgatcttaatactcccattcccagaacacagcaaattagttgaatatgttttaccattcccactgttagacctatttgcccccttctcatggagaaatgatcccactattacatttatgacaggagctgagtttctgctgagagaaaattccctcagagaaaaaaatgtggcatctggggtcagaattaaccttgcaaagatgaatcctaaataaagaagcaagaggttgaatttgacttatatgagagaaagtgagaccagttttgattgtcctaaaaaaagtatctgttcagattcttgtcacaattattattattttagggattgaagatctgccatgaagaacataaatgtgaaaacaatagtcatttgaaatggttttgatttggagaaaatattttcttctgagcaatggtatagtagttgtttgacaatgataggcaattaacatagaacccctgatttctttatgtaattgtaaattgatgaaatatagcatttttaaaactttctaatcttgaccacctctataattctccttttttgcatcaccctatctcttgctccatatcctaattatttctgtagattcttccaggcacaggtggcaaataagttgggaagtaaaagaaattttagagataaaccagagtttcgttttttgtagggttgggtaaggaaattgcacaggctctatgaagcgggtgcagaggttagatagaaaatctatgctttaaaaattatttttaatttttgtgtctacatagtaggtgtatatatttgtagggtacatgagatgctttgatacaagcatacagtgtgaaataagcacatcatggagaatggggtatccatcccttgaagcatttatctgttgacttacaaacaattccattacactgttcatttaaaaatgtacaattatattattgactatagttaccctgttgtgctatcaaatagtaggtcttactcattatttctaactatatttttatacccattaatcatcttcacctcccctctccccagccccccactaccattcccagcctctggtcaccatccttctattctctacatcgatgaattcaataattgttttgatttttgttttgacttttgattttttccctttttttctatattctgattaaaactccttcaatttgtctgtgctgttgtgggcctatgtaatggtaaaatgaaccgctatgcagctcttgccagcagtcactgttttaaaagctttacaggagtgactcacttaattctcgtaacaatactgtgagaaaggtattgtctccattttagcaaggaagaaagtgaagctcagagagatgttatttgtctattgaaacacagctagtaagtagaaaggccataaatccaaccccagaaaccacattccaaaagccttttttttttaattattctatttttatttattttttttaattttttgacacagaatctcactctattacccaggctggagtgcaatggcacaatcttggctcactgcaacctctgcctcccaggttcaagcgattctcctgcctcagcctcctgagtaactgggattacaagtgcgtgccaccacacctggctaatttttttgtctttttagtagagacaggatttcaccatgttggccaggatggtctcaatcctcctgaccttgtgatccgcctgtcttggcctcttaaagtgctgggattccaggagtaagccaccatgccccacccaaaagccctgattttaaccatcaactgcatgacaacagatatgttacatgtatatagccacacattcacattcgacgtatagctataaagttgctttaactgaagttttgtttgctgttatttgtcctatatagatcttccttttcacatctctgaatattctaaagaacaagggaaataactctcaatctgaggtcatcttgttagtggggtggcaacagcgctgattacatgatcctgacacttctttatttcaggaaacagggatggtgataattcactgtctaagccagcttgggttgtcaatacaaaacgctatatactgggtgggttaaacaacagaaagttatattctcagagctctggaagctggaagtcccagatcaaggttcagtgtggtcagtttctggtgagggtcctcttcctggcttgcaggtggccttctcgctgtgtcttcccgtggtggagagtgacctctctggtgtctcctcttcagaggacactaatcctattggattggggccctaccctatgatttcatttaaccttatgatttaattacttccataaaggccctatattcaaatataatcatattgggggttagagattcaatatacacatttttggggaagcaattcagtccatagcatccacatttaaaaagaaagctgttatttcactccttcactaattttttcccagtttttcagaagcagaaggtaaacattttacccaggatcacagaattagctgttggcagagttagaactcaaaacttttctttctggttcctagagtgtgcagtctttctactgtaaatggttactatatttaaacatttgatttccattcttctaaaatcagctccaacattttagtgtctcacagaagcattttagaaaatccctttgttttgagtttgcaatggaggttagctgtaactctgaaacatgactgcttcttaaaagtgattattagatcaaacttttaaggtatttttgtttgcatcgttatgtcccatttaatgtccaaatattgttctccactttgagatgtctttgtatgaaaatcgatattcttagcatgagcagaaatgtttactctttcatgtgtgtttctacgtctgctcattgtaacaataggtgctatggcgatgatacagtaccttaaagtgggcaggattctcatgaagtgattttcaccattgctgagatgaattacaaagaaaatgctcactttgagcactctcaagtgtatttaattctccatgacctggaaaaggggtgatctgaaacactagacctagagaagaggcctacgtacatagggcagtttacagatccagataaagacagcctgctgtaaactgcccgcccaacaaggaggaagaattactctcctgtgaattgtggtaatggctgataatggtctagcttttcatttggaagtcactcagtgtgtgctataggagcactggaatggaattagatactttcagttctagcacagtcctgccactgggacctcttgtgtaatgttgggcaggtgacttaacatctctcaacatcctcacctgtaaaatgataagttcagactaaattatcttttggtttctttcaagatttaagattctgaagttttaaggttggtattagaataaaaactcaggcataacatctttgcatagtgaagcatctcacatttatggcttttccactatgtgtcaattactcttctatgcattgtgcacatgcaatcctatttgattcttatagcacccttacagatgtagaaaaagagacagagaggttaaaacttgcccaaacactcacagtatgtaagtggtgtgaaagttgattatacaaaatggagtcactcatgtcatacccaactaaaatggagtcaggaggttataaggaaaagcactcagatcacatacatttattccaggaactgtcttgtgagactaaacccaaaacttcaaggacctggtcatgattctaagattccacatcttacttaacacctgctgacactcagcagctcctggaagacactaccagcaccaattaacttactttcaaaacaacttgcataaccttcctctattccacaataaaactccgcctttccctttattctctagactcacctggggctaccttggtttgggtgtcctgaattgcaattcatattctcaaataccttcttcgctcagagattcacctctatgtatctttattttaggttgacagtgattaggcccagatacatacccaggctacctaactggagaatctctgctcttgacgttgtgtaatttctggaaatgcagactcatgatctgtcatcaagaaagttatacctaaatggcatcaccataagttcacctagtttaaaggactttgtctttccttaatagggtattcaggcaaagtacttaacactgcacctgccattttacacctcagcagttttaatctcatgaataaacagaatgttaattgtttcaaatttcagggaaatagggtttttgaggcagtctagtcaagcttggaatttagttaatgtaatccagactttgcagggtttggattacagcagccagactgccgtttgaaaaatggaaacctttagtgccttctgatgggagctgtttaattgaaaattaaaacctcttcttaccctattattgtgcatagtttcaacacagtttattattcggctgcttgctacacccacttgaaaaagctattctcacctgggtttttcacaggttcaattctgtaaattaggactgtggtgaaacagtagtagcagaaaatgaataatgtgcttttaatggagtgttaaggtgcttatcatgttcccagcaagcagtcaagtagctgcctatgtcaacttctcagcagttttcatgttttaataggtaactctgaaggaacaaaaacgtactcagtactcataggaattgatgtgattcatgggataattttaaccttctcacacctgtaaggtagacatttttgtttatacacttcaaataaaattccataaacaggttcttcttgtaagagccactgtattttggatgccatttccttgtacagatattggccaagtacacggtcttcctagctttattttctgcccacttcaatcagccctagattctgccgcttcaattttctttccaaaacagatgggtcactgttgctttggggatgagtcagttctttgacatcaagaaccttggctatctgactgtaacgtctctttcctggtgtcatggccaatagatccctccacatatgccacaatcacaaatcaccctggaaaaagtgcatttttcacaactacatgctgtaatgtgtaccattttctcagccttagctgtgctttctctctttctcaactaagcaaagtcttctttgagactcccttctcaattttacttttttcaagaatcctttcttacctttcttgtcttttattcacctgtattttcataacacccatcctatttttattgtgttttccatttcttcttatactttgctatttatattcttagcttcttgaccagattttaaattcccaagaacagagaactggctagattcttcacattgtcatccctacctccctaatttagaatttatcctattttagttgtctgataagtgtttgtttaatagaatcataacacaaatgtttggggaagcagctacagagtaatctggaaagataagttttaccattgaatgaaaagtgtagattggacagctcaaagtaatagtgcacatggctgtgtatattggagatttactgatcttgggggagacgagaagttatgcatatatttccaacaggaaaaagtatattcaataatcacctactaaaataaatgctaaatagaaaaacaagttctctgtaattcagctgatggtagttacatttgtagatggctacgacctcctgcactcattttgtgacctccagtcttgctgtccttccttgttagcagaaaatttatagatttgaatttcaccagctgcttggaattctgagtacagaaaggagaaaatcaaaactaatggaagctgataagtttgttaaaattgtggctatgaagtatgaaaagaactagactcacttttgataacttgtggattactatgtatccagtactgtgctggcactagaaacattagaaggaaatggtcctggcaaagcattagaaggaagtatggttccgtgggtccattttcaagaagcttgcaatatagttaggaggaggatattaacacttccagtccagtatgaaaaatacaaaatgccaaatcagatggtactgtctacatgtgtatgttacgggatttcagataaatcattgtgggctggattagaaaagacttcttaaaacctaagactgggctttaaatatatgagtagaactagactcaatgcaaactattaccgggggaagagtagctgatcccttatgtagagaaattctaggatggaaaagttaggaagccaagatgctgggaaaatagtgaggactacaggatgggctccaggaacatttaggatataatttgctcaggcacaaacatatctcatgcctacctttgcagagtagtaccttatggcagagacctatgttggtgaagaggcttttgctatttctctctgctctaatgtagtagttctggggctttcctacttttcaacatatcagctagctattgtctacactggccagtgaaggcctgcctgctcccttgtatcccgagccctggaaacccatccactcttggttgctgatattgatcatttcctgcttggaggggtgtgactgtgggatagggagagaaaaggatgatgggatgggagtaggaatggggcctcagtagcagtcatcttcaaagaattttcttggccttttttttttctttttaaccacttctgttgtaccttttctgaagtggcaacttcactttttccagtactctgcatggttacaaggaaactatttttcattctctgccacagccttgttttgttctgcatgttcaattgagaatagagccaccatctcaagtcatacatacctaaactctcactcttacaccccaagaccaactctttgaagtgctctaatttctgtccacaattttccccgtttctcctctcttttttttttttttttttttgagacagagtctcactctctcacccgggctggagtgcagtggcatgatcttggctcactgcaatctctgcctcctgggttcaagcgattctcctgccccagcctcccgagtagatgggattacagtcccctgccccactatgcccggctaaatcttgtatttttagtagcggtggggtttcaccatgttggccaggttggtctcgaactcctgacctcaggtgacctgcccgcctcggcctcccaaagtgctgggattacaggaatgagccactgctcctggccccctattccttcttttagttatttattcacctataatgctaaaatcatcatcatcagagtcatacagtatcagccacttcaaatgaaaccctgtgtttattcatctttctgagctatagttttctcagctataaaatggggttagtaatgtctgcctcagagatgcataattaatattgccatatttattggaacagtttattctgatccatttagttccacagtcatccagaataatctttctaaaatatatgtgtaattagtcagagttttgcttaaaatatcttcagtggatccctatcctctataaaataaattctagaccattttgcagagcatttagggagttttattattgtacctctgccttttttttctaagctcatccacctcacggttctctacctaataaatcaagacagatctttatctgtccagctcctttggttccctaatttttgccttttcagtttttgtccactctcccttgtgagacatcaagaatgtgggaatgagaagtactagaattcacaggagtaaccaatgtgtttcttaaaatatatatgtatgtgtctgtgtatttatatatttatatataaatacatatatatttatatattacatatttataatatatatttataatatatattatatatttataaattttatgatatatatttataatatattttatgatatatatttatactatgttatatatcatatatatttatgatatatatttttatgatatatatttatatatttatattatttatatatttatgtaatatatatttattatatatatttttatatatgtatattttcccccactggttggcctggcaaagtatactgcttttactttggtgcttgcaaaaagaattctcacctcacatgccacctcctctgagaaaccttttgctaggcataagtagataatcatcctgtttttccactgggtcacgtgtttgtttgttttcttttttttgaatttttggaaattaccatatggttgtaagtattcacttaacattttccgtctcactgacttacaaacttctgcaatagtcattttatattcctaatgcttagcactgtgaatctacttaatgcatttgttgagtggatggatgaagcacggatggagacataaatgatgaaatactgtgctccaacagtgtcgttatctacacagactagcagggcaccagcagggtgctcatgttctagtgttttcagactgcagctgcaacttccagatctatagtcacttggaggagagaactctctcatcctcttctgcctcttcttcccgggatgcttggcaaatttgctcaggcacaaacatatctcacacctgcctttaggataagcttgtgaaccacgcagatgggggaggcttttatggatcattccgtggcctttgagaacagatgctcttttataagccaaaaaagattgtctcattctttatgttgtagcctggcaaatgaactagctcttggaaatatctagtcatccaaggcagtgcccatatttggaggaacagaatgctttttagattttaataaagactaagctgcatataaaagtggtttcttagacccctaggatgactgttacttcagatatactagaggcaagtgtgcataaaaggagattccaatgacaggaaggacttcagagaccaccatctaccaccatactactgatattatgaagccatctttatgttttattctattaagaattcaattgttattcagttgtttcattcctaacttgcatgaataataattataataactaataaacatattgggctttagctgtgtggaaggttgtgacaagggtgatcaggagcagctgacaagttatcagcagccgggcaagggagatagtcaagtgtagttattgtcacataggttagaacttatcatcttttctcacctgaaatctttaagaaggaggttaactactttcctgttaacaaaagatcttgatctgtccagctcctttggttccctaatatttgccttttcagtttttgtccactctcccttatgagacatcaagaatgtaagaatgagaaatagtagaattcagaggagtaaccaatgtgcttctaaaaacagaaatatatataatatattaatatatgatatataatatatatatttctttttatatataatatataaatatatacatatataatataataaattatatataatatataataatataatatataatataatataatatattataatatataatataataatataatatataatataatataatatattataataatatataatataatactataataatatagaatatatcatataataatatattataataatgtgtcatatatcatataatatattataataatatataatatataatataatataataatatataatatataatataatataataatatataatatataatataataatatataatatgtaatatataatatagaatatataatattatatataagtatatataattataattatatatataattaattatatatttaataatatattatatagaatataataaattatatagaatataataatatatagaatataatatataatataatataatatattgtatataatataatatatgttgtatataatataatattataatatattgtatataatataatataatatattacatatataatataatatattacatatataatatattatattattttatatatattatataatatataatatatattttttatatatttatattgtatattttatatattttatatatttatgtattttatatatatataaatatatttatatatatatttatatatataaaatatatatttttatatataattcatatatatttttatatataatgtatattttatataatatatatttttatatataatgtatattttatataatatatatttttatatataatgtatattttatatattatatatatttatatatattatattatatactatatattttatatataataaattatatattatatattttatatataataaattatatattatatattttatatataataaattatatattatatattttatatataataaattatatattatatattttatatataataaattatatattatatattttatatataataaattatatattatatattttatatataataaattatatataacatattatattttatatataacatatatatattttatatattttttatataatatatattttatatattttttatataatatatattttatatataatatattatatattttatatataatatatattttatataatatatattttatatataatatatatattttatatatatataaatatatatatatcggttggtctggcgaagtatactgcttttacttgttggcctggcaaagtgtactgcctttactttggtgcttgcaaaaaataatgcagtatttgtaaacgtttttcctactttagaagatggtctctgcaagagaccacatgcatgcctcagacagtcaagacccattatcaggctaagatgtaaaccaagagcagaaattaggataagaaattaatttgtttaaatttgtctaggatacccacagtttctattttgtatcctggtattttttttgtaataactgtatgctcactcaatttcattttattcgtgtgtgaaattattatcttagttttgaatttgatttctaaggatttttaaaaaatgaatttacttctcaggaagagtctaacctgttcatattttatggcctaaatacagaaattggaattgcaaaaatactactacttatgattaagagaaatatgggtaatggcatatttggttttcttgcactttggctcagagtagtttaccaaatgcattcctatcctgcagattattgcccttagactttccacaggtggaaaataaaaccaaaggttttgaagaagggaaagcagcaagaatttgtagagcaccagggctcaatattggacaggcatagcagtaacaatgtattttctttcaatcagtgaactttctttcatgttgttttgaaaacaatgtgttgaaccttaggaaaaggttaagagagctcattagttcttttctattaaaatatttgaaatatcctacgtgttggttatgattttgctttctggtttttgatgcccgatgcctttgtttaaaatcagcattgttatcaactgcctggtaaaccgatcttttagaaacacatttcagcctctgacaaatcacctactttaaatacggtctgtgtgtcagatggacagtaaaattatattcaggtaatattaatggatattctttatctgctggtatacaagacagaaaatcaatgcaatttctatcatcattagaattattttcagagaacaaattttaagatcaagaagatatctcagtgctcagcacccttggaaagatatacattgaacatttgttagatggccagtctgtccatttgatttagattatggacaatacgtttttctctagggattgattgtatgaacgtcgtcctggatgaccctctcttatgcccattcagggaagatggattaaacaaacgattagaactaccacatccacttttctccatgtcttctgcagattaattttccattctctcttctctgaacttataaacaatcacacagaaaaactagactctaggactgaaatcccaattgaattaatctttgttcagtgctgaaaattttttatcgtggaaaagattctcaatctgcccatgtgtgctgcaaataaggatttaatataaacattaatgttatttcattttatacgtacaccacaataaaaacatgcaaataattcaggtgacatgtaaggataataacataaataataaattgcataatagtaataacttaagatttgtacttattattaaaacattacaaagcatcctagctagcattagttactcataggacattgagaacacatttttgcacatcacttcagttagcacaaaggaatataacaatgaacagacttcctaaaggaagtcatattacttctgccaattttttcttcaattcagagaacaggtagcagggagatcaagaagacttttgtccaaggaagcatatggtatgtgccaaaaagggataaaaagaagattccttatgaggcccatcttttaaataaaatgtgtaaggcaaccccttaaacgactttatgacattttaaaaattcaaagaaaggagaggtatatgaaatttctgattaggacctgcctaagcattacctaaataaaatatatttaaatatataaaagctattttgaataactcaaaacagctacaaactccctctgttttaactcagccaatgcccatttaatatttatttaatttttgtttctgaagctaccatttcctggttccaaaatctaaggtaaaagtagaaaatcatttgcttttattatcaaaactttggcagaagctttttttttttttatgaaattagctgcataaaattccaaagttgttaagtgaaaatcaattaattactctttaatatctcattcctccccatcctcaatttgtgttattgagaaaatatgggtacatagtaatccaatacagaattcttctttatatcctgtagaattatattcatatagtacactttgttttttgttgttgttgttgttgttgttgtttttttactgagccagagtcttgctttatcgcctaggctggagtgcagtgtcgcagtctcggctcactgcaacctctacctcctgggttcaagcaattttgcctccacctccagagtagctgggactacaggcatgcgccaccgtgctctgctaattttcgtatttttagtagagacgaggttttgccatgttgcccaggctgtcttgatctcttgacctcaagtgatccaccctcctcggcctcccaaagttctgggattacaggcatgagctaccgcacctggccttcatatagtacatttgatcactattcatataaaattgtattattcatataaaaaggaaaaaataaactactgatttctaaaatgctttaagccatgttgaactttatttgagggaagaaaactgaaatttattacgtgatttcccccaaatttatatttgaatttccataaatccatttaattatttagaattttaatttgtaaaagtgttaaaaatttagtatgatatgcaaaaaagtaattcaagattttaaaataaatataactatgaaacatataaagttatgtgactgaaaataaaacatttttatttgcatgcagttcttttaataatacttttgataagaatactttaataataattaaaaagcatttttaattaaacctagtagtaagtttatagtaataaatgaattaagttattcttaaatctttaatgtcagaaaatattaagaaccatctgcagttggttaatattaaccataaataggcctgcataggatctgattacaatgaaccaactctccctgtcatggcaggatccatgtctaatatatctttttatactactccttccctgaggatctaggactatgcgttgcatgtagtaagcatttaataaatgtttgaaagaattattaccagttttatgcttcattaataaaatgacctctgggatagggaagtattttatatctttgcattagctgactttcactccagctgttttctaaattctgattactcctctctttctcgaaatcagtgcttatgaaattaaccaaggtaactaaacacatccaatatttgttctacagcaacaagctcttaaaaatgctgtgatatgccaagaagtaacacccataaacccatatcctttcctttttagcctttattgtctcttcatttgacaactttgtgatgctctccttaaagcaatgggagaatcttttatcattattattattattattattatgtattggccacataaagggagacttcctgaaatttaaaagacatatttcagagaatggaaacttaacatcactcaaaattaaaattaaaattaaaatctgatgcctctgtctttagatcaagagatcttaggctcatcaacatcccagaaatgggttttgtggttttttggctgaagtggtgcaagaaatgtgaatcactataaatctaaacttgctcgttggtgacatcaactttttaaaaagtgctttctgttggacttgttgagaattacatgatttccttttgtgatattaatctaattataagggacaaaaagttaacccacatcaatatactagattctgtgagtagaatgtccaagctttaagctactccttgttatttagaaacatttctagagttcctttatctcacccagcgctttgacctatacggcatctgatttcttctacctattgaaattcacgatgtaatcaatagcctcactaaatctaaggggtgctgtacccatagagctatatgtgtatgtaatatatgaatatgcttattggcttctttttgcatcctgccacaaattacagggagagttggaaacttcattaaaaagacatttgccaggctgctggaggaaaaggaaaatcctccataggctacctagctaatttccagccgatacaggattattcccaacaggaaacatgtattgctttactggcctaagtgatgatgttagcatctcttttggctgactgctttgcaatctagctgctttcagttgctagaaaagtcatcttaatatttatgtagagcttccacctcacatcagccaacgttgatctcacgatgtctcgtgggcaaagcttatccgctgctcattgaaaccccaaatgcatcacagttatataaacaaggtatttgtaaaagggttagacttgtccacatttttgtcagcccactaaaattttcacaatttcagctcattttgattgttcctctcaccaccaccttccccctgtacacacacataggagcctgcatcctatctcctacttccttacatactcacagtcattgtcccagcagatattaaacatgccgttttatgctgaagatataatataaggtgactgaattaatttatcttattgcttgctagaaatttgacatcctaacttcagctgtgacttgatatcaaaagaattttttaaattgtgaatatagagtcagttaacaggattctaagttgtttcttgaaagctgttttgcaaataaaatgataaaatcttgggaaagctttagtaagggtagtgtttgtcatgcaaaataaagtcacaaaaccaggacttgaaagttatagagatgaagaaaactgaaatctctaaatgtgagaaaacaacctatgttactgtatctgagtgtcctggttggctttctctatgtcatccactgattggaactgctttcagaaataactgttttaagcaaataaaatagaaaattacctatactctggtctttgtttgcatacagattcacctctcaaatgttttacataagtagtctacctagatattctagaactcaaaatctaatcaaatgatttcagttctatgaatgcaccagtagagaaaaagattatctgtggtgaaacaccattaattaaattttggatgatagtataattatttctggtgaattcctggcttatttctcttaaatacggctttcacatctgttacacacctaatggaaggcagaatttccaataatgctatactgaaggagctttcttccctttatggtgtatttgtaggaaatattcagaccatatggtttgtgacataacctccactcttacttccaatgtggaatttcatttccaggtactgtatttgacacctaacaaagagaatacccaaagcccagttataagatgaaatgtgctggccccttgtaggataacaataattttccataaagtcttgtcagttgggtgacagtatctgcaggacctaggagccaggacctgagttatttctgttctaaaaggttcaggagaatagcatttagaccggcactgctgctgcacctttaataaaagactttaataagaatattgggagaaataaaaagaatggaggatggcatatcagtgaaacactgaatttagtttaagagagtttacttttgcgacttgtttttctcacacatggaaaataacattttcttataggtgtaagggtatgagagttgtcaggctttcttgggggtgatcaaagtaatctgttctgttattgtgtgtgttaaaatatttattctttttgtcttcattttgtttcatttgtactgacattgtgacatgctctcccaatgaacaggtcgtcatggagatggaggttattggccagttgatactaatttgattgatagaagcaccctaaatggtaagtatataaattaggtaatattgaattagttatattaattaaatggttaattcaagagtgtctggggcaaattttctatcaactacaagtgccaggaaccttggatttagtgtcttagtgggataatagaaacatgaagttattaaaaaacaaaaacaaaaacaaaaaaaacaaaaaacttctagcacattctgccaggagatgatgccaataagagttgacaggtatgtaaaaaaggagtcagttagagaagcccagcatggagcactttgtaaatgacacaaagctgttaaataccaagatttttaaatgttacaatacatttaagatgtttgcaggaatctaattttatttgagagaggtgatatctaaggttggttaaattgaaacccacccagtttcatatattaaagttacttggatttttgcctgcagggtacatttaattcttcaaaatcctctaccatcttagggctaaattttctttgtgttgtctacattagacatttatttctgctcatcctagtggagcatgcccaaatatctgctggctttaaggatgaccagatggaggtactatctagagctacatagaaggacaaggttggtgtgggggctgcattccaggatcttatccttagttttgctgaaacaaactttaaaaggatggactaatactggccaaattttcaggggactaatgtatgtatgaggccatgttataagtttctttttcattattgctgttgtttggtttgacttactaaaaagaccttcagatattcaaaatgtgaagatgaacacttgtatacccatcagcaaggttaagatatgaaatatacagcatggaattgaaatatcttgtatgtctgtgttttctcacatgcttcttaacactgttcctcactctgatataagtgctctaatttgatgtttactacgtatgtatacgtatccctaaacattatattgttttacagttttacaaatttatagaaatgatattgtatcctgctacaacttgctttcttttttaacgtagttttgaagatgtatccatgtgtttacaaatagctctcactcatttatcttggctgctgtacagtattctattttatgaaacaacaaaattaaccatttttgcaggttttcttaagaaacttgattactgaactgataaatttccatttgtttgatctccttttaaaaaatccagaaaggaagtcaaaattccaatctaaaaatagtttgctgcatgtgaaatagaatagtggtgtaaattaagtgattatttcttatcataggctgtgataatctaatgcagcaattttcccaagaggatatatatatatacagagtacaccaaatgcttgcatcaaagacttagggttatctctcctctggccaatggtagacttagaaatatattttcacctcttgacttatttttgaattgcctggcaataccttcctctgttattaatgcctttttcctaaccagcaacacgtagaacgtcttatgtttaaactttgagtccatttctgctgctattaaaaaataccccagatttggggtaacttataaacaacagaaatttattgctcacagttttggatgctaggaagtccaagatcaaggtgccagcagactgggagtctgctgagggctcattctctgcttcacagttgatgccttccagctgtgttctcccatggtgtttggaaagggtgagcaagctccctcaggctttttctaaaataagggcactaatcccgtttatgaggccaccactctcatgacctaattatctcccaaagcctccacctcttaatgcctccctaacagggattaggtttcaacataagaattttggaaggacacaagcattcagaccatagcaagcttcccaggatgctctttccaggctactcacaacttcctattgtctcttagactcctcattttccttcatttaaataacatgactgtccctggtaggtatttgactttcagacacttgttttaactaacaccttgctctggcagtccctaacatacccaacaggtagtttaggaagcacacagggctgggtgtggtggctcacgcctgtaatcccagcactttgggaggccgaggcgggcagatcacgaggtcaggaaatcgagaccatcctggctaacacggtgaaaccctgtctctactaaaaacacaaaaaattagccaggagtggtggcacgcacctgtagtcccaggtactcaggaggctgaggcaacaggagaatcacttgaacccaggaggcagaggttgcagtgagccgagatcacaccactacactacagcctgggcaacagagcaaggctccatctcaaaaaaaaaaaaaaaaaaaaaaaaaaaagctcacagaaggtgagaggagggacttgttgagacagaaaacagaccccaggccatgctccataaaatgggcataagtaacaataattccctcctcccaactttgcaatttcattagctcactctcgtgctccaaattttatcttaaatttcaacaataagccaaaaacattatatgtattcaagcagtcagtcaagaaatgcgactaagccctcagcgagtgcagggcacttgcaatgagctatgggcgcaaactgaaggacagaccactgcaggaccaatacaccaagagggttaattgcctgggtggacaaagcagaaatatacaccccaggaagatgaaagaggatgagaaaatccctagagatatatagcagggtaaaaaaaggaagttgctgaaattgggagaaacataattgttgtattttataccctgagatacagagcttctgactttggagttcatgcaggaaattagcattgtcccctttagaatcatccaacagagccaattttaagaagctatttctacaaggattttcacattgaaattcattcccagtcaagggaatactatctatactggtacgggacagtactttttgaagagacatactgccagaaaattaaagagggatttggtatggatgaatgagagagagaaattaacctataggtttcaaccactactgagcagtggttatgaggcttaaagcttgggcaaatgtaagccacagacacaaaactatgtactctcttaaactgcatgtccaaaaggactccagtattgggaagaattgccagatattgcaattaaaaatataaagaggccaagtaacatttaaattatttctgtgagtaatagataaagaaaaattataaaagggattgccatctcaatttatatatgcacccctaggtatacatgaataggcaactagaaataattctaacctaattgggcctcctgtatttttaattgtgaaatctggaaatcccaatttcagattgaattcaaaagtttgttgttgactatttgaagttgctattcaaattaaaataaatttttggttgaaaagaaatcccagcccacatttgacatgagcatataagtcaacaatcactttccttttcaaaggtgtcagatgttagaagaagagaaagagaaatccacatcattgggttcatttttgttttaccatttaagattcctagtgagaaaactgaccaaaattaaatttgacctggtacacattatctcacaggagaaagtcgtgaagattaaatagaccgatgccattcagtagctttgaagcagtttagatgcgttattgacattacttcttcccaattttctgcatcacttaatgatgttttagggatttcatgctaaatgaatgagatgaataacgtatctgaaatatttctagattccctactggaataacaaattatttcaggctgtctggctgattaaggtgaactgataacttcagagagccagggatggtagaggccaaactttatctgcttcctattctattttgctagcaaataaatgatgataagtatataatataactttagccttggctattacaagcaaatcagcaaaggcatctgaaaacctcagatttctaattaaatttttgctaatgtcttaagctttaaaaggggggtatgttttccaagtagatgtgcaagtgaggcccctgagtaataaaactccaattgtacttcacccttataaagtgggctacatcaaaacatttaatgtctgagtttttaaaccttgtatacaataaaatttcatacgtctccccttagagtgacagaattatagaggtttcctagctccctctacacttgctggattcattcttcaaagcattgtaatagaataatggcttactgtcaggatactcaagccagttgcaaataaatttagaccttgctaatcatttactttctcttacagcgtgccactcttaaaaatgtactcttggaattcaaataaagaaaaaccaaactatagttcatgtttactcctgtagttggaagcccttaattaaatggtagaactgaaagaggcttcctaaattattttctgatggcaggtagaatcaaagctaatatgtggtgatgtagtagtatttttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccgtatttttcttttatgatgcattcaattttagattatggtccacattcttaatgcagaaaaattcttcaatatctggaaatgtgttttgtagtttatatttgtataaatgacggaactatgaaaattgcttcaacataatcctccctttctgattagagaagataaaatggcaatttccttttttctatagctctacctataatttgtaaaatcagtgtaacaagtttgattaaaagatctataaacctcataatagtattttattgacctcaacctttaaagataaagttaaacttgatgagttttaaaactttggtacatcaatgttaataaatagatcaacattattaatttttaaatactcagaatcatattaagtgctctataaaatttgtcagaaaagaagcagtttgctctctatttttgcaaacctgtttttttttttttagaattcaataacattttaaccaatgtaaataaagtatacataaaactctttccacacttctataaaatgatcattccaaggttggtaactattagaagacacccaatgctacactcagcagaaatcttaatgcaaaagaaaagatacagaaacaaaattttacagctttttttccagatgaaaagaaaagataactagagtaatctgaggtcctaggttctagttcagtgattacaagagactgctcacctatcatccacccattatctttatcccaaaggatttttaaaagtcctagtctaaacccagattctagacctgactttgtagagcttagagctgtgtgacaaatcaagtcacttaaactccggatctcaattttcatctggacctagaaactgttaagctagagcagcacttctgaacctcaccagcattaacatgtaagattggatttttctttgttgtgggcacatgtcctgttcaggatgtttagcagcatctctggcctttacccactggatgccagtaatatctcctctcctccatgttgtagcaatccaaaatgtctgtagacattgccaaatttcccccttggcagggagggaatcttcccagttggaaaccactgagctagattagcataccctgtaggttgctccaaggtacatgggtcctcttgagaagctctgagaaaataaataaatcaagtgtcccattgtcagataagcatcaggaaagtggtatggcacctcactgcccttttgccaggcctttgtcttctgtttgaaaagtaggttttaaccttgacagtgcttctctgctcagtcttaacctcttgattttggtgatctcatcctttccatggatcggaattccatccatgtgccaactcccaaatgtatatcattaatgcagagagagatcaatgttctggctgtttctttaataattatcatgagatctccaccccgacgtattcaagactaaacttttgctcttccctctttgagccttccctttcaccctttccctcatctcaagacatgaggactactacttaggcttgaacctgagtctctcattctttcctcccccatatccaaccggtgttgtgctcatttactttcaaactgtattgtgtaactggccactttgcctgattgtaattgccactgtctcaggtcaagctatcatcatctctcatttggagaacttcaataacctcttagctgatctccatgcttccaccactgacccctctccacacaacagccagagtggtcttcttaaaacaaatcacgtctgtttctggcttgctgaaacccgttagagggtctgtgattgcatttaagataactgaatgtaatctacagactcagtaaaactgggtcctctttctctgtgtagcctcctcttatgccattatcccttttgctggctgtgttccaggcacatgggctgctctcagttctgtttaaaggaataggagctgatgcttagcaataactcatgcttcagcctgttgctttcataataagtcctttcatgagcccccaccaacagccatacattctcattgttatacctctctacatgaatctttctacttttctttttagcactagttataattgtaattttatacaggcatccttccttttattgtgcttcacattattgtgcttcacagatactgcagtttttccaaattgaaagcttgtgctaaccctgcattgtgcaagactattggcaacatttttctaacagcttgtgctcacttcatgtctctatgtgacattttggtaatttttctaatatttcaaacttttaaattattattatatctgctacgatggtctgtgatcagtgatctttgacattactattgtaattgctttggggcaccacaaactgcacccatataagatgatgatcttaaccgataaactgttgtgtgttccagctgccccaccaaccagcctgtctctctcccccttttggggcttctctattctctgagcacaacactgttgaaattaggcgaattaataaccctacaaggcttctaagtgtccgggtggaaggaagagtcacatgtctctcactttaaaattcaaaagctggaaatgattaggcttagtgatgaagacatgtcaaaagtcaagataggctgagagctagacctcttatgccaaaccaagatgtgaatacaaaggaaaagttcttgaaggaaattcaaagtgctattctagtgaacccatgaatgataagaaagcaaaacagccttattgctgacatgaagaaagtttttgtggtctggataaaagataaaaccagcgacaacattcccttcagtcaaagctttatccagagcaaggccctaagtctcttcaattctgtgaagatttatggaggtgagaagctgcagaagaagaattggaagctggcagaagttgattcatgtggtttaagaacagaagccgtctctataacagaaaagtgcaaagtgcaacagcaagtattgatatagaagctgcaggaagttatccagaagatctagctaagataattgatgaaggtggctgcactaaacaagagattttcaacacagacaaaagaaccgtatattggaagcagatgccatttaggactttcatagctagagacaggtcaatagttggcttcaaagtttcaaaggacaggctgactctctcatcagggtatagtgcagctggattttaagttgaaaccaatgcttatttactattctgaaaatcctagggcccttaagaattatgctaaatctactctgcctgtaccctataaatggtgcaacaaagtctggttaactacacacctgtttacagcatggtttactaaacattttaagcccactgtagagacctattgcttagacaaaaagattcatttcaaaatattactgcacattgacaatgctcgtagtcacccaagagctctgatggaaatgtacaagagattaatgctgttttcatgcctgctaacacaacatccattctgcagcccatggatcaatgagtcatgctttcaagtcttattatttaagaaagatatttcatagatatgtcttccagctgccataaagtgtgatttcctctgatggatctgagcaaagtaaattgaaaacgttttggaaaggattcaccactctagatgccattaagaacatttgtgattcatgggaaaaagtcaaaatattaacactaacagaagtttggaatagattccaataaggagtagattccaatccttacagatgattttgagaggctcacgacttcagtggaggaagtaagtgtgatcgaaatcccagtaactgcgatcgaaatagcaagagagccagaatgataagaggagccttgaagaagtgactgaactgctgcaatctcatgataaaattttaacagatgaggagttgtttcctatggaggagcaaagaaagtgattcattgagatgaaatctactgctagtgaagatgttgtgaatatttttgaagtgacaatgaaagattggtaatattacgtaaacttagttgataaagcagtggtagggtttgagaaaattgactccaattataaaagaatttctcctatgggtaaaatgctatcaaatacatcccatgctacagagaaatatttcttgaaaggaatgatcaattgatgcagcaaactttattgttttcttattttaagagattgccacaggctgggcatggtggcttatgcctataatcccagcattttgggaagccaagttgggcagaccatttgagatcaggagttcgagaccagcctgtccaacatggtgaaacaccatctatactgaaaatacgaaaaggaacctgaggcaagagaatctcttgaacccaggatgcggagattgcaatgagctgagatcacaccactgcacttcagcctgagtgacagaacgagagtctgtctcaagaaaagaaaagaaaaaagagagattgccacagccaccccacccttcagcaattcccaacctcatcactcagcagccatcaacataaaggcaaaagcctccatcagcaaaaggtctgtgactcgctgaaggttcagatgatgcttagcattttttagaaatgaagtatttttaaattaaggtgtgccatttttagatgtaatgctattgcacacttaatagactacagtatagtgtaaacttttatatgcactggaagaccaaaaaactagtgcaacttgctttattccagtgtgtggaaccaaaaccacagtatttctgcagtatgcctatatttatttccctcatgatttgttgaacatctacctttttttagtaaattgcaagttccatgaagtccataatcatgcttcttttggttacaacattgtatctccaacatctaactggatcttcaacacatatttatggaataattgaatctgttttctaccacccctgccccactcctcctggcaattaacaattcacatcagcatattaaaaatccaaatttttttaaaataaatatgttctgaaacttagttgtccaaggaactgtacccccataacgctgataaatatcttattttagggtacaatgggctaaattatctgtgagttgtcttccagctgattgattacagcatcttatttcagggggaaatactttgaaacgatcaaggccgtatgaactttggttcaaattcaaatgcttataaaattattaagacatatgtagagctcaaagtgttctaataattataaagccattatcagggtaaactgcaattgtaggagtgaagttaaatccccaactatacactttcattggacctctttccttcctcggaagtgaacttgtcattcttacattcacattgtttgcctattgatattgtgtagctattggggcacagccattacagccattgtgccaaggggaccaggtcctcaaagtaggagccagggctcttagagtcaatatctagctttcttttcaatgataattaagtactcagagctctggtctatcaatgagcttgctgcagagtgtttatgagagcaaaatatgataagaaatataaaacatttttgacagtctataaaatttttataaaaacaagttacttcaatgaaccaattttttaatatttaataagtctttattaaatatatgtatttgctttattaaatttagaaggaaaaggctgaaacattttatcatgttcaaacatcatggaaataaaaaataaatggaatgcccatgagatggtaaaaaatgtgacacccttattactaattttaatggaacacatctaggtcttgattactcaggcactggatacccacactattatgctaacagcagagacaggtatattatgatacaaggttttttttcctttaaactgggaacattacataggatataatacattgggtggacctggtcgttcatgcctgtaatcccagcactttgggaggctgaggtaggagggttgcttgaggccaggagtttgagaccagcctgggcaacataagaagaccctgtctctacaaaaaaaaaaaaaaaacaaaaaaaaacacttaaaaattttccagggatggtggcatgcacctctgtagtcctagctactagggaaactgagatgggagaattgcttgaggctaagagttcaaggctacagtgagctatgattgtgccactgcactccagcagtagtcacagagtgagaccctgtttctaaaaaaggaaaaaaacacattgagccacatcataatgtctaacgagtgccaactttgtgccagggcttgtggtcactgtggtgcaactattatctcatgaaatcatcacagtgccctataggatatttgcaagtctttgaatgactttatgcagcttccccactgaagctggaaagggggcaatgtcacttgccccttctggagccagcctgtctcccagatctcctaactacactaatctaggtttgagagctctaaaatttgtttctaatttgtagcagtcttttgatgtattaagatatagatcctcattacttgcagaatctgaatttgtgaatttacctgcatgctaaaatttatttgtaacccccaaatcaatactcacagtgttttcatggccattcatggatgtgtgcagagctgcaaaaattttgggttgcccagtgctcatgtcaccacctaagacagaaaaaaaggtactctctgtcttctcgtttcagcccccatactataagaaagtgccccttttttggtatgtttctgccaatttttccatttttttctttttgttggtgacttcactgtttaaaatggtccccaaatgtagtgctgaagtgctttctaggttcctaaacacaataagggtgtggtgtgacttacagagaaaatatgttctctctacaaattttgaaaagctttgctcaggcattagttatagtgctattggatgtttcagtattaatgaatcgacattatatattaaataagatgtctctaaacagaaacacacaaaaaacaaagtgtatattaattggttgataaaacagtgtgatcagaggctcacaggaagctaaccttgtgtttcctctagaagtaatcattcagtattcactaattagcatttgtggcaactttatagaacacaactcctgcaaataacaagaattgactgccactaaagacaccattgcacttgacttttttaattgcctgcttgatgtcaggtaatctgattattcagcctttgatttcagattgagtgattaatgaaagaccttgaatacaaaattttaaactggtgggaacttttatgaggaagtcataaaggcctgcagtcaaagatttgtaatgggagtcctcatgaaccccgactctcccaggcaaatgacatcaatataatctcactggtactcagcagaattcagagttattttttttgacttggaatatgatgtcttccagggtgaaaagaaagaaatagaagtagaaatttgagtaatttcagtttaccatgcttttaaaaatgttgacaaggtgtactgttatgtatgattcaagctaagtttgtcagaaacagtgaattgttaaatttaagtcatgcttataaaaatctatgagatccctaactatcttccttgtaagttctcacataaaaggttaatttattccaatctattaacttattaagtacaaaaagggcatattgaaatactactgtaaaataactttttaaataataagtaaaactgtgaaaaaagggagttttgacctttcattttttgcttcattcttttatggtaagtgtaaaaattacttcaaggaaatcctatttctttcatttgtaatcataattttttaacagaaagtgctgttatttaaaaacttttgatgagttttttcctccaagagtcaacttatagtagaagtacttctgtttccaataataatgaatgagctataatttatttaaattttgatgagtttttttttttttttttttttttacaaaagcaatgattcttaggcaacttgtcaaaagacgtcatttcagttttgaggcaagtactgggttattatattaaattgtgagaataggttaatttagctatcacaatgagtatttgtattaatacgttcttacaatgctaataaagacatagctgagactgggtaatttataaaggaaagaggtttaattgactcacagttcagcgtggcttgggatgcttcaggaaacatacagtcatggtggaagtggaagcaaacacatccttcctcacatggagaaggacagcaaggagaaatgctgagcaaaaggggggaaaggaccttataaaaccatcagaccttgttgtgagaattcactatcacaagaccagcatgcgggtaaacacccccatgattaaattagctcccactgggtcccttctgggacacatggggattatgggaactacaattcaagatgagatttaggtggggatgcagccaaatcacgtcagtattattcctaaaaatgtggtggctcacacctgcaatcccagcactttgggagactgaggctggcagatcacctgaagtaaggtgttcaagaccagcctggtcaacatggcaaaacccgtctctactaaaaatacaaaaattagtgtggtggcacatgcctgtaatcccagatacttgggaggctgaggcaagagaatcgcttgaacccagaaggcagaggttgtcgtgagccgagatcatgccagtgcactccagcatgggtgatagagcaagactctgtctcaaaaaaaaatcctttacagtctggaagttcacaccataagtcccaaatgctattgtagatattataaatttaggcaacattttattattgcgttagtcatgtaattttattataagcacctcctctgtatcaggtgctgagatggttgttttacatgtattttatctaattctgtcagtaactgcacacaataagtattacattctttatacagatggaggcactgaggtacagaaggtctaaatattttgctcaagatgtatagaaaattaatataggttattaaagaaaaataatcaaatttaggtataggaaaacatacaaattccttgcttttttatactttctaaattatttgtaaataatataacctaatgtttaatttttaagaaatgtgtaacttgtaatgacaaacatgactgacatagaacagagtattgctagttgatttatcattgactgagagcttaagaaagctacgtcaagggtcattagtcattcttatttagcaagtaactcatcacagatgtcttattattctgttattttccacctacatattttctgccacgaggtactgaggcaattcaggaaaacatttgtgttaggactttgtggcttttgaacccggtggctgcttttaggtgggattcatacacctttaacaggttgaaaattaaattgctttatagatggcatcttcaaaggaatggtggtaaattgtgagtgattggtatcaagcagtttgtcttttacagcatcaaatagtgtttcctcataaaccatagcctctctcgttcttgtcactcaggaattcttatggtacaaagtagcatctcttctcctctccgtaccttccactcagtaggaaagcttaatcttgtttttattgagatatatcttatgcgccataaactcaccctttgaaaatgtacaattcagcggtgttcagtgtattcataagcttgggctgccatcactgctatttagttccagaacattgtcatcattccaaaagtataccctgtatctgttagctatccctccccattcacccctctttccatccactggaaaacaccagtctactttctgtctctctagatttgcctattctggatatttcatataaatagaatcatataatatatgtccttttgtgtctggcttctctcacttagcacagtgtttccatagtttatccatattatagtaggtattagtgcttcatttctttttatgcctgggtaatattccatcatagggggatatatatatatatatatatatacacacacacatacacacatacatatgcatacatacatacacacacacacacaccacacatttgtttattcatttatcagtccatagacatttagcttgtttccacttttggctattctgaacagtgctactatgaacgtttctctataaggttttttgtgcaggcataggtttttatttatattgtgtaaataggtgtttcctctcattttttcattgcttccctcgaactcccatcactacccctaagttcagaaaagcccagaacattaggaactttgtatatcccaagagagcttggtaaaacttctgccacatcttcctaaacctgaactccattttcctgtcttttcccagagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagtaggtaacagctggttcccaagaggaaagaagtcattgtcttttggggttatatttttgatggtcctctttctgcgttctttcataattcaccccatgtccttacttcctaaccctggcaaaaccttgcgttttgtctattccaggcctatcattaagtgagtgagggctagactcgcagataagataactaacaaaatccatctgggacccacttatatttctgtttgcttttacttctctgaccccttctcattttcaagtgagcgcaggtgttccttaggtaacacctagagaatagactccaccatgcccctgtttctggccttccctgaaatcatgtacacgagatttgaggaatgtgtttctctgtgtgcacttatttaccactttttacaaggagccctgtaggcagttaatcaatacttattggagagatgactaaatatagaatgccagactctgtacagttacaatcctgttggtgcttagtttggaggcagtagttaagaaagaagagagagttctgagattcaaaatggtttattttctgtggttaattgtcagaaattaaaagtgttgagggctttaagaatattttcatattatgcagctttaggttctagcagatgcagagaatgatacatcaaagtacaaagtttaaaatggaaaagtgatttttattcagcctatatccttgcagcaacaccctgtaactggccagttagtctgtgtcagccagtgctgggagtcagcaataatctcacagccattctctgcctctttgactttctagtccttttaaaattcagcctgatgtgtctttttcagctacactctctcactgagttgactatcttaggctcttccatgagtttttggttctggttttaggtttttccattggcctcaggcatgacattacctctgaaagcctgaggtatgggttcataggtggctggtttgacaactgtgtactttacactttgctagaaaagattctccagcaaataatgttcccccttctgttgctaatagctcgctcttgctctctctctctctctctctctccatctctctctctctctgtctgtctttctttaagtcctgtaactctatttgtagatctctagtttaccttccagcactctgaagtgacatgtttagaaagagaacaggggaagatatacatactgaagaaaagtaacatggggtgtagatgcaggctttgtatttaatttatttctatggcaggacaaattttctaaccagctgatttatgagatttgactagtttgaagctggtgatagctggtgtgctgctccattgtgcctaagcaagaaacctgctagagtgagcttagctgggccagcctcatgtgtgagcattctgggaagtcataatcactcacagagcttccacagtgcagggctgttaataaggctctggaggggaaagtaactaattgagtaaggcattgaacaatctcttggtgctgtgttatcaggaaaggggttgtgaaatcacggaacagtggaacatcaaggcagcaggtctctgaagcagagttaagagggactcatgtaaaagaaggtggggaggcggtaccaaaatgacacctggcctaccatataactgctttcaagacactgaagcattcactaaactagccaaatgtaactaagctatctgtagtgggtttgtttttgatttgggttcccccccgccccgtgtcatttctgtgagaagaatgttcgagcattagattgacctgatgaactggattcctggatatattttgtttctccacagagagaacaccagtcttctcaatgtgcaaaagtgggatttggtgccatgttgagaaaatctccagtcatcttaaatcctaccctaagcactttggcaaaagcttcagggctttatttggaaaagggagactctgagccctgagtatgacttgtttttaaaaatagggacctaattaaagaataagtggttctattaatgactgaaaatccaagaacagttagttgtagagtcactttggtttttcctcactgcactctcaaagtcttttaatagttacttgtgttcacactttgtttcatatctttcttcagtagcagacccgttggcattcatttttcatccctttgtgtgcatattttcatagagaaaaagaaaatgtttccttcaagttatttctgaactatagtttagtggggtttgtttgtttgtttgtttgtttgtttgtttgtttgttttttgagatggagtctcactctattgcccaggctggagtgcagtggtgcaatctcagctcactgcaacctctgcctcccattttcatgccattctcctgcctcagcctcccgagtagctgggactacaggtgcccgccaccacgcccagctaatttcttgaatttttagtagagacagggtttcaccgtgttagccacgatggtcttgatctcctgacttcatgatctgcccgcctcagcctcccaaagtgctggaattacaggtgtgagccaccgcgcccggccccttatagtttagttttttgttatttgttccattgaggaccgctactcctctgcatcacaattgagcccttcagaacaaactggataatgcaggtgaaagcaaaatcaattccaatctgaaacagaaataagatcccctccaaagctcttagaaaattggactttaatgtaattaataagttgaagtagaaaacgcattcacgagcttcttcaatatctcttttggggttctagagaatataaatttttctttatgttttttttgggggacttgaattacatccaagtgaattgaaaaagttctatggactctcagtaatatcttattcaggttaagtgtctatgcatttaataaacctaacctttttataaaatcatacatatattcaacaattaggctatccagttgattcagactagtgggtaagatttcatttttattatataaaatagctaatgaaagtcagtacccaagttctagttctgggttctactgcttctatagtaaactaatcatatcacctaaatgaagacccttaatacttgggtggcagtttctttaaatataatgataatttgggctaaatgctttctatcattctctttagctttttttgttggtttttttgtccagagccaggtaacaatcttctacttttaaaacataaaaattcccaatggaatacttctaatttatagaatcacatggtagcattaagctttaaattactgcagttcttttcagttatttattaaacttttttactactgtactttgaagagaccccttccacagtttctattagtgagattatcgtatgacatctaatacagaaaaaattatattttatgaaaacttaaggctggacacacctgtaaccccagccttttgggaggccaagacatgaggatggcttgagaccaggagtttgagaccagcctgggccacatagtgagaccttatctctaaaaaattttaaatcagccagatatggtggtgcttacctgcagtcccagatactcaggaggctgaggttgggggatcacttaagcctgggatgtggaagctgcagtgagccatgattgcatcactgtactccggcctgggtgacagagtgaggcctgtctcaaaagagaaaaaaagaaacaaaacttaagttgatttttgtccctgtttctctgttttttaataaggcaataacattttctcgcccaacatatggaacacatgttattagttagactttatccacagatactaaggacaaaaatatatgaaattgagcaaatccaggagatctagaacgcatggttattacatttctaaggcagttacctgggtaggtgatctacagtcttgtctgaatgctttaaatttaaacatgtaaataaaacctaaggtgtacttgttagaaccactggctggctgggccttctatttgacttgacatgtggacagcaagttttaaagattagtatgcattcaaatcttgacaaaaataattatttttagtactgacgatgaaatgtctaggctcttaaatgaaatctacagtattttaactattataggtcacttttactgatttttcacttgttaacgttttaattggttttcaatattcacctcataagagatttgaactatcagctaccttaagacttcattatatcttaattccatctcagaattttttctgagatatatttgagtatctggaatttgacctgggtttctaatacaaatttttggttttgtttttatttttattccactaactgctattaatcaaaatggacaattaggggctagaagcctttggaaaagatttggaaagaaagcagagaaatgtttctacttatcaatatatctttttctgattaacttgtaattatttattcacactcacttcaagcttccttccttcctgaagacttcccccaaacccctggtgggtcagaatgttcctgcctcaatccctatcagatgttgggcatgtcttttaaccacgggaattagtacagcactctttatttgtctgcctaataaagttgggaacaactttagcagacgatgcctgagtccgtagtggaaatttaataatttattatgatgtgccaaaataacctatatggtaacagctgcattttagaacttcaatggacacagtcttgcataaaatggacactcaaccaatgttggtttttactcattcacatccccagcatactaattaaaagtgaaaaggaaaaaaaactccccttacagtaataggttatgcataaagtaaggaatgggtaaaccagtacagaaccagagaagaagctttcagataaatacttgcatgtcaataatggaaagtaattcttattatttaattcaagtaattattgtgtgctttatatgggatctgcatcatacaaagtaacaaatctgattaatattaactctcaagctaaaaatctttttgcaatttcccactgacttcttgatattattaaaaatgtatctatttgggccaaggcctcctatgtttttgtcccttctactttttcatgcacacaaactgtcatgccgcagtgcatgctcctcattccaacaatgcagaaattcccaggagccatgccatgttacaatcattttttaagctttcaatgcctccctgatctttacatttgtagtacttagcacatttcttgacacatagtcaatcatccataaatattgattgaataaataaataagtgttgtaaaacaatggatgatgttgaagaagtaaaggaaacagagtttgctccactttcactgaaggaactgaattatcacaaagggagcagctggacagctcaataagacacacggtgatcaatgccaaggtgagtggtacagagagagatgagggaaatgatttagattctctaagattacagtgacctgagatggtcaggaaggttccctgaaggagagagtcttgaaaggagacttaaagaataagtcatttgcaagttaggattttgaaggcactgtgggcagaaattaaataagtaaacaaacaaaacaaaaaatagagcaccagcacctgaccatgctgtcaaagttttgccatgatctgagaaggagaaaacagagagcctgggagggttctttgtttgcctttatcaagaatacctggggtagaaggagaccctcctattctagggctattttagaagcagaaggatgactggtgcctgagggaaaagatacatttggtatttgcagaggggccaaacatgaaatactctatgtcaaatagaaaaactagctttaaaatacaaacaaaaccaaataattcactatgatagtgcttcttaaattttagacagattcacctggagagtgttaaaagacagactgccccctgcaaccaagtttctgattcagtggttctgcagtggggcctgagaatgtgcatttctaacaagttcccaggcagtggcagtgctgatgcctctggtttagagaccccactttggcaaccactgtactaggagcacctgaatacacatttcgaagaatctaatggtgagacacaggaaccgtgggctgcaatgagcagcagtcgtgtcaagaaccaacagatgggcagaaggtcagggtgacacctgttcctataggttttaagacaaatttcagacaatttaattatgagcacatgttagttttattacaaacctgctgtggtagaggttggagggacaaaagaaggagaggctctccaaggccaaagatttctcctttaataagagatacgataggaaataaaagtggttagatggtcatggctagaataaatacaaaaaggaaataaagtctatttagagatctttagcttcttgactgacagtcagctgggtgggtgagcaacttcttagaacttgtcttgatctgattaaaatccagcagaaaaatgcctgttcattttatgaggaactacaatttcttccccagtggagattatgaatcacaacatacaaaaaggttctgccaggtttggaactcttttaaaaacagaagccatctggggctcgttggtactgaagtcatggaaactagcaaataaatgaataagtgaaaaggcatgcttgtaagcaaggggaaaccagaatttgtaatttattgctggtttcaattttatcttgactactttctttattccaggttatttaaatattgagttaaataaggagtttggctatgttttcctgaatttgggaactggtacttctctgtgtgcagccacacagatgctggtgttaagttatttagcattttgatcttctagaaagagagataacagggtgaaacatccaagtttgagaatgacattacattttctatgaagttaccaggagtagattacacagggagctgtgtgtgagttgcagatcagtttgccgtgggcaagtgaagtatatagaaatgaattcaggaaataaatggttatcagtgagttattatcttagacacatagacacttagaaaataggggttgtttcagaccattgttttaaaacattgtggggctgccaccaggaaatcagcaaagtgcaggtagtgttattttttctctgctaaaatacaaaatagatactaggtctgggattctttatctcctatcctcatcagcacgcttcaagaaagacaaaaaaaaggatgtcagggaaaattcaacaaattacaccaccaaatatttattaattacctagtatttacaaagctacttattcatcatcggaaaaccaaagccactccaatgactttgcacaggttacaggtgttttcactgagagtagcttgtatgaactattgagcagccatggaaggtagttattataataaactgttcactgcaaattaaggaagtgggaagtagatgcttctctagtctgctgtcaaaactagattttaacagtttgcattatttcttacaagagacattatttttaaagaaatagaagttacaagtagagatttaaaagttataaaactagggaaagggtcaaaaatgatttctgaaaaggaccaaataatacatggtttaggatttttgagccatatagtatctgtcacaactattcaattctgccattgcagtgcaaaaataaatgagcttggccatgttccaataaaactttatttacaaaactaggctgtgggcagatttggcttgcaaactgtagtttactgaccccctgctgtagagaatgactaacatgaacattgtgttacttcacttatcacacagggaacatttaatctcactagcctcaagaagagattatcaccccaaaaataaatttatagttgttaaagccttattgaggcaaataagaaacatgtgaaatacattttcaaactgtgttcttctcctttcaaaggatctgtctcactgtgtttgaatctggacactcagtgatgccaaggcaaaagtgttttattctcctaagaatatcctcatgtggccttttgtcttcaaataacaagtttcccagttgcacattaaattatacagctgaggtatagactttcttctaagacctcatcttagctattggcataaattctggccttttttatttctatttgccctttcaaagcaactccttcatttatctcctaaacagatgttgccatcaggtaccttatgcctggctccaaagattggcatatggttccatctaacccattttcaccttgcacatgaatctgcagccgctgaagctggagaaaggagctctctgccaggaagccgaggccctggggattcagcactgcatcctttataatgtggtgaagctccaggggggaagaggaaaggcagccaagacaagtctgccaattcctgggtttcacagggctcattctgcgagtccttttgtttcctttcctgcttctaacttgaattgactgatgaaagaaaggaagtgccattgaatagaggttctcacatttgccttctaactttgttccataggaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtaattatcttttcactggcattagggaaaacataccattctgaacccaagggagtttttcactccttttatggaaatgtcttccctactaatttgcatgtcattatgggtcatttatcaatagttaaatggatctaatataaatttggttgattaaccaattatatgtctttcttcatcctgtgacttgatataattttaataattcttttataattttgataattcttgaattttctatgaggttggaagtaggacagttgggaaatacagaaacttaaatcctaaatggattgactgctttttgttaattgttaaacaaatgttttgtcaaggcaataaaatttgaagccatctgtacattttccagttccttatttcgatagataattgaaagttaattctaaatttactgtcaattccctgttttaaaaatcacatcagggcacttgaagtacaaaaaaactgaatattctgttactttggccttgattactatggaaatcaactgtcatccacatacagtcaccttatgtgatccccagactagtttgatgggattctgtctgaaaactatgttgttatacaaagggatctgaaaaaaaaaaaaaaaaaaagcctactgttcaatgaattggtgcagaacaatcactggtgtccagggataagtaagaacactagaaaataattgtaagatagttcactttctctgggtcttcatattatctaagtgcttatgggaatcatcaaccaaatactatcatcaaaaaatcccttggtctactcataatgtgattatagaatgaggagctcctgtttttttttttttttttttttttttttttaagttttagggtacatgtgcacaatgtgcaggttagatatatacgtatacatgtgccatgctggtgcgctgcacccactaactcatcatctagcatgaggtatatctcccagtgctatccctcccccctccccccaccccacaacagtccccagagtgtgatgttccccttcctgtgtccatgtgttctcattgttcaattcccacctataagtgagaatatgtggtgtttggttttttgttcttgtcatagtttactgagaatgatgatttccagtttcatccatgtccctacaaaggacatgaactcatcatttttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcacgatttatagtcctttgggtatatccccagtaatgggatgcctgggtcaaatggtatttctagttctagatccctgaggaatcgccacactgacttccacaatggttgaactagtttacagtcccaccaacagtgtaaaagtgttcctatttctccacatcctctccaggacctgttgtttcctgactttttaatgattgccattctaactggtgtgagatgatatctcattgtggttttgatttgcatttctctgatggccagtgatggtgaacattttttcatgtgttttttggctgcataaatgtcttcttttgagaagtgtctgttcatgtccttcgcccactttttgatggggttgtttgttattttcttgtaaatttgtttgcgttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacctgaagtccttgcccatgcctatgtcctgaatggtaatgcctaggttttcttctagggtttttatggttttaggtctaacgtttaagtccttaatccaccttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgtggctttatttcctgtttttaaagtgaattatttgaatgtgttgctgttttactgtactctgtcatctcagaattgcataaacaagaaatacaagtattgactgtcaaccatggattgttgaatatttcttttcaagctctcaaatgatgtcttaggcagatttcctaacttccttgtcactccagttattgaaggacagtctagttccattaaaaactatcatctgaaatttaattaaagattctcctttctcatgctcagctagatatttggctctagggactgggggtcagaatttgttttctcaatcctccagtacattggagtgaaatggaacggtgggattgagaagaagctggaacaaagtctgtttcagaaacactgttacatcttttccccttctctccacttttcctgagcatgtgagagaagagggatggagtgaagagggaggggaggtgaggataaagagaagaaagtaccatttgaagttcttcatagcttttgtggacacgtgggctaacctctatgtggtatccaaattctgggtctcttatgaaacagaagtatgacttatttatggcaggggtactcaacccctggaccatggatcagtactggttcatggcctgttaggaactgggccacacagcaggaggtgagcaacgggcaaaagagcaaagcttcatatgtatttacagccattccctatcactcccattactgcctgagctctgcctcctgtcagaccagcagcagcactggattcttataggagcatgaaccctattgtgaagtgcacatgtgagggatctaggctgcacgctccttataagaatctaatgtctgatgatctgtcactgtctcccataacccccagatgggaccatctagttgcaggaaaacaagctcagggctcccactgcttctacattatggtgagttgtataattattccattatatattacaatgtaataataatagaaataaagtgcacaataaaggtaatatacttgaatcatcctgaaaccgtaccctgccccctgcccccaggtccatgaaaaaattttcttccatgaaactggtccgtggtgccaaaaaggttgggaatggctgctttgtggggccttgtagaccaggcccagttccatgatgggagacatgaagtccaggcttaccacctaacacagctcttcctcttccgtcatgaggcctctgggaaattccagcaaggggactgaagcccagccaacttttcacatgcccacttggcccacaagaatctcctatatccttgccagacccaatggtgagagagcttgcactctaccactggccctctctcaaccttgctctcttcaattactttttcctctgcttagatagactcggggtagaacagcaagcccactgcctaaacaggctttcgcctggggagtgacagaaaacaaatcccttttgcaggaacctccatattttacaagtgattcttcttctagctttgttcttgactggatatcagggaggggagagcacctccacctcccactgaaagggatagaattgcctcactgccctaaggaggttttgccaatgacttctaagacacatccttctaaccttttcctttcgtcttttatatactgagatgacattaagttgatatctcttaataagtcctgggggaaggtttaatcccaaatgatgactgttttctttaaaataaaagagtacttatgcctacttgtcctcaatttgaggacctcgttgccaattttgtaacaaaaggaaagtaatcctcaaagtcctgcaagctatactttatgttaaattaagtattcttctctcctgcttaaaaaaacaaaattcaacataagtgaacagcattaccaagaaacattatatttaacaatggggttcctgagtaggcaataactatgtaaggagagattactgtatgttaaattctatgatttggacttttatacattattttgcctaatcttcacaaaatactttgaggtagatgctatcattcttttcatatagtaaatgaagtaaccaaattaagaagggttaaataatgtgcccagatttcagagctagtatcacagccaggaccaaaaaaatctgaccccaaattaatgttttgttgatccagtttcaattaactcatgtaatacttttatataagtacttttcttgttttgcgcccatgaaattagctttttggataaaaccagaaattagtttacagtattcatactttagctatggaaaagagaattgaatcaagcaattgctgcataaacaacaacaactaattttattgagagttaattttttattttactcattcttccctactgctggtatgcaaactgcttaaacaaaacctacttcattctctaaccacaaaaatagaggatgccactaaaatatctaggaattaagatgataagttattgcttcatgatacatctcttctacatctagtggatttcaaaattattttctttacttaaaagtttacaataaagaaacgaaagagttcaggtctatttgatctctaggacttacaaatagaatttagtttcttgaaatggatttatcctagtctaatttcactacagaagcaccacaggattatgttacttagcttcacttcggaagaatgaacaagtaaatttcagcatgtggcatttggtagtattcaatttctaaaaatgttcaattcagtgaataacatctataaaagagctacataacaccaaatgggcaatgtgatttaacacttaactttttattagttattttgaattatatacatgtctattaaatcctgtatttaaatttcccaacctcatttggaccaatggtaaataatgtcaggtggcaagtttatgagacaagccacaaagtgttactaccaaaaaattttatgcttcaaaaaaagtaaaaggaaaaaatcttgtttaacttttcaatgaattcatgtaatatcaagcacagtctatttttagaataaaaaaaaaaactgaaaacccacacacagacacccaacaatatcaaaggacttatttgaaaactatgttaccaccgggagctgtggctcacacctgtaatcccagcactttgggaggccgaggtgtgcggatcacctgaggttggcagcttgagatgagcctgaccaacatggagaaacccctctctagtaaaagtacaaaattagccagacgtggtggtacatgcctgtaatcccagctacttgggaggctgaagcaggagaattgcttgaaccttggaggcagaggttgcggtgagctgagatcacgccactgcactccagcctgggcgacaagagcaaaactcaatctcaaaaaaaaaaaaaaaaaaaaaagagaagaaaaaaagaaaaagaaaactggttggatctagagttacttttttggagtggcaagaagaagcacattagatagtgttttaatgtttgcttctactgtcaaacataattttgaaaactaaagaggaggaaagtctgttgtatttaattgatattttcactctttctgttgttcatttttcctgtttgattgtctgagattcctcttactacttcctgtttagagaaattccattagcttttttttttttgatggtttatctgcttgagacaaattctcttcattttccttcattggacaatgacttgatttcaccttcattcttgaagtatatttttgctggatattgttaacccaattctgtttggtagttctcttttagcacttgaaaaatgtgttggatacttctggccttcatgattcctgatgagaaatctgctgtcatttgaattgttttacccatataagttgtttacctctcactacttctaagatttttttgttgttcttgtctgtagttttaagaagctgaactgtgatgtgtctggtatggatttctttggttttatcctgttcggggattactgaatttcttgaaactataaggtttatttatgtcttttgccaaattttggaaatatcagccaataattctttaaatatttttcagtttcacaccctttttcctctttattgactctttggacactataatttttccccaaaattgatgcttttctattctttttatttatttatttatttatttatttacttgagatggagtctcactctgttgcccaggctggagtgtagtggcacaacctcagctcactgcaatctccgcctcccaggttcaaatgattctcttgcctcagcctcccaagtagctgggactacaggcatatgccaccactcccggctaattttttgtatttttagtagagacagggtttcaccatgttagccaggatggtctcgatctcctgacctcatgatccgcccacctcagcctcccaaagtgctgggattacaggcatgagccaccacgcccagccaaagcgatgcttttctaatgttgccactttatttcttttagtttattttgtttttagagatggggtctcactgttgaacagactggtctcaaaacatcctcctgcctcggcctccataacaggtgcaatcacaggcatgagctacacactcagtggttgccattttaaaacccacacacttttaaatgctctggtctcctaggaaacttttttagtatttttaccattagggtgcacttctttggtagatggttttaggtcagtcttgtgatccttatttccctcttctctcttctatacagactttccagatagctggcttttcacaaagactttgtggctgtagcttgagaaatagctttgctagaaagtattatttctctttgtacttacaggaaatttgaaatgtatcctcttttctgttttgtgattctgctgaaggagtaatatttgcatagttcatttttacttttattttttgagactgagtctctctctgtcacccaagctggagtgcagtggcgcaatctcagctcattgcaacctccgcctcctgggttcaagcgattcttctgcctcagcctcccaagtagctggaactacaggcagccaccaccacacccagctaatttttgtatttttagtggagatggagtttcaccattttggccaggctggtctcgaactcctgacctcaagtgatccgcccactttggcctcccaaagtgctgggattacaggcgtgagccaccatgcctggccaggtttgcgtagtttactgttttatatgattctgtgtagtttttgtaggatgtgtggacagagttagatttaggaagcttccatgacttcacctatgtggacttctcccagtataattttttattttaaattgtagtaattatgctgttaattttttaaaaaatgcatgcatatgataaaaaataaaaagaataaaaaagtttcaaaaaatagtaagtacccaaaatagtaaaacatatgtttgcctcttgcctatcccaaattcctaatccctttcgcaaaaggaaaacaatgttaaaaattttgtgtataaccttattacatagatataggtgtgtacttatatatatatatattcatatacacatagaaatgtgtgtcacaatatggttttatatgcatactacacaaatgggaacatacactattcagaacttcagtttttttaatacgtattataattaacttttcaaatctgcatatatccattttttctaatttttagtgactctttagtatgatattttatggaatcctaataaatttatgtaaatatgtctgatcttatttttgaagaatgcagtttatttcttgtgggttttttgtaataaaatttaatatggttgggcttaaagtattagttgaatgaattctagtaaattaatatagtggaatattacatagctgttaaaaattatactgagttatgtattaacagagaaagatttttgtgttaccttttatagcaggttacaaaaagtatgcatgatataatgccatttttgaaaaatatattaatgtacgctctcccactttcacatgtataaacatatgcaaaaattataagcatcaaaatataaataatggtttattgtatgcaatgagtttagagtttatggttaatttcattaagatttgtacaatgaaatagattcaggtaacaagaaggtagatactatcatagaaagcatctgtaagactgaaaaggcattggaatgcctgctagaaattaggtaaagtgttgcatccttgaagagggcatgtttctcaggagtgtgtattttttaggtcaagacactgaggaagcagggagctctatgtccactctggagaggtcgctggctgcacgccgagccccccgggccaagctcatgattcccatggatgcccagtccaacaatcctggtgagtcaatattggtgccacaatgaagaaatgaaatgctttctgtatgtatcttttctataaaaaatcaaattatcaaaagtaattataattttccctgaactttctggacaaatggaaatgaggaatgactaaaaccgtatcattaataatttgaagtctaagtcttcattcgttactgtatttttttgtatacaatcagatggtctgttggcaaacagatggatatatatttaagaaattgtttgtaaaatatatgaattcacataaaagagctgatatatattttaatattattgatcttattctaataatcatctccatagtttatttttatttatttatttatttattttatttatttatttattttatttatttatttattttgagacagaatcttgctgtgttgcccaggttggagtgcagtggcacaatcttggctcactgcaacttccacctcccaggttcaagcgattctcatgcctcagtcttccaagaagctgggactacaggcatgcaccaccatgcccagctaatttttctattattagtagagacagggttttaccatgttggccaggctggtctctagctcctgacctcatgtgatccgtcttcttcagcctcccaaagtgctgggaatataggcataagctactgcacccatcctccatagctttttaaataaactttttaatgagtctaattctcacacttaaataatctagctcctttaaagcagatgttgacagacacccacttactacacaccccttgttgaagttttctgtcatcctcccacattcactgaagatattattatctgagaatcacttcctttcccattacttctatgctcagtcttggtaattacagtattcatgcagataatccatctgataccctagatggttagttcctctatgttgcctgcaaagatattgattccttcccacctcaattcataaattccatgtcacaccaaatcaaaccagtacaaaatctcagttcctattaccttattagttccctgctcactttattgcccccttgccatcaattcttcaatcccaccaggacctccaatccattaactctgccatttcttcccatccctcatccccttcgtgtcctcatttatctgcaagcttaacttaggttttatagtcacttattatcttcagtctcatctcccttggtcttccttccccatcttactcgcctgaaaaaaacctggtaaaataagcagctccccaattcttaccccattccctcatagctaaatgtatctggagaaaaacatatagcctgcttactgaatatttatgaccaaaagtccaaggtgagctctcactatttggaaatgacactgtatttctctagtggttcatagttacactttataagatgaatgtcttatatgtattcttacttttcagatttcagtatctcccatctttccctattcttagctaataatcttatatcaggaagaaaagaaaagcattcagaaagtggtatccttgtccttccatcaaatctaattgatctgttagtgctgctctctgagtgtcttgttgaaatcccctctcacccatttagggactcttctgtaattactccttccctttcctgcatcatcagttttttttccttatttatcactgcagtaagcatacaaatattaatattctgtcataactcctgttttataacactcaatgccacttccccctccaattgaaaccatatttactgaaaaaaatttctaaattatctgcactttctcctctatctaagctttcttattagttttaataagatttttacagtcactctccactgaatccatgattgccaaggttgtcaataatctccacattgtcaaatccaatggtcaagtctcatactctcagaaacagttgacataggttctcacttatttccctgaaacactttctctttggcttgcaatgtactagatgcccctggttttcttcctacccttctggctgctcctcctcagtatccttcatttatttctcttcttcctcctgatctctaagagtcagagaatgccccagggctcagtcttcaggtatcctctcttttctccctacacctgcttcttagataatgtcatctagtatcaatggccttaaataaatattattaaaatgctgatgaatcctggaggacattatcctgaggcaggatctctagggcaagggcaaaatgccaccagtctttgctaaaacatagcaagagtctcctttgcttcatttcccaataatttcctcatcaccatctgaggacacctcagcctggacttcattgtccatatcactacaagcattttggtcaaaactgttcatcaagtctctaggcaattccaaactttcccacatcttcctgtcttcttctgagccctccaaattgttccagcttctgaccattacccagttccaaagtcacatccacattttcagattatctttatagcagtgccacactctttgtggtaccaatttactgtattagtccgttttcacactgctataaagatactacctcagactgggtaattcaaaaaacaaaggaggtttaaatgactgacagttctgcatggctgaggaggcctcatgaaactcagaatcatggcggaaggtgaaggaaaagcaagtaccttcttcacaagccagcaggaaagagagagagagagaaaaaacgaagggggaagagccccatataaaaccaccagatctcatgagaactcactcaccatcacgaggatcatggggggaactgccccaatgagccaatcacctcccactttgtccttctcttgacatgtggggattacaattcgagatgagatttgggtggggacacagagccaaattatataaatcaacttactctgttcagaaactctagtttcatgcctcttcattctgatttccttataccctaaattcagtcttttaccaaattattgttttcaaaacatttcccaaatttgaccactcttttccaccttcactgttttgcccttatccaagctaccatcatctcttacagattactagactacagcaataagcttgtaactagtctcttctttagctttttgaaaaacaaaaaaactattcgtattttttgtgggtacatagtaggtatatatatttatggggtacatgagatgttttgatacaagcatgcaatatgtaataatcacatcgtggagaatatggtatccatccacgcaagtgtttatccttcttgttaaaaacaatccaattatactcttagttatttttaaatgtacaattaagttattattgactacagtcaccctgttgtgctatcaaatagtaggtcttattcattctattttttgtacccattaatcttcattagcctttgcctttacagtcaattctctacacagctgtctctcaatatataaattagataatgttgttcctctgtgacttccatcacatgtagaaacaaaatccaccaattttactatgttctacaaggtcccatgtgatttagtctctgggtttatccctcactttatctcctattgctcctttctgtaattcattacaatcatgtaaccttcccctgtgttccttggataataggcatatctcagttcagggactctgcacttgctgtagtctttggaatctctttttgtagatatttacatgtcttatcccccatttctttcaggtctctattcaactaccacctttataagcaggtcttccctgaccattgcctaacacagcatctctggtcactctctacttctctattatgcttcatttttcttttttaatgcattacactattctatttgtggttttgtgtttgttatttatttgcttcctgtattttaatataatctttataggggcaaggattatgcctattttggtcattttgagtcgccaatacccagaacagcacctggcacatggtaggcatgcactcaataccatttagtcaaatgaaagaattaatagttgtttatttttacttaccatatgccacatcctccctatgctccattacatcttctctcaattttactataataagtgcaaaaacttacatagcatttataatgaatgccagctgttcaagtcatgtagtaagcactattgttatgcgtctcattgttaggttctctcatttactagagagagaagaaaggattggagagtttaagtaactagctagcagtcacacagctagtacgtgctatagccagaatttggactcaaaaggtctgatttcagagttcagtgttcttaatcattatgctcctagctgtcataccctgtgaagctattgtcctttatcttttatacctttcactactgagaaagatactgtgcacttagttgccttttttcccctctagttgcactcctcttgtattaataactaagttctatctgtgccaatcatttattgctttcttctcaaacattattgtactttagaatctgtggagccttcctgtcccatctaattagaaatatcttcctcatctaataaattcccatatgccattgctttttctttcacagtatctttgaatccctggctatcctcccattctcaactcttttatgtcttctttgtgacttcacatctaaactgccaagacagcttcctagctaagtcttcccggctctagcatcttccagactcttaggcatcctgcttgccagatttcttcctaaaacaagttaaacatggcatcccaccccatacatttctccagtggctcccatttgtctgccaagaaaaacaaaacaaaccaaacaaatttttaaaaacgtttttagcatatcatattggaatctagatttctgttactctatccttatatgtacccagactcatgctaaggtagactcattgctgatccacaaatatgcactgtccttcatttgttttttccctttacatatttctttccttttgaaatgactcagtggatagctcaacctaagaagttttatgtatcctccaaagaccagagtagatattgatgctcttacaaatgcttttctgattactccatctagaaataatgactcccttttatatgtttgaataacatgttcttgtagcacgatatagcatttattacacacaatactgccttatatgcttaggctttcaagtacaaatcttccctcctccaacagcttgtgaattacttcatgataaggatgtaatgtatctaattcatcttcatattcacacattttattgtttaatacctagcacaaaattggtgcttgctaaatatctgtcgaatgaaaaaacaaataaatgtattattaaaatgccttccttatgtttgtaacacatcaatgtttggagagctctttttttgtcagttataaatagaatgtcatctaacaaaattgtctgatgtattaagagcagttaaacttgttttcattaaacagaaaaggaaataagaggcttagaaagagaaagaaaatctaacaagtatgaaaatgtttaatattattcacttggtaaataccttgctaattattattttcatttaatcctcacaatattatcatgtggtaagattatcctgattttacacatgggaaacagcgactcagacagcttaagcaacttcctctaggctacctgggcaacttcagaacctctacggtatactgcttttccaaagataaatatggcttttatctcctaaattattcatatccttttatttttcaaaaagattttctgaaggtgctatctccattgtctaaacatggaagctgaggctctgagagtctgaacttgaaacccctgcttgatccatctactctactatattgcttcatactgttatcttgagctctgagtttttgtaggcctaaaataacaaatcttctcttagtgacttattctacatgaatggaacccataaaattaccagaaattaatttttgttatttttgtaattatcagataacaacacatacatggttttaaaccatcacatagttttccaaaatttataagaatattctgattcagcaattccattcctagatatattctactcttggatatgtacccaatggaaatatataaaatattagtcaacaggtgcatataagaatgtgggttatttgtaatatcacatcttcattacaatagatgaatatagtatattcatatagtggagtacaatgcagcaataaaaataaactaaaattatacaaaacaatatggataatctcatgggtgtaaatttgcaataaagaaacctgatgcatctatataattcaatttatgtaaaattagaaaatcagtaaaataatccatggggtttaatatggtttggctgtgtccccacccaaatctcatcttgaattcccatgtcttgtgggagggtcccaatgggaggtaattgaatcaggggcaggtctttcctgtgctattcttgtgatagttaataagtctcacaagatttgatggttttaaaaatgggagtctccctgcacaagctctcttctcttctctgctgccatgtgagacgtgcctttcaccttctgccatgattgtaaggtctccccagccacatggaactgtaagtccaataaacgtcttttgtaaattgctcaatcacaggtatgtctttatcagcagcgtgaaaatggactaatatagtaatttgttctgggagtggggcattgctgttaagatactcaaaaatgtggaagtgactttggagctcagtaagaggcagaggttggaatagtttggtggaggactcagaagaaaacaggaaaatgtgggaaagtttggaacttcctagagacttgttgaatggctttggccaaaatgctgataatgatacagacaatgaaatacagtctgaggtggtctcagatggagatgaggaacttcttgggaactggagcaaaggtgactttggttatgttttagcaaagagactgggggcattttgcccctgccctagagatttgtggaactgaacttgagagagatgatttagagtatctgacagaagaaatttctaagcaataaagcattcaagatgtgacttggatgctgttaaaggcattcagttttacaagggaagcagagaataaaaattcagaaaatttgccccctgacaatacaatagaaaagaaaatcccattttctgagaagaaattgaagctggctgcagaaatttgcataatcaatgaggagctgactgttaatccacaatataataggggaaatgtttccagggcatgtcagaagtcttcacagcagcccctcacatcatggccctggaggccttggaggaaaaagtggttccatggaccaggcccagggtctgtgagctgcgtgcagcctatggacttggtgccctgtgtcccagctgctccagctgtggctgaaaggagccaaaatagagctcaggtcttggcttcagagggtgtaaccctcaagtcttggcagcttccttgtggtgttgagccttccagtgcacagaagtcaagaactggggtttgggaacctctgcctggatttcagaggatatatggaaatgcctggatgtccaggcagaagtttgctgcaggggtggggctctcatgtagaacctctgctagggcagtgcagaagggagatatggggtcagagcccccacacagagtccctactgggtcaccatctagtggagctgtgagaagaaggccaccatcctccagactctgtaatggtagatccactgacagcttgcactgtgcacctggaagagctgcagacactcaatgccagctcatgaaagcagctagaagggaggatgtaccctgcagagccacagggacggagatgcccaagaccatgggaacccacctcttgcatcagtgtgacctgaatgtgagacatggaatcagaggagatcattttggagctttaagatttgactgccctactgaatttcagacttgcatggcgcctgtagcccctttgttttggttaatttatcccatttggaacggctgtatttaccaaatgcctgtaaccccattttatataggaagtaactaacttgcttttgattttacaggctgataggtggaaaggacttgccttgtctcagatgagatgtcgggctgtggacttttgagttaatgctgaaatgagttaagactttgggggaccattggaaaggcatgattagtttttaaatgtgagaacattagaattgagaggggccaggggcagaattatatggtttggctgtgtccccacccaaatctcatcttgaattcccatgtgttgtggcagggacctggtgagaggtaattgaatttcggagccaggtttttcccatgctgttctcatgatagtgaataagtctgacaagatctgatgattttaaaaatgagagtctccttgcacaagccctcttctcttttctgctgccatgtgagatgtgccttttcccttctgccatgattgtgaggccttcccagccatgtggaaatgtaagtccagtaaacctcttatttatttattttttttgtaaattgtgcagtcttgggtatgtctttatcaggatcatgaaaacagactaatacagggttagaattcaggaggacaattacttttgatggaagtcgattagtggaccagaaggtactatagggcacattctcataatgtgttatttcttgttctggattacagatgccaggcatttcactttggaaaaacattgagcactgtatttagcatattctcaattttccctgtgtatattataattcaatgagaaaaaagacaatagaatatgtatatttttaaataacttggtcacatcacattcattgttatctacaagctgtttgttggtgaaactgtattcaacaaaagaaaattattttaacatataaacacagttaattttaaaatattttttattttttgagtcagactctcactctgttgcccagctgcagtgcagtggtatgatccctgttcactgtaacctccacctcacgggctcaagcaatcttcctgcctcagccccctgagtatatggaactacagacataagccaacatgcccagctagtttttgtattttttgaagagacgaggtttcaccacgttgcccaggctggtctcaaactcctgggctcaagtgatcctcctgcctctgcctcccaaagtgttgggagtacaggtatgagccactgtgcctggcccaaataaattcttaaactttttgataaaatagccctttgcatctgagatgattgataaggccataggtaactatgtttaaaaattttgtatctgtatcttggcagagttatgattttattcaggagagtagataaatttataatggccccatttgcaattatttacacttactggggtatcaagccttgtataaactaaagccatagcattgttcagatttctagtcacatatataaagatcgttgctatttcattgaggaatcattattcctataagattgttattttctttcttccttgacatttcttattatgtgctataaaatgttaacagataaaacataagttatctgaagttgtattttggctcttaaaactcacagagaaaatgtatttaatttcatgggaaggcagaatcttcttatttgtctaatattatactttttggttgaaaatattatatggcatatgctactccttatccccaagcattcttcacagtaaaattagctgaggctcatgaaaaacatgccagctgacagcacaggcaggagatgaaccccaatcttttgattccccagcctagttacccttaccataaaatggtggcaaaggttgactatttgtataatggccaaaaattattttaaatgctgtttcttactataatgaaattaattacaaaaaagtcagaacagagactggaagataggagatttattggcttaagtgctttctggaataacaccagtgagggtgaaggatacagaataacaccagtgagggtgaaggatacagaattggggcaagggtgggattgaactggtgatgctgtttaatggagacctcagctgacctgaggctgtcctttagggttgtcctaaatgaagcaagtggggctggccttctctatcctgactcaagtaatctttcatgcaggctatttccaagaagtggggtgtggccttgggtgagcgacttaatttggatgagagcattccttgaagaaagatttagatctacattacatttctagatggtattgcacaatcggatgtaactatttggccattttcaacccattttcttcttttgtaagatgccgaaaaggaagaggggaataggaactaggaaggatatagattgaagcagattagctgtaagatcatttaaagtatgagaggtttttgggcagtatcttgaattttatatatttgtcacttacctttctctgtaaatatttgagggaaaaaaaggaaatcattctttaaaggaaaaagaagtctcaaaaaggtagcctgaaacatctagcaaaaacactgaagcaaaggaagttatacactttgccatggtaatggctactggtttctgggctttctagaacattcactatgagagccaatgctctccttccctttcccaccatctgcattagtcacttggctgtagaacacaaacagtgacttggagaagctgttgagaagtgaaataaagctacatgagaaagggcagatttttaaaactggagttctattgactctaggtgctgtcctaccaggaggcctgcttctacacaaatggacattgagagggactcgtctgtgagacgatcatccctttgactcatgcatataaggtgcgagaaaccagcatcctaagattggtcccagctcaatagtcttctgagactgggcatttattccatcacccttcagcccttgtggatgcccacaaccaaccaagaattctttcctaggagtaaggagtgcatagagccgttctagtatgataaatatcaacagcacacccattttcaactattcagaactgtaggaacggtggtgagaaaaaagttcaaagcacacttaaatttgcattagaaatgatctcattacctaatacatgattttaaatactaatctgatcaattcattatcaatatcagtttttattctttgagtcttcgatgacatacttcattccacctcttactctgaattactgaaaggaacagtattttttattcaaactctataggcacacaattcattatgcattatgcaatgttttgtgcgatgccatggctctgtataaaaatggaattaaaaagttgttaatgaatgggaactggagacctagatgtcgtttcttggtagctctataagcaaataaattttcaaacaaaattaatctattgttaattctattggactaagaaaatcagcaagtcagtagagttatgcagacacagtcagagcttaaaaaggttcctgtagagagtacagaattgtatcttttgggaggattttacaagataagaagtagtttgtttttcaaagatatagaagtaatgaagaagggatctgacaaagggttggtgaaagtaaatattttagatgatggagtataaaaagtataccaacttagcttctagaaagagtttctattgcaatgtaaaaatacagatatccttcaagacttagattacctaattatttcttaattcctaatatcttagagatttcttcaacaaaatggaccatttcttaaacctcacaacatttcctatctcacacaaggttttggagatctgggggtaacttatgaatgactaaggcaaatggattcacaatttgttgtggaaatctttctggtctgcttagaaaagaatactgtgataccttaagctcatttcaaaggaattccatggaaccagatcagagtctatatctttcctatggcctcatcttctgtctaatatcatggagccaaaatgtacacctggatgttcacaactatttcatatatctgggcttcatagacacatctcatttgagaagatctcagctgaaaaggtccagatagaggagtaaaggtccagatagaaggagtatagtaggagattgcaggggtcttaaagtttccttctcacagttcaccctatttgatcttaacacatagctcctgctgtggcaagcactaagccagccagtccacattctgtctcatcttggaaagcgtgtataaaccacattaaaattgggccagatagacttcaataaatgccttccttcagcttataaatgacaaaacaagaacttgaactagaaattatctttctcatgtcaaaaatctttcagggtcatacttccctcaggttcaaatttgaatttaaaaactattatttattttcctctatcttaatgcatagcactctttttttcaaatgtaagacaggatgttttaaacaatattttcaattaaaaaagatattcaatgcagttttggatggatctgttgcagccttgcaaattaattacaatgcccaacatttatggggtgctgacttctgaccctgtactctgttgcacttctctgtggatgatctcttaaatcctcacaaccacatcataaaatcggtactccattgtgcagatgaggaaactgaaaaacagagcgtgaataatttgctcttcaacgtgtagctattatcatgtaacaaattactcccaaaatgtagcaacataaaataattattgtttattttctcaatagtatctgagaatcaggtatctaagagcagtttagctaggtggttcagggtcagagcttcaagttgtttcatgaggtttctttcagtgtcttgagctgagggtctagtttctcgctacatgggcgtatgcacaggtctgccagcctgtccttaagacataacacctggattccccaagacatgacacctggctttccccagcatgagtgatctaaaatagagaagagaggagagagagagaaaaacagagtgagcatgtacaatctttttaaaccttatcttagaagagacataccatcatttctgccacattctactgctcaccagaccaatcctggtaaaatgtgcaagggaacccaacaggcatgtgaactccatgaagtgggatcagtgggaggcatctttgacgctggctatgatgcttattcactagcaaggagtagaactaggtaacgaatccaggcagttttacttcagcacttaggactctttaccattatattaagaataactgcaaagcacatatttatgaatcttagggcttttccaaaagcgaccctctatggagtttgtggatacttgtgaatgtcattctgtggcacttgcttatcaaagaacacctgaaaatgtgaaggagatatgaatatcaaggacaatagaggctaaatttccaaatgtcccagataatatacaggtcattgtggaaaagagaagataaaaagaggcagaatgaaaaatcatttcagttaagctctttcatttcgacataccattatctttgtctccttcgtctcctcaacaaatctctcaattctgtcaagtaccatgttgagaaatatctagggagggttttattatttcttaaacattgtagcttaaaaaaatctttacttttgatttcctataggtagtatttagtgctaacattttagaatattatggaagttttcaaataccaatgtgccttgttcagggagctaagtaatttggtgagggaatttctacttgaaaaattttgtgcatcaatgtcagagataaattcaattgtcagaaagctgtgtcagaacagatttcttgtcatattttgccgcagagcagagatttattgaaaatgcttgatgatatcgctctctgagctgttttacataaacatagcagtggagtgaatgctttgagttgaagcatttgtgtgtttgtgtgtatgtgtgtgtttgtgtgtgtgtgtatttccgactttcaaaactgacgtcaaggggaaaaataccaaaagatatcctaatacctaatgttttatccaacttactttaagaatgattattttttgttataagtaaatgtagacttctgtgccttttcagaaatgaatcatagaataaaatacttcaagatcgaagctttgggatactggctattctatctgatgtcacaaaataatgaacacttttgagatgcagaaacatacaacagatttattatttttgaaagaaggtttattatttgtaaaccctttgtaatcaggtcagcagcaaaaatacaaaactattagaaagtaaaatttctttcttcagtaatgaaagacttggaactgcagtgtaagttcagtctctagagtgctctcagcactctaactaaaagattatatggcttgcaaaattgttttatgtttctctctccaaatttgtttggctccaaatcagaagatacgtatgaaactctttttctaaacgtactgtgaaacatttgttaataatattattgcttgtattataatatactcattttgataataaaatatagtatgcacagtttgtggaatgagtattttctatatttaaaggagactaacattgtcacatttatgagtaaaaagtatcaatactgggaatgttttgcaatctagcaatccactttaatgactgcagtgatccatttgatcagtaagacaggtgaaataattcagttgactgcctcagagtctgggaatttgagttgtttaaaaatagactttatgctctggtatggcttatatttacaaatgtgttcaactacattattattatcattattattatattaactatataccccaggagagtaaatcatatatcaagtcactctaaaagtctccagtgtgttaaaatgacagatttctaaataatactcctagaaaatccttcatattaaactcacttgaaaaatatgaagtatctctagcactgtcctagaaaagacacaaagacaacaaaattataacttatttctttaaggaatttataacattttggctggtatctggtttgaatctctgattctttttaaaagtttccttgtcattttttaaatttccctttttctggagtctgtttacgtgtttatatatccataatgtgcttttcataaaatatctttattgaggcattgtgctttgtactaattactctcaaatgttcattcatgtcttctctaaaataatttagaaaaactatgtatcccctcatatatttaaaatttgacacttaaaatattttgttacacattaaatacctgtgaaagatggaatttttctgatgtaacatgcttttaaaccaatctaaaagcacaaaaataccatagtagtttgatatcaacatcatccccttaaaaaatatgtgaggaagtgccttgttaacagatagaagttaacaccactcatttttctccttgaactggaatctacaatttattttccccacagattaacatacaaacatgatctatttttatgtttgtgggtctttttttgattatatatctatcttatttttttgcagcataaaatttatataaaccaaaattttattttatgtttgtatttccagtgactatgagtctttgttaattttctttcctatggatcttgttaacattacaattagtgtttctccacaatggcatatagcgtaaaattttattggagtgttatcacttaatgacatgaatggggctttttgtacattaattgcatacatccatgtatgaatgttgcttattgcattaattctattccagtgtgcttgttgttgatctaaacactgtgaaacctttgcctatgtttgcatagatagatagatagatagatagatagatagatagatagatagatagatagatatagtgtgtgtgtatatatatatgaatgagtactataacaatgagatctttatagcaatcactgaacaatttgaacttctcccaaattacatgccaaaatcacattgtgacttcttattctgttatttttgataatttttcaactaacaactacctgagattttccttcaattatgctctaaatgaaaatgttagaaaccacctgacttgcagaagtatttgttactcattcaagttatttactttcttgttttctaggaggttcacaataaaaagctgtaccaaaatttatcagcaattttaaaataaacttgaaaattgctttcaccgagaggcactttttgtaacaatatataaagacaagattaggttgccttttcttttggtgattatttcctttgctgtgcagaagctttttagtctggtgcagtttcatttatttatttttgattttgaagccaagcttttggtgtgaaacctaaaaagatcataaacaagaccaaaatcaaggagcttttcacctatgctctctcctaggaattaacttctgggtcttacatgtaggtattttatccattttgtgttaatttttctgtatggtgtgagataagggtccaatttcattattttcaatgtgaaaatcattcccccagcaccatttatggaagagactatacctttttaacataatttctaatcaggaagtgcagtgcctccaactttgtttttctttctcagtattgctttggttattcaatatttgttatggtttcatagaaattttaagatttttttctatctctgtgaagaatgccattagaattttgatggggattgtgttaaatctgcatattgctttgggtagtatgaacctttcaacaatcccatttatatgtgaaatatatgtgtgaaataatacatatataagctcaaatacacagagatagagaatgaaacagtggttcccacaggtgggagggggagaggaaatggggagatgtaggccaaagaatgcaaaatagcagacatgtgagatgaacaagtctagagacctaacctacagcatgagaactaaagttaatacaattgtattgtattagggatttttgttaaataagtacattttagctactatgttactttgtcacaaaaagtaactgtgagccgatagatatgttaatctacttcactatggtaaccaacctactatctacatgtatctatatgtgtctcaaaatatgtcataaacctctaatatacacaataacatgtatttttaaaaaaattctattaatgtcatcactcctctacactccaaagcaagaatttgtgatagaacaaaaacccaataaaacccaacaattttttactgaaaaataaagacaagattaggaaaattgaaatatcacttagatcttcactaaagcaatttttgttgaaatgatttatctttaaatgatttatatttttattcaatttataggaaatactaatcatttaatctgattagcagagtcactcttcattttcaaaccagtccatcaaaatgctttatctgaaacagtctgacttcatttttcagtttaagtaaacatgttcaaatgcattttaagaaacgttataaatatactgaaaaataaattctggtatataatttcaatagctagtttactagaagcagcccttttaaaatcttttatcttttatatatttaatctgaattttcagttagaatttaaaagaaatctatatgttgcttctcattgagttacaatatgcagtgtaatttgtatctacaattataatgttataaaatgaggaatatgacaaaagaaaagattttcatttggtaaatgtgcatgcatgtatgtgtatgttgaactccagttattggcattaccatctaaataaataaaaataaattattaatttcatagacaggaatatactgctaaaactgatcattcaggtagctgacttaaattttgctttggcataataaaagatagggaatgctaaacattttataagaaaatataagataaagattgactacaattggaatatttaatatatattataattgaatagctattgaataatgaaattgaacaatactatctaaacctagaagatattttgtatgttttttatctgtgggtttcagccactgtaactaaaaaaagttgatattcctgaaaaacattcagttacacttaatatgtcactcacctgcactgatttgggtatttgaagatattttctatttaaagataaatcctaagtatgactattgagaaaacactttgcttctctctctctcgactgtccctcaagagcaatacattcttttacagaattaatggaaaattcccaacattttttcaacccactctacacaatatatttgatttgtgaacaacctaacctttctaatgccatagttcatccttaaaagaaagactaagaccaagacaaacaaacaacatgaccgacataaaatgttaaggtggatttatggtaacttgattaactgtttctttgtttggagccctggaatgttttaaactgcagggtaatatttcgtagtatgatgcttgagggatgagctgtcttttctaaagtaaaaagtgggattggtggagagaggtaagtaagggaacctagttgatactatgaagagtgtgtatagatttgaggatctgaaaattccaccgttttcttttttgcttgttgagtgaatacataaggttcaaaaaacccattaacctttttcttttgcagctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtgtaatgcattttcctctctttttaataagcacaaatgaataatagcaaaggtgtcttgtaaaatatgttgcattctgaccttatcccttagaaaagttgatttccctatgactgtggtactagaatgttcctttccaacacagtgctttggatcctagctcatgtgcatttgtactgattccctaggcacctttccacagcacactccactgacaatacaaggggaagtggtggggaaacaaatgtcaagtggttccatcaaacaatgatgtgatgggtacttgaaattaatatgtcctattaaataggaaattaataatcaagtgatatcttccaacatatttggtatctgttggttatgtctcactgattgctgatgaaccaataacttgggtgaatgctttagatttctttaatcaggtaagtgatactttttcagctttaaaaattaattatcagaaaaaaaggatttccagggtattatttcatttctttgaaggaaggtaggaatgaaaagagactctcaagctattatatacaccctggtgatttctgctgtgccatttgactctttttttttttttttttttgagcacagtgttttaaaatctattttatggttttcatctcttagaacaggtgactcagcagctcatgtgagataggatgttttgtaatagatatgatagtaacaacaataaaatatatttttgaggtaaggtatatttttctaaccaaacagggacagctctaagaaatcataaatcgtctagatacagcaaggttagaattaaaaggcatcaaagatctgccaagggagaattagatttattttctcttttctcactgcacataatatctacagaatagagttgtgtgcaaaaactcgaggaaaaatagttgcccaaactgcattgaagggaattaaataggaaagatgtagaaagtctaataaccaaaattttcaaatcccaagacaactggaaatggaattccaatcaaagaattgagagcccacaagtgccttcttcacttctaaaatgaagctctctgcaacaaaaaaaaagacaagttttaatgttagtttagtattcggtctattggtttgttgtctcctacactcttttgatttcttgtatattctctgactttaaagggaaacatgaaaagaatgtgtagactttcagaggctgaggtgggcagatcacttgaggtcaggatttggagacaagcctggccaatatggtgaaaccctgtctcttctaaattagttgggtgtggtggcgcatgcctatagtcccagctatttgggaggctgaggcatgagaatcttttaagcctgagaggtggagattgcattgagctgagagtgtgacactgcaatccagcctgggtgatggagctagactctatttatttcaaattaaaaaaaaagaatgtgtagaatgacctttatcgggtttctccatcatgactggtacaagccaaaattcaggacttttaaaattagtaattcactatttttattcgtgttgtgttactcatttcttgtccctttttttaaaggcatagttttcttttgaaaatttattcattgagatccaacatcaatttactctttccgttttcctctttcctcttaaattggtgcagcatgtgaaactctctcttattgaatcatggggaaaatgattccaaaagttaaagctcaacgaaaatgaataaagggaattgactagtataaaatttgtttttatctgtggttaaaagtctcatgtgtgacttgtgattttgagagtgagtaggttgtgtgtatgtgggataggaggcttgtgagaaatctctgtaccttctgctcaattttcttgtgaacctcaaatgcctctaaaaataaaatctattagaaattaattgattgggccaggcgaggtggctcatgcctgtattcccagcattttgggaggctgaggcaggcagatcacgaggtcaagacatcgagaccatcctggccaacatggtgaaaccgcatctctactaaaaatacaaaaaaaattgctgggcatggtggcatgcgcctatagtcccagctactcaggaggctgaggcagaaaaaaaaaaaagaaattaattgattaaaatatttattctctagaagatgtttttattttttaaagtaaggattattaaataaaagtagttatacgacaaaatgcttagtgattttttaactttatctaaaatgaaaaggcattggatgttctactcctgcccaagattttacagatttttaaaataaatacatcttcagtcattcatcaagaactttttgagcaaagctatgcacaatgcaaagcaactaagatctaatatgtgttccaagtgactgtttaaaataaataacactcaccctcctttctaggaaactaaatattctctaaatcactgtcagaaacaattaactaacttcccatttcccgtcattccctattggtttctaaatgccttagagaacactaaacaaacattcctgttctctctcaagcagaaaacatttcatgaatctgggtggatatatcttattagtcgccttgggaaacagagaaaggcacacgtattaaaagaaaaagttgactttgccaaggtggaaactctttttcctccaaagttatctgaaagacctttgagttttataagaaatgaaatgaatcactaaagtcctattccaaaggtctgctgccttctgaaggcacaaataaagctgaatttctctccaaccataaggaaagaaaagatatggtacatacatttgcattacatgtattcgctgacctatcagtaaataatatttatatttatatagttgtgatggacaaatatttcttcttcttaataagtaactgcagtactgctcttagcctcaataagcaaatgagttatccctagggaacagtttagctgcattgtatttgaaaacttcaaccaatagatagtcttggggcctcatttctacaaatcagtacaaaattggtgcccccactttcttgtctttgaaacaagtaggtggtagaggagcagtttaagtgatttccactcttccttttagttctgacattgtcttaactagtgggaaggctggtcagctttattcatgctatttttctgcctctgttctccctcaaatgggaaatcaactaataaatgaaacttgacctagataaaatgaggagtgcaatggagttcatagagtaatctctagggtattttaaaaaaatacaggctgtaagaaactggggttatgtaaaaatattgtgttacgtcgttcttctgaggttaatgagtgaattgggtttctagaagtgttcatgactcagtctttgcttagagttattggcttgctatatttctatcaatcacatattgtagtttttatatagaagaaaattcctcatttccatttttataatattttcccagttattctgtagcaattatttatatgtattgacattaattattataaagtaccttgagatttgactctgctgtgtaatggtatgctatttgtataatgaattctgactatttcatcatgtaacaacaagtgccttgctagcatgtatttgattctcactcgatactctgaattgcagagcaggggcacgtcatggacaaaagcaggtttctttgctttcagagatcttggcagagctaaatgtcatgccactaagccaatttgttttgtttcacataggtgtcctaaagccagtgcctgaactggacaaaagtgctcatctgaaatgagagtatttcactggcggaccagttgctattgtatttgttaaagggtttttgctgccttaagtgtcaggcagttccaaaaagcatttattttgctccacttaaaatataagaattatgaattatagatggaaatcctatacctgttcattgtattcattttgaacacaacagaaattgtcccttagggattggtgatatattccgtcttgaggaagggccctctcactcctgtctagtacattaggcactttcctattctccctatgtggtactaaggatggattttgctaaagaggggacctacctatgtaaagccatttttacttctgtcaaagtcaagagccatatcatgatgtttgtttgcagccaggatcacaggagccagctgaaaacttggggatagaagactgggcatgcagacaatttttgtttttggagatgctgatgaggagcaatggcgttaaagagtaggattaggaaaaaagaaaattcagtggcgtaatcagaattcatgtgaaatatgaaagttttcaaaataagagaccaaatttcaaaagactaacaaatgcatgtacattctattaaacttacaatcacaataatgtagatttctttattatactttaatttctggggtacatgtgcagaatgtacaggtttgttacatagatatacacgtgccatggtggtttgctgcacccaccaacccatcatctacattaggtatttttcctaatgctatccctcccctaccctccaatccccgagaggccttggtgtacatgtgtcctcattgttcatctcccacttatgagtgagaacatgtggtgtttggttttctgttcttgtgttagtttgctgagaatgatggtttcctccctacaaaggatataaactcatccttttttatggctgcattgtattccatggtgtatatgtgccacattttctttatccagtccatcgttgatgggcatttggattgcttccaagtctttgctattgtgaagagtgccacaataaatatacacatgcatgtttctttatagtagaatgatttataatcctttgggcatgattctgggccaaatggtatttctagttctagattcttgaggaattgccacactgtcttccacaatggttgagctaatttacactccaaccaacagtgtaaaagccttcctatgtctccacatcctctccagcatctgttgtttcctgactttttaatgatagctattctaactggcctgagatggtatctcattgcggttttgatttgcatttctctaatgaccagtgatgatgagcattttttcatatgtttgttggctgcataaatgtcttcttttgagaagtgtctgttcatatcctttgcccactttttgatgggatttttttttattgtaaatttgtttaagtgctttgtagcttctaaataaatattagtcttttgtcagatggatagattgcaaaaattttctcccattctgtaggttgcctgttcactctgatgatagcttttttgttgtgcagaagatctttaattagatcccttttgtcagttttggcttttgttgtcattgcttttggtgttttagtcatgaagtcttttcccgtgcttatgtcctgaatggtattgcctaggttttcttctagggtttttatggttttaggtcttatgtttaagtctttaatccatcttgagttaatttttgtataaggtgtaaagaagggatccagtttcagccttctgcatatggctagccagttttcccaacaccatttattaaatagggaatcctttccccattgcctgtttttgtcaggtttgtcaaagatcagatggttgtagatgtgtggtattatttctgaggcatccgttctgttctgttggtctgtatatctgttttggtaccagtaccatgctgttttggttactgtagccttgtagaatattttgaagtcaggtagcatgatgcctccagctttgttcttttttgcttaggattctcttggctatgattctcttggctatatgagctcttttctcgttccatatgaaatttaaagtagttttttccaattctgtgaagaaagtcaatggtagcctgatggggtagcgttgaatctataaattattttgggcaatgtggtcattttcatggtattgattcttcctatctatgagcatggaatatttttccatttgtttgtgtcctctcttatttccttgagcagtggtttgtagttctctttgaagatgtccttcacattccttgtaagttgtattcctaggtattattttgttctctttgtagcaattgtgaatgggagttcactcatgatttggctctctgtttgtctgttattgatgtataggaatgcttgtgatttttgcacactgattttgtatcctgagcctttgctgaagttgcttatcagcttaaggagatttagggctgagatgatggggttttctaaatatacaatcatgtcttctgcaaacagagacaatttgacttcctctcttcctaattgaatactctttatttcttcctcctgcctgattgccctggccagaacttccaacactatgttgaataggagtagtgagagagagggcatccttgtcttgtgccagttttcaaagggaatgcttccagtttttgcccattcagtatgatattggctgtgggtttgttgtaaatagctcttattattttgagatacgttccatgtatgtgtccaggaatttatccatttctctagactttctagtttatttgcacagaggtgtttatagtattctctgatggtagtttgatttttgtgggatcagtggtgatatcccctttatcattgttgattgtgcctatttgattcttctctcttttcttctttagtagtctggctagcagtctattttgttgatcttttcaaaaaaccagctccttgattcattgattttttgaagggtttttcctgtctctatctccttcagttctgctctgatcttagttatttcttgtcttctgctagctttttcctgtctctatctccttcagttctgctctgatcttagttatttcttgtcttctgctagcttttgaatttgtttgctcttgcttctctagttcttttaattgtgatgttatggtgttgatttcagatcttttctgctttctgttgtgtgcatttagtactataactttccctgtacacactgctttaaatgtgtcccagagattctggtatgttgtgtctttgttctcattggtttcaaagaacatctttatttctgccttaattttgttatttacccagtagtcattcaggagcaggttgttcagtttccatgtagttgtgtggttttgagtgagtttcataatcttgagttctaatttgattgcactgtggtctgagagactgtttattatttccgttcctttccatttgctgaagagtgttttacctccaattatatggtcaattttagaataactgtgatgtagtgctacaaagaatgtatattctgttgatgtgggctggagggttgtgtgggtgtctgtttggtccagagctgagttcaagtaatggatatccttgttaattttctatctcattgatctaatgttgacagtgggctgttaaagtcacccactattattgtgtgggagtctaaatctctttgtaggtctataagaacttgctttatgaatctgggtgctcctgcattgggtgcatatacatttaggatacttagctcttcttgttgcattgatccctttaaccattatgtaatggccttctttgtctcttttgatctttgttggcttaaagtctgttttatcagagactaggattgcaacctctgctttttcttgctttccatttgcttggtaaatcttcctctatcccttcattttgagcctatgtgtgcctgcacgtgagatgggtctcctgaatacagcacactgatgggtcttgattctttatccaatttgccactctaattggagaatttagcctgtttgcacttaaggttaatattgttatgtgtgtatttaatcctgtcattatgatgctagctggttattttgcctgttaattaatgcagtttcttcatcatgtcaatggtctttacaatttggtatgtttttgcagtggctagtaccggttgttcctttccatgtttagtgcctccttcaggagctcttgtaaggcaggcctggtggtgacaaaaatctctcagcatttgtttgtctgtaaaggattttatttctctttcacttacaaagcttagtttggctggatatgaaattctgggttgaaaattctttaagaggccaggcgtggtgactcatgcctgtaatcccagcactttgggaggccaaggctggtggagcacctgaggtcaggagttcaagaccagcctgaccaagatggtgaaaccccatttctactaaaaatacaaaaactagctgagcatggtggtgggcacctgtaatcccagctactcaggaggctgaggcagagaattgcttgaacctgggaggcagaggttgcagtgagccaagatcgcacactgcattccagcctgggtaacagagcaagactccatctcaaaaaaaaaaaaaaaaagaaagaaagaaaattctttaagaatgttgaatattggcccccactctttctggcttatagagtttctgccgagagatccgctgatagtctgatgggcttccctttgtgggtaacccgacctttctctctggctgcccttaacattttttccttcatttcaaccttggtgaatctgacaatttgacgattatgtgccttggggtagctgttctcgaggagtatctttatggtgttctctgtatttcctgaatttgaatgttggcctgtcttgagaagttctcctggataatatcctgaagagtgtcttccaacttggttccattctccccgtcactttcaggtacaccaatcagacgtagatttggtcttttcatatagtcccatatgttttggaggctttgttcatttcttttcactctttttgctctaatcctctcactttatttcattaagttgatttcaatctctgatatcctttcttcccaagctggctctctagattcctcgtctctgggcagggcatctctgaaaaaaaagcagcagccccagtcagggacttataggtaaaaaccccatctccctgggacagagcacctgggggaaggggcagctatgggcacagcttcagcagacctaaacgtccctgcctgacagttctgaagagagaagtggatttctcagcacagtgtttgagctctgataagggacatactgcctcctcaagtgggtctccatccagcccatgtatcctgactgggagacacctcccagttggagctgacagacacctcatataggcaagctctggctggcgggtgcctctctgggacgaagcttccagaggaaggtacaggcagcaaactttgctgtcctgcagcctccactggtgatacccaggcaaacatggtctggagtggacatccaacaaactccagcagacctgccacagaggggcctgactgtttgttagaaggaaaactaacaaacagaaaggaatagtatcaacatcaacaaaaaggatgtccacgaagagactccatccgaaggtcaccaacatcaaagaaagaccaaaggtagataaatccacgaagattaggagaaaccactgcaaaatgtctgaaaattccaaaaaccagaatgcctcttctccaaaggatcacaactcctcaccagcatgggaacaaaactggacagagaatgagtctgatgaattgacagaagtaggcttcagaaggtgggtaataagaaactcctccaagctaaaggagcatgttctaacccaatgcaaggaagctctaacccaatgcacggaagttaagaaccttgagaaaaggttagatgaattgctatctagaataaccagtttagagaagaacataaattacctgatggagctgaaaaacacagcacaagaacctcgtgaagcatacacaagtatcaatagctgaattgatcaagtggttgaaagtataatgtagattttatttcaaaaatgcagaaaaagtagaaaaggaaaaattgaaagaagggagtaaaaaaggaaataaaacatcataaacatattgtccctttaatggctaaaccagtgtttaaaatgtaatgtgcattaattgcaatccatattcaatagagagaattatttaaggcagatttttgaggaaaattgtgaaatttctttccctggatgaatatttttaatgtggcatttatagaccctttaatgaaaagctagcccattggagataaaggaggaacctagagaaatagccacaggaacatcatttgtgagacgcacaattcacagaggaacacagaagccaaagcattttcacttccccagaatttcttctgtgaaattacaaactctttctgatgaataattttctccaatccaacgattatcttgagaatcctttgtgaaagagcctgccttttcctcctaagcaatgcctgcaatctaacatttcacaagcatcctctgagacctgtggttggaaggaattgctatcaaggaggcccacattaaggtaaactttcttatgggaacaaagagtgaggagaggacttgatgtcatctctttcaggccagtgccacaaagatgcccaaagttgggtcttggctaaaaattgaccatcggtcatagtctcctttagattaaatgagtcaaaagtcaaacctgagtaattttcattgtctctagaaccacactcacaaaaatctcattacatgacactgtttgaatacaagcacacaagtgtttctctcccctttacagtcttaaaagaaatttagtgccttgtataacacctacctaaagcctcgcatctgaaagccaacatcaccaaggatttgccttaatggtttacttgcagccctacactttatccttaatactgtgcattcatttgctctttttcttcttctttggtaagaaagatttcctagcctggaaataaggcacttctcttcaaactccttgggattctctcatttgctgccttgattcatttcccttgttcaaagaaatcttttatcaagtctctgcctgtattttggctctgattgctatatggctacatcctgtgctcagccaaccttgtatctatctttctaccttcatctctgaatgggataagcctggaggctgctcaatgacccagaagacctctaaccccttctgaatatagaagaatgagtatagataccctctgaagacacatttcacttctgcataactttaattctatgtcttgatcttttgtatcttaaatctctattcccttcagaattatcagattttctatttcctctgccctttgatgacctccttgagcctccgggagacttgtctcaaaattatctcactaattatcttgaaatatttcctggttaaaaattctctttcaaaagcaagatattatcttatatcactgcattttgttttgatttatctgacaaaactttattaagaaataagtcatcagaaaaaatattttattaatacttaaacctactatgcagctcgttttgcttgcagtttaacctggacctgttaactttgaatatgaatgaatagttcaagttcaatcactgtgtcattaacaaggaaaacttccttgaaaatattttattctgtcttaactgtgttctctggaaaaaaaaaaaaaaaggtgtatttccatatacaaagcttttcaaatgcccataggcactcacagtaaccgtgcagaacctcttcaactaccgtaatctgcctgaaaattacaaggtttactatcaaagaggaaaaattgcaattccgcattcaggcaacttgttctggcagagtcatctctcatataactttttagctagatgtgcctccattttgttatggaagataatgatagtggttattatttgtatcattttattagcaatgcctctgagcatcctgtaactctgatttgtttgacagttgacatggcatgtttaaatcacagaaaaattggctggtagaaaataatgcagctgtaacagggtttggtacattgaatttcactgacattgctacttatgaaaggagaaataactcttttttctcgcttcatcacttatgattagagggcccagacagttcaagcaatatagtcagtgctcaatatattttactattctttctcaaagataaattcctgtcctgctggatctatttctattgtttaaaggggaagtgctgtcatgttccgtaagtatatgaaggtagacgaatgacaatgttcataacttggagaagagactgaccacatcctatcacatctctctgaatggatgcagggactgttccagtgacttaaggaaaacagactttgtccaggaataatgaatgacttttcttgtctccactgcagcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccaggtaaagtactcggttgttcacctttaaaattcttattattattggtgcctctatttaagtgcatgagggtgcttgagaaggcctagatgtcatatatcttttcaatgctgattacatgcccagtgtgctcatttttgttactgatgcttgtagtgtaacccttaatgacccacctcccaagcaactgattggttgtaggtgcttttcatccctttggaaagttgtccatgaatcctggaagccagtccaccatttttaatatgtgctataggtgtgcttgctagagaatactggaaacattcctgattccctaacttcattctgccacatgagttctaagcgttaaagctagactgcaagactagatgtaaaggtataaaaatctgcaaaaccactttttagagaaatcataattctaatttgtgcctttcaatagtcatttctcaggagttcttatttatttcagagtactaggccacaaagaaatgtcagaaccagtgctgagtacaactcaattaattttaaaaatgaagaaactaactaacatttagattgatagaaagtaaaatatctatggtcctttctaagaaaataagatggcagggatgggaaatgagtcccagattcccaatgcagtattgattttattacttcagctagtatccaaattgagctccattttgtttttgttaggggttgaggagggggagagagaggcagagacagaagaaggaggagaggaggaaaagaagaaacaggtagaatgaatgtcaatagataagtagagataaataaataatagtacttaaaattatttggaatattagaataattcttaaaatcctcagtatatcaggcataagatagtaaatttcagtaatctgagatggcctccttgatgagcataggcagctgaactgggctaatctacattatgctcatacatttgactaacttttctgttactcagacctacaataatttattttgttgcattagtacacaagccacataatgactgtaaaagctagaaaaatgattgtctatgaagtataaatattaattattttatattaagaatgtatctagttgctgggatgacattagttgatttgtacacatcacctctgatgttctcaacattcacatgatgtgcaatatggatactcagctacacagcccctgggaggtggagtggagcatgaaagcatgtaggattccattggttgggacgcacgttccactatggagtcttccttgacacataggctcagcacaggtcatgatttcattctacaagagatggcccttctcaccccagcaaagcccacatagggacttaaaaaggtctgtattgcccaagcccctctctccaccctcccatgcatacacactccacacatactacattatggggaggatctgctactttatatggccccaaaactatgaagtctttgataattgaggcagagacaacttgaagcaagagcattcatttactgaaattctggtgccaagagtatgcttccttgtgatttctggctgcatctgtttccccactgcaagcacaacccaaggaaacagaccttgaaggaaactagtattcaagatagttgacagcttaattgcaactgctaacaataacgagcctttaatgaatctttaatgcacctgcctataggacaggcatgattctgaaggcttattacatctcatttgatcctctaaacaactttgtaaggtagctattagtcttaaccccattttaggcacaaggaaactgagacacagagaatttaagtagcttaagtctacatagcaagtaagtaatgcatcttttccctgctctcctgggttctcaaattttagaaactcatttgtgcctcttagtttatgtctaacttgtttaataagaaaaagactaataaaacgactaaatcattaaattaaatcattagaagaaaaaatcaagaaacatcttaaaataattctgaattgaagaatatattttctcatcagatttcttcactcacattttaatgaggaaaggtaagaaccttaactattctatagtaaagaggaccaatttggtagcaacaaaaagtaaagtgcggttgcagcagtttatgctgttaatgttctctcggcttgcaagtaaaaactttaagaataaaacagctgaaaatgacattctggaggctactatggctactttaaatgaaaaattttactgcaccagtgatgtttagtttgggacacaagatttggaagtcaacctatgctctgaagtgctacaataacaaaaggatacaattttttttaaagaagatttgatgatagatggagcagagaattggcatttttttactagttattttcttctaattacattaatgccaaagctgcctaaaacaaaatctgatacaatgcagtataagtggattatgtccttcatagaagggaagtagaatcagttgtgctgtttctatactaatttcatcaaataataagcatgtctgaagagccaaagaaccattctctgatctaatggcaacaaggcaaaatctcgttttcttttattttcatggtacccttaagatccttcttttgtttttatttgaactatttctctcaagccatctcttctttcctattttcagatatctctggctagagtttttgtttgattttatgttttttatagctcctctttaaatgccactcctctcccccactcaactggaggcatgccccgccatccctttggaattattaaattctttttcctttagtgtttctctcttattgtcttcctatgattcctgttcatttcataatgtcttacctcatgattttcaaataagttcttcctgcattgctcctgacacatggtaaatagcatgctttttaaaagggctaatgtttacttattctgatagaaaaagaaaattagcagactgacaaatgtattagctgtgacattaactacatgcttcttagacttaaagatgaaatacttagagctttcaacaagttttgattctaagaaaatcattactttcctcaaaccgattgatgaagtaaagtcattctcttgtcagcttttaaaaaaaatacctcaaataattttactgtggatttcacaagaaaggactgcataattagtgatgaatttatctttacttaccgcaagtaattactttagaatatggtaatgtgaggcattgctctaatttttaaaaatgagaaacttctactttgaaagctttgagattaggatcaaggaagaagctctttccccactcaaattcctgtgtgtgaatttgcttttttttttaaatttattttattttaggttctggggtacatgtgcaggacatgcaggtttgttacatagttaaacgtgtgccatggtggtttgctgcacctatcaacccatcacctaggtattaagccctgcatgcattagctatttttcctgatgctcttcctcccttcaccctacccaccgacaggccccagtgtgtgcagtgtgtgttgttcccctccctgtggattttcatgggcaacaccatcagtctgtgccttagtttgcctcccaataaggcacacagagctatgcttgcagcagttttacatgggtctagggcaaaacatattatgcagtaatagtctccatggggttgcagagcattttgcaatatttttatagtaagcagtaattagaaagccattctgttgtcataacgactgaaattctgcttacctgaaaacagattcatttcctcaattttttttccttccacctgctgagttaaaaatgtaacttacaagactctagggtatttatggtgtttcttacaatttcatcatcaccttataatagagtgcttccattttttaatgctttatctatagacgtgaataaccgtgagatctttacacatttcatggaggctgcaatcactacactttgcaaatcacaaatgtagacatgtaagtgatttggcttagtccactttcaggttaaatagaaaatgtttgatagagtattgggcttattgcattatagatctgacataaattttacaaagggctaagatagggtgtgtgggtttttttcttctttactagttaaaattccttttagtgatcagctgcactttaaatgaacctgggttaggagaccatttgtcttctagagatgtaattctaaagggaaagaaaatgtgatctcttaaatagtgacctttatatcataatactcttttataacattagccccctggacctcttgcaactttgtaaaactccataagcactatattttccttcatttacacattgcattttacacacatatatttataaaagcaaaactccagagcattctgatcttttccatcttcaagggatcaatatgtcagtggacatgacaagtccaaaactcacttcattgtactgcgaaattgagtttgattttccccgtgcaaattgtggcatgtgctttaatttgtctgaggactgaagacaaggagggggtggaggtggctgacagtggacagaaaaggcgtttgatttatattttatggatggttgggaaatcatgtattcctgctgtaacctgatctttttggcaggccttatttcagtaaatctgctatcacacaaaactgccaataaattactataatgccttaatacaattgctttccctgagccactcgtaggctgccattgcgggtattcatcaagaataccacacgagtgttccattctgctaaaatcagccacaggcagaggtcatgggagatcagacatcctttagaaggtgacacaagacggtcattttaaaggccagtcagatagaataaatcattggcacagctaaataggagagatgtgttgatttgctgttattgaagccaatacttccaatcaatgctatagtggaaaattacactacatctaagtttcatctcatgtgaaagctatcggtgtggctttttggtagacatctccttgaaattttcctgtcctcactcctaacagaattaggatgattcgatttggtctggtcatcctaaattaccattggtaaaatgtaattaaggcaaatttaagtatcaataatgtttgtgactctggaacctacctacttggtggcttaataaattagtatttcctctgaggttttagaaaataaatattaataggaaaagagctctgttaattgcccagaggagagagaaataatttctagaagagtcattatgcgtaagccaagtaattgatgccctatttataagtgacaaagcagaggcctaaaaacgttaggtagcttgcccaaggtcaacaattgaggtgacagccaaatgtaaagaatttggagaaatgtttttttgtttgtttgtttgtttttttaactaactttgaagatagatagatacaggattttacctagcttttttgtgatgttaacagttattcttagagtgactttttccccccctaaaaggggtcttctaggatcctaataattaaatattctttaggaggaactacatcaggtaagttaagtcatttagctgagtgtttgagtaaacattttattcctttatgttggcattacatggagaggagatgttatagcaaaagtagcaactagctggagcactctggaatagctgccatctgcctttaactcacctgtccagtctgtctgtcgagtatccctctacggtaaggcaggaagccaggggctgacatctgacatctgttgctttcaccatcactgatggccaaggctttagaaacaaattaaaaaaaataaagatgagcataaagaagtatataagagtttaaggcatatgggactattgcttacaatgggagttggagagtgtgagcataggtcaatgagagcaaaaactgaacagctagtatttttcagaattgcaaaaacttcttttggggagggagtgaatgactgcagtagaaaagtttgagtcccttttatgaaaggtttgcccaattacaagaaaatatcgcatcaagaattgttagaccatatatgaaactgaagttaactatatcaacctaatacaatgaaactctgaggttaaagtattcagtggccatccagataatcgtaagagaaagtgaaaaataataaataatctattttcagaactttgtaacctaatagaagacataattcgaaacatgtaagctacaaagaatgtacttggattatactgcagagtgggtggccgcatgagtgacagaaggaatggtgaaggaaaggtgggcagtaggttgttttcaaggcagtaaatattccttttacatttcttatacacttgatgggtcacatggttaactactgctgtatagattttgttgttgttttgaaatattttgaaaataaagcatctttttaaaaatcaacttacataaaagtagtaaggcttatgctttatactttgtcacctttttatagtttacagaggacatttccaaataaatgtatatctacctgagaagtaactttgaccagcattaccaatacagaggtcaatatttagagaggttgaatacctttcaacttttccagggtcatgtgtcattattcttaggaccttcatcgccacccttacatatggtggacactcgaatgttggttgaattggtcagaatataataaaataattaaggtgagagccagaatttgactgcagttcttcaatttcaagtctaataatgagtttagacaaaccagagcgacttgtaagtttgtaaggattagatatcaggtactagaaaaagataaaggcagatacgatgaaataacttacaaattcatgaacattttataacatgtttaataatctgaactataaatagcatcttatgctaaagccaaataaattgcatagagtggaaaagacacttgaaaccacagccctcggaaattcagtggtttatttttatgaaaataaacagacatgcagtggcctccataaagaagaatagaattctctgcgttcatagaaaggaggcggccaggtgtggtggctcacacccgtaatcctagcactttgggaggctgaggcaggcagattgcctgagctcaggagttcaagaccagcctgggcaacacagtgaaaccccatctctactaaaatacaaaaaattagccgggcatggtgtcatgtgcctgtaatcccagatactcaggaggctgagacaggagaatcacttgaacctggaaggcagaggttgcagtgagccaagatcatgccactgcactccagtctgggtgacagagcaagagactccatctcaaaaaaaaaaaaaaaaggaggaggagtgtggatcagtggaagtcagtcagagtcctaaggactagtctctccatcatgccaactacagaactgattttgctcttctgaatctcacttttctcatctgtgaaatcagatggtctttcctctttaaggaggaaggaaacatgaaattctacaacctcagttactacagaaataagggtagatattctccctttctcctttttgttttgtgaaagactatgagtaagagaaaggttttaatttgaatattttgagactcatggtatacattttaagtattctaagtagttgacagatctttaaagttcttcaatgagcatcaagttacagttgctttctttggcagcaaggggaaatgttgaaataaagtgctcacataaacctctgtgctaatggactattgaaaatgtgttatgaaaaatctaacatactgaaagcaaacaaaaagtctctgtcatattaaacagtttaaccatcagcaacccatttctaaagacatgacctgtagtacctaaaagactgtgtgaaaaacagtcttcgatttgaatgtttataactcttatcttactagcagggacttataaacgaattcaggtgtcatgttaaacatcttgtgtgtgttccagcattgactttcatcttaggcttgcaggaggactgatgttcttatctccaggatctccttatttaccggaatatcaaggctcttagaggagaatgcctttatcttctgtggtaaaagggattctacaagcttttttggtggaaaacaatgataagtaagccctattcatgaaaccgtatgcctctcattttgaaatgaataattgcacgtacagacttataagaataatggcacttatagtgactgctatttttaatgtctttttcaaagtgctcttctaaaacattcttctttgacatttctgattcttttacccagcaagttttatgtatttttctacttctgaggtcacctgagtaagaattttctaacagataccactttttttttttttttttttgagatggagtctcgctctgtcacccaggctggagtgcagtggtgcaatctctgctcactgcaagctctgcctccggggttcacgccattctcctgcctcagcctcccgagagctgggactacaggtgcctgccaccatgcccagctaatttttttgtatttttagtagagacggggtttcaccgtgttagccaggatggtctcgatctcctgaccttgtgatctgcccgcctcggcctcccaaagtgctgggattataggcatgagccaccgcgcccggccgagaccacattttttttttagacagtctcttactctgtcacccaagctagagtgcactggctcaatcacagctcactgaagctttgtcctccctggcagtggttatcctctcgcctcagcttcccgagtaactgggactacaggtgagcgacacctcacatgactaatttttgtattttttgcagagatgaggttttgttatgttgtccaggctagtctcaaactcctgggctcaagtgatttacccacctcactctcccaaagtgttaggattacaggcatgagccaccgcgcctggctaagactgcatttttttaaaccacgataacctagtatgctcttgagtcaaaaattaacttttagttttagtgttgcacttaaaagaatatagttatttgtttattttctttttggctacgctctgagtggtacctcatttaatagaaacaggctgcttggtgcacacatgcctgagctgacacattagaatacttgataaatctggagaacacattgcctgataagttgagcccagtgaagttttcatcaccttatgagagacggtgagcagaggaggtcagagcaactgctcagagctgtctgaatgtcgttcccttagtctagagaaaagagtggcctctttcatttggacagggcttgctctcaaatcataaatgcatttgacagccaggaagccattttcactgtctcacttaaatggtcacactgcaaatgatcccaccacattacaatagcataggtccccagtaaggccttatatccaacaggtgtacagattaggtggtcactacctggcttcttctctctcataaatactgcatctcccgacttgctcctcacaatggaccaatttaatgtgattaaagcttctggagtttcctagatcccagctctaacttccagtttagctattccctgcaccaactctctgcaaagagaatcaatagcaaagcaaagagggataagaagtgaggagtaggaagtaagctattgaaagtgagaaaaagaggttatttctcattgagcacatgtaaaacactactgatgtctttgtcttctcactgaaaaattatacattttgtttttattaagcatgttacagtatgggtaatgtccaaacatgatttgagatataaatattaacttctaagctcagcatggacatggctatcaaaagcagtgtttctcaagttttgtgtgcctgggaatcacctgcagacattatgaaaaggcagatttagatttagcagatctagagtagagcctgaggttctgaattgctaaaaagattctaggctttgctgaggctgaccctctgcagattagattatgaggtagtttggattctgaacagattggatgctcttaacctggggttcatggaagaacttgtgggtttggtaactcacttgaaattaaatggatatttctctgtgggtgtgcctgtacatttttctagcaagtgagttcatagcattcattagtgtctcagatgatttattatctataacaggttaagaaccacttgacctgctgttttgtcatcaccctcaatgtagctcacctgtggaacataaaccaatgtctgtttttcttttgttttgtttttcaagatcagttccaaaaccttgtactgaaacaacttttctgaatctgaggccaaaagctgagtacttgtgctctactcaaatgaaactctgcaaaatttattcattttcatagaaacacctgaggctttgtacatttttcaacatgtgatgagggaattagttaaattagtatttataaatttgtccttcttctgcaacaatctcttatttttattgcctaaatgaacatcagtagatcagagccaccgctgtccatggtatattttctccaaaagatgagctcctgtggggaaatgggatgtgttgtccttcgaaaggggtcatcctaacctgtccttagcacccctcaaatggtacactgaaaagcacttcctgcagagacttaatgactgcacacacatttccccaaacatgactcatcatttaataaaaatttcccattcagccagtgtcaccccaggttgaacagcatatgcaatctgtaaaataaattttaatattttttctggtggtagggagggtaagtgaacccatgaatagtgataatgttaaatcacagagaatgggagctaattaaaataaatgtttatttgagcagtcaagtagttcaattgtattctataatttcccagaagatattatcataaatcatttattgggtataaaaatgccgtaagtcaaaagagtatgtgtttgaggaggctggagagtgctaaagaggagttgagagaaaggagtgcaaaaacaagaaagatatttgaagacagttttcatcctttgcattattcaaactaaagaagctctaaagccaagtactatgtttgtttgttattctttcccaagacttcagaaattttcacttccatgatactgtgatgtttatatttatattggctccccatttaaactggaacaagtctagctgggatcaacatagagaagacagcaggaatatgctgatttactcctattccttcttctacctctttcatcaccccctgccaccatcccacactataactgctgtctcttctccttctctctcactctcacatactcctctcctctaagattgtctggcctgttctgtttcactcagctttctatcaaagcctaccttgtagaattttttatttttgtctaagaaagaacatataatttaagccttacttatcagctgagtggctttgaacaagtcctttatcttctttgaattttgattttcctatccccaaggcatgagcaataaggtatgctttaaaagttctattttaaagaacagataagaaaatgtaggaaaaggtgttttactgcagtttatgtacctgtaggtgggacaaaggttacctgttttaccctttctctctctaggttttagtttataaaaataatagagacaaggtactgataaccagatgggaatcaaggattgcagagaatcacagccttttggaaaatggtaggagtaggtggaagacctcttcctccctccctgactacaagaatattcgacctgctagctgtaaactgaaacagacagtagagaggtggctgggacttctggagtcaggccttgccttgtttgcttaacaaatgcaattcttgtgaagtttaaggatagagggtcgagaagccaagatggccgaataggaacagctccggtctacagctcccagcgtgagagacgcagaagacgggtgatttctgcatttccatctgaggtaccgggttcatctcactagggagtgccagacagtgggcgcaggtcagtgggtgcgcacaccgtgcgcgagccaaagcagggcgaggcattgcgtcacttgggaagcgcaaggggtcagggagttccctttccgagtcaaagaaaggggtgacggacggcacctggaaaatcgggtcactcccacccgaatactgggcttttccaatgggcttaaaaaacggcgcatcatgagagtatatcctgcacctggctcggagggtcctacgcccacggagtctcgctgattgctagcacagcacggcagtctgagatcaaactgcaaggcggcagcgaggctgggggaggggcgcccgccattgcccaggcttgcttaggtaaacaaagcaaccaggaagctcgaactgggtggagcccaccacagctcaaggaagcctgcctgcctctgtaggctccacctctgggggcagggcacagacaaaaagacagcagtaacctctgcagacttaaatgtccctgtctgacagctttgaagagagcagtggttctcccagcacgcagctggagatctgagaacgtgcagactgcctcctcaagtggatccctgaccccgaccccccagcagcctaactgggaggcaccccccagcaggagcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaagaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctggagaactatgtgaagaatgcagaagcctcaggagccgatgcaatcaactggaagaaagggtatcagcaatggaagatgaaatgaatgaaatgaagcaagaagggaagtttagagaaaaaagaataaaaagaaattagcaaagcctccaagaaatatgggactatgtgaaaagaccaaatctacgtctgattggtgtacctgaaagtgatggggagaatggaaccaagttgggaaacactctgcaggatattatccaggagaacttccccaatctatcaaggcaggccaacattcagattcaggaaatacagagaatgccacaaagatactcctcgagaagagcaactccaagacacataattgtcagattcaccaaagttgaaatgaaggaaaaaatgttaagggaagccagagagaaaggtcgggttaccctcaaagggaagcccatcggactaacagctgatctctcagcagaaatcctacaagccaaaagagagtgggggccaatattcaacattcttaaagaaaagaattttcaacccagaatttcatatccagccaaactaagtttcataagtgaaggagaaataaaatactttacagacaagcaaatgctgagagatttttgtcaccaccaggcctgccctaaaagaactcctgaaggaagcgctaaacatggaaaggaacaaccggtaccagccgctgcaaaattatgccaaaatgtaaagaccatcaaagactaggaagaaactgcatcaactaacgagcaaaatcaccagctaacatcataatgacaggatcaaattcacacataacaatattaactttaaatgtgaatggactaaatgctccaattaaaagacacagaatggcaaattggataaagagtcaagaaccatcagtgtgctgtattcaggaaacccatctcacatgcagagacacacataggctcaaaataaaaggatggaggaagatctaccaagcaaatggaaaacaaaaaaaggcaggggttgcaatcctagttctgataaaacagactttaaaccaacaaagatcaaaagagacaaagaagaccattacataatgctaaagggatcaattcaacaagaagagctaactatcctaaatatatatgcacccaatacaggagcaccaagattcataaagcaagtcctgagtgacctacaaagcgacttagactcccacacattaataatgggagactttaacaccccactgtcaacattagacagatcaacaagacagaaagtcaacaaggatacccaggaattgaactcagctctgcaccaagcagacctaatacacatctacagaactctccaccccaaatcaacagaatatacatttttttcagcaccacacctattccaaaattgaccacatacttggaagtaaagctctcctcagcaaatgtaaaagaacagagattataacagtgcagaccacagtgcaatcaaactagaactcaggattaagaatctcactcaaaaccgctcaactacatggaaactgaacaacctgctcctgaatgactattgggtacataacgaaatgaaggcagaaataaagatgttctttgaaaccaacgagaacaaagacacaacataccagaatctctgggacgcattcaaagcagtgtgtagagggaaatttatagcactaaatgcccacaagagagagcaggaaagatccaaaattgacaccctaacatcaccattaaaagaactagaaaagcaagagcaaacacattcaaaagctagcagaaggcaagaaataaatcagagcagaactgaaggaaacagagacacaaaaaaaacccttcaaaaaattaatgaatacaggagctggttttttgaaaggatcaacaaaattgatagaccactagcatgactaataaagaaaaaaagagagaagaatcaaatagacacaataaaaaatgataagggggatatcaccactgatcccacagaaatacaaactaccatcagagaatactacaaacacctctacacaaataaactagaaaatctagaagaaatggataaattcctcaacacatacactctcccaagactaaaccaggaagaaattgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaacacgaatccagcagcacatcaaaaagcttatccaccatgatcaagtgggcttcatccctgggatgcaaggctggttcaatatacgcaaatcaataaatgtaatccagcatataaacagagccaatgacaaaaaccacatgattatctcaatagatgcagaaaaagcctttgacaaaattcaacaaccttcatgctaaaaactctcaataaattaggtattgatgggacgtatttccaaataataagagctatctatgagaaacccacagccaatatcatactgaatgggcaaaaactggaagcattccctttgaaaactggtacaagacagggatgccctctctcaccactcgtattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacccaggaatccaacttacaagggatgtgaaggacctcttcaaggagaactacaaatcactgctcaaggaaataaaagaggatacaaacaaatggaagaacattccatgctcatgggtaggaagaatcaatatcgtcaaaatggccatactgcccaaggtaatttacagattcaatgccatcctcatcaagctaccaatgcctttcttcacagaattggaaaaatctactttaaagttcatatggaaccaaaaaagagcccgcatcaccgagtcaatcctaagccaaaagaacaaagctggaggcatcacactacctgacttcaaactatactacaaggctacagtaaccaaaacaggatggtactggtaccaaaacagagatatagatcaatggaacagaacagagccctcagaaataatgccgcatatctacaactatgtgatctttgacaaacctgagaaaaacaagcaatggggaaaggattccctatttaataaatggtgatgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtcgaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaatgcaaacaaatttacaagaaaataaacaaccccatcaaaaagtgggcaaagcacatgaacagacacttctcaaaagaacacatttatgcagccaaaaaacacatgaaaaaatgcttatcatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacccatggacacaggaaggggaacatcacactctggggactgttgtggggtggggggaggcgggaggaatagcattgggagatatacctaatgctagatgacgagttagtgggtgcagcgcaccagcatggcacatgtatacatatgtaactaacctgcacaatgtgcacatgtaccctaaaacttaaaatataataataataataataataataataataataaaggatatagggtcttcaatgtcaatgcccaatgtcaagcccaagcaggtttaaaaacttgagtagtaaccattagtaccttaaccctctcgtctcatttttcacagacaggtggcccaatgaaagccacgttacttgtgactcagagtagccctttcttacaatgggaggaggagaaaggagcagagaggggagcagggcacctcatcagcacgtccccagtggtcaaataggctgtttcccttatttttgaggagaaataagaaggttgggagaagaacacaatgtttctctccccagaagtggcatttagagatgtttatcacccttaaagtacaattcacatggtagactaaaatgccttaagattgttgcaaaatttatagtttgaaattcgatcacttatgagggatgcctgaggctattgtgtctgagtaaatgcggctactctctttttgttcaatatttgttgaagatgaaagggtagagtattacacaaagtttcccatacatatcttttatttctcccatgccctcaaaagttccttgcctatcagaagtgtaaatgattatgtgacacttctatatctgcccccagataacccgagcacaggctagttacttaataataagtatatataagaataatattctggttcacagggaaactagactgagagagtccatttcattttgtctggcatcacagaatggatcagagacaaagcagagataagaacccaggcttcttcaaagccaccctttttaactttgttcttaagggtaaaggaatggaaaatgaagtaggaaataggaaaaagtggggaagatgtgagttaatagtgaaatcaaaaccatgctgtgcattggcctctgatcggaccctggtgagcatttttagagcattccggctgcagcctaatgtttctcaccccaaaaaattattttacatgggaaaaccttctgcagagagatgctagcaggagtctgcacctggcagtcctatgttatgtacctaatgagtaaatgaaatgtttaataactgtactgtgaaaatgaagcttaaaacagtaaattcctgctgaggctgctcttctgcacctgaggcacactgctagcccatctcagaactccagcccatttttattttttcctcttagtgggtcctgctgaggagataacactaaaaccaaagcgatgctcacttaattagttgtatatcagtgtaagaacatttacttagcacatcaacagccagcgttccaccaaagggtcgcctgaaacttctccaacatgcaccctggataggggaaattctgcagtggcttcagattgagcattcgtaaatttaaatttgtcaattagccatggatcatttaacctcagaaacgtaataccacttatttttagagtatctgtttgaaatacaaaagcagtaaaaccttaattgttggtatagcttttcactaataattttaagaaaaaaatgacagaacatttattttttacaaagcactagtttaaaaataaattattgcaatttgagttaagctttaactggctggagattcctttagattcaatggatcaactaattcttcctaagtcttaaggagaggcaagaaatccaaatgtaaagttaagtacaggtagaatagctatattatccttgtgtaattttcatagctaataacttaaaaattaaatttcttacatttatagacatacagaccccaaaatccaaagaaattagactatcgagccaaggtcacaaaactaggtcctaggctaaaatgcttcctcagtatctggaatatttatttgagcactcattaaatacttggaatttgttgtatagatcacacacagtttaccatcattgaaaataataatatagatcagcttagacttcagagtgggaaacgtttcatctttcaaggcctatttgcaaaatgaaaggtgatttttccaacttctcagagccccagtactgatcctcttctcactagctcccacccagccttgagcacctccctctcccaaaatgaagtgttttttttttttttcttaaccacattttgaaaatcacttttcatatttgggagagatcccagaggatgctgactccaaaattgagattatattcacagctaggagccatggaagagattcttttcatttttatttttcctttgacatatgtttctgatagagctcatagaagttctatgaaaagcgttcatgtttaggccaattgtcagtgttaagtgttgttctccaaagtgaataaataaatatgaagctttccctgtagctacaatctagatctaccaacatagaaaaagtcatcaaaaattctatcatttcttaacattaaagaacagcattttgatatcccaaagtaataagttttcagtttgtttttgtgttttttcctaattgccataatttctattagttcttgggtaggatggtggctctcttctagtgagtcaaaacactgccaggcacaccaaaggctctcatgcctcaaggcagtccattatcaagaaggagtcaccaagaatgggtgaggccagggatgcataaacaaagtgggctttaaacctggcttctgaaagcagtgtagaaaaaaaccagttagtctcccaggaagtgtggcaatgccccatttcaatgtcaaagtctttgaaatctaggaaagcttcatgtggaggaacagatcggggttaggacaaatagtcacccgacagtagcagtgagtccatcagcagatgagaggccgcaatatggtgtccagtatcctgtttggattggaccatgctccaggcctcactcactaatccacatgcctgacgactacattgccttctcatttgaacatagtccataccagcagactgattattttacataaaaatgttcatttggtttaaatggtgtagaagatggattgagaatttagacacacgggaaggtgactgatcaggtctcaggcacaaggcaaaagattaaaggcatgtctcatagccccatgaaagaacagagatgcagaccagaaaatcaagaaagaagccatttatgcttggtgagctacaagcacttaaggaaaaagcactgcttggtgagcttgtagggacccagatttcaccagtgcacaagcttgaaatattgaacactgaatctacacacaaaaaaatacaaacatcatgtagggatggagttatgcacaaccaggaacatggtgtctgccttccgacaaaggatgttttcatggaaatcttggttttcaaacatttattctccttaactaaagggcaattttgagaccacggttgcctaattagttgttaataaatctctcctgggaaatttccctcatactctttcctttaattgccctttcaaggaaaggaaagaaaaatattaagtccatagagtgtcccagtcaaatcctgctgacaatgaactctgggaggctgtttaaattctttgtctctactagaattttattgaaattaattctaccttcctctccagggacctcagtattctcttcaacaaaataaaaggaaggtcattcgatgagctccaagagccctcgtggttccggcattctaaatttctgtgattctatgaatattacttgagaaaaggcagtcatctgaggtttaaacactctgtgcggtctttgagccgagacaatgtcttcgattccttttgtgaggctcaccatgtcttgtacatttgttcaacactcactacattttgaatgcataactgttgcctgggcactagagaaaatcaattattataatgaactttctaatgagtttgagggatggtagtctttaggcatgtccatgccctattgtaataataggagtgtggttgatgcagtatgatacacatagtgcaatacacctaagtgtttggaattctgggaagaaaatacaccataagaatgtatttccatcgtgataaccgtaggctatgcctaggaattcatttctctgcatgtaaaactgacaaaaaaattgtgatgaagtacatgttatggaattatatacagcagtctggtatattctaaaagaatctttacttttacgtttctcagaacaggcactggccctacttgaatttcctacatagtaagctatgcctatgcctttcactttttattgtagatacctatgttagagtgaattgattttcagaatgtgttaaacatgcattgcatgtgtttggttacatattaaattgtaaattttcagaagtagctgagtttcttaaacatgtttttaaaatgaaaaatttaaaataaaataaataggttttatgatcaagggagtctaggtcaaaaataagtaaaagatgtgtgaaaaaatatatagagacaaatgttcatttttaaaatgcagctgctgtgttaaacataggaatggataagagctagcttctggaaggtgctaagaggaacagcttttgtgactattataaattcaggtttaatcagaacattgcaagcattcttgaagggcatacaaacaaaattcaggcaacacaattcaaaatatgtggttggtagataccttctcaaggtttatgcctctttttaaagcttttaaactttgtgaattcctttttaaactttatgccttcacttaaataataacctaaaatatcaacatgaatttcacatgctgggttatctgtacctgccaaggtttttagtggctgccttcctatttgggtttacaattaagatggcaccaggaacaccgtggttatagtcagaagtttggaaaaaaaaaaaaatggtgtgtgagtagaggtaaaccattcacatccagtgaagaccacctgacattacagtccctgtatgaatgaggtcttggctattgttgagttagaaaatcttcacagaattagaaaaaactactttgaatttcatgtggaaccaaaaaagggcccctatagccaagacagtcctaagcaaaaagaacaaagctgaaagcatcatgctacctgactgcaaactatactacaaggctacaggaaccaaatcagcatggtactggtaccaaaacagagatataaaccaatggaacagaacagaggtctcagaaacatcaccacacgcctacaaccatctgatctttgacaaacctggcaaaaagcaccggggaaaggattccctatttaataaatggtgttgggaaaactggctagccatatgcagaaaactgaaacctgacccctccttacaccttatacaaaaattaactcaagatggattaaagacttaaatgtaagacctaaaaccatacaaaccctggaagaaaacctaggcaataccattcaggacataggcatgggcaaagacttcatgattaaaccaccaaaagcaatggcaatgaaagccaaaattgacaaatgggatcaaattaaactaaagagcttcttcatagcaaaagaaactatcatcagagtgaacaggcaacctacagaatgggagaaattttttgcagtctatccatctgacaaagggctaatatccagaatctacaaagaacttaaacaaatttacatgaagaaaatacacaaccccttcaaaaagtgggcaaaagatatgaacaggcacttctcaagagaagacatttatgcagccaacaaacatgaaaaaaggctcatcatcactggtcattagagaaatgcaaatcaaaatcaccacgagataccatctcacaccagttagaatggcaatcattaaaaagtcaggaaacaacagatgctagagaggatgtggagaaataggaacacttttacactgttggtgggagtgtaaattagttcagccattgtggaagacaatatggtgattcttcaaggatctagaattagaaatgccatttgacccagcaatcctattactggattcaaaggattataaatcattctactataaagacacaagcacacgtatgtttactgtagcactattcacaatagcaaagacttggaaccaacccaaatgcccatcagtgacagactggataaagaaaatgtggcacatatataccatggaatacaatgcagccataaaaaaggatgagttcatgtcctttgcagggacatggatgagactggaaaccatcattctcagcaaactaacacaagaacagaaaaccaaacaccgcatgttctcacacataagtgggagttgaacaatgagaacacatggacacagggaggagaacatcacacactgggcctgtcggagggcagggggctgggggagggatagcattaggacaactaatgtagatgacaggttgatgggtgcagcaaaccaccatggcacatgtatacctatgtaacaaacctgtacattctgcacatgtactccagaacttaaagtataagaaaaaaagaagggggaggcaggagaaaagtattaaatttatattaataaaaaaagaaatagtaaaattatgattatcagaggctgtgaggtgagaggattgaggagatgttggtcaaatggtacaaaatttcagttaggaggaataagttcaagagatccattgtatattgtggcgattagagttaataactatatattgtatacttaaaaattgctgagaattgattgaaagtgttctcaacacaaaacataagtatgtgaagtaatacatatgttaaatagcttgatttagccattctataatgtatatacatgtatcaaaacattgttttacaccataaatatatactgtttttccttgttgattaaaaataaataagttgttgaatacatgaaaaaaaaaagaaggaaaatgttcataatgaaaactgggcgtgaatgacaaacccaaaatgattgtaatatagcaacagtatcaaattcatatggcaattttgttttagcccaacaatctcatttatcatattaaattaatgattataatccaaattgtactattttcacagggctttctgtttaactttaaatgtgtttttgttttatagcataggataagcactataaggtatgatgcttatagcaagttttatgtttgtatatattttaaaaatattggaatacagtattttaagtcaatgctggagttgattaaagtcttacttttccctttaaattccaagtcagttatgagaaacaatgataaaaaatgagcttttatccccagatttatagtccttgaactagatttcatgttcatttatgttgcttcctcaaaaaacccatgtaaattggatgggctaggtcaacaagctagtgatcatccttcatttgctccatggagttagacagatgttggtgcaaaattcttacaccgcctgcccattcctaaatgtgcgaacttaggcaagttacttattttgtctttattttggcacccccatgtgtgaactgagaataagaatacttagcaggattgttttgaaaaatagtaatatataatattataataagatgattaatattaaaaatagccctcatttggataactatttttggcaccaactcccaggcaacttttcacagcgtgaatagttagccctctttgaacaagttactaagtaccagccactttaaatacataatctcatttaatcctaacaaattactagtatcattcctattttgcagatgaaaaacaggccaagacaggttcagttgacaagaaattgcacagatctaaatgcagactggacttactgtgaatcccaaattttccctcaccatgttattttgtccaaaatgaaactaaaatgcttggcatagatctagacttttgtaggcactcagtaaatattatttccactctgaagaaaacgattcatgtttcatttcgcttctcatcagaggtaccacgaacagaatatcacccttttatgataaatcactcaaattgcagacttttgatccctaaagttcaagagtgaaaaggtataaatatgaagaaatttcatgttaggtcacgggatgggaaaagatgcttatgtcaggatttaccatttctagtgaccagcacctagcagattgctggtttattagatttatttattattttcattgtttccttcagatgactcctatttatctgattgtagagtaacctctgagctttattagctagaattttattttccacagtgtagtccaaacaactttttcttggcaaaatataggaccccattagaaccattaggactaaaatgtcagctctcgtgatagaagagaactgaggccactgtcttttcatggctttctctaataccttttctgctgaagtcttggttacaatgctaagaatgacataaccccttagttatgtgaggtgtactagctgattcaataagcctttatgaaagttttattttcagctataaggtcaaggttgtattagcgctacaagctaagcagaatttataaggcaaatttcagtttcctccaaaaaggcagcccttatgtataggaaacagaaatatcatctatttgatactcagcagtgcctcttatgattttcatgagcagcagaatgtcttttattgacaaaagccatacaaaaaaaaccagaattacatcttttttgttccaaaatagaattaaaaatgatagtctatcaaattagccatgatggattttattttattctaacgtcttatgctcatttgtagaccagagcaaccatctcttctaactctgcaaatcttccttggttctgctatgcaacttagggctcatttaggtggtttagcacagggctttctggccctaagccgagactggcaccaaataagcttgcctgacactttatagggtgtgatgaacagtccagagctcccaggcaactttccacagcatgatttggaatctacttgcaattacatatggctagtggagctgcatctggagaagcctaatcagaatttgtcttccatttagtagaaataaaacgagcccactcattgtgtcagaattcatctttacactacagaatgagcaataacctaaaatcaatgccaatctcctggatatggtgtatatacttgagaaagtgttctgcagaatgttttctacattactttcatcactgtgttttctatttcagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtaagggcatctttaaaattcatgcttcatcaagggacagattgactggcgctgtgtaatagcatctaaaccaatgagtactgtccattcaccccaggccaccccaggccattgttgttcttattgttgtttgttcctttgttttcctgcacttaaatatgaagaggaaataaaagctatgaaaaaaaattatgtcagagacttagttatgtaaaaaagttgattcttaaggacagtcttagaaatatgaccagatagctacagaacgtgtggttttacacccatatatgtacataatatatacatatacacatgatatacacatggatacgtgtgtgtgtgtgtgtgtgtgtgtgtgtgtgtgtgtgtgtgtgtgtttcttttcaataggaagaaataccttggcattcttggaaataaataagactatataactcttcttcttccttttttttttttattttaagagacagggtcttgctgtgttgcccaggctagagggtagtggctattcacaggcacaatcatagtgcactacagccctgaacttcttagctcaagcagttctcctgcctcaatttcccaagtagctaagactataggtgcacattactacaccaacttatacagttattctctaaaattaaaaaaatatagtgacaaaaagctatattatgagggctttttgaagttattatatatgttacttctgaaatcataaaataccagaaatatagatttgtgaaggaaaaaatataaaataaaaaaattgaaggagtttaagtaatacaaaaaggaaatgacgtaattaaaaaataagaagggaaagtttatttaaagacagaaaaagttttactaaggaaataagctaaaaagggttccagttagaaaactcagaaggaacatcaatagagaaggggaaaaaatcagaattttaagaaaaaaaaaacatttatcccgaaaatgcactgtaaaggagattcaaaaagacattgcctaaaggcagctatttatagtacactttagttgtttctgaatataattcaagagaaaacatttaaaagaagcctaaggaattaacatatcagatatcttgaaaaatcagggcactagaagagaaaaaagatgaaaagagcagattaaaattctattttgttattacatttggatcttttttaagcataaattatgaaatgaaaataatctgccacccttccaactagcttgttttcttcatgcataaatgaagtcttctgcaaaatttgcaaataatgtattgaaaaataaatttataacaatatcaaggaataagtaggtaacatttaatcagtcctctgtaagcaatgcaactaccaggtcttttataaaaattatactttcttttgatatctggttgttgttaaaaacaaagaatcatttcatttgaatgaagaacaatacatttttcttgacttaattttttttcaatactacaaacaataaaatattttaacgacatagagatcagggaagctgagtatgtgagtgtgtctgtaaatgttttggcagatgagtgttatctacttaacatgcttttcaaagattcaaatttataagactctaatgcacttttgtgcgttagaatatagctgtttatgtcaatatctgtttaggatcaaggtttgtggccacatctcaaataaaatcaaacttctaagtttacatgaagtatctcatctcataaagaatcatgtcaggtaggcctatttttacattaaaggttgactctaaagaatggcagccaaattaaaatattaaactttattaatattaaaagcagtaagaaacacatattaaaggaaataaagaggacaaatagtgtagaccaacatttgcctatgaaaacataatgtgtaattttaaattgactagaagctacattaaaagatgtaaaaataaataggtgaagttaataccttttatctaacccaatatttccaaaatattatcatctcaacatgcaataaatatttaaaattgtcaataatgtattttactttttttgtactgttccaaaactggtacgtattttttcatgtaaaacacatttcaggtgagactaggcacattttaagaatataatagttacatgtggctagtggttgccgtattatacaatgaaatctagacagtttgagaacgacaaccagacaatgaaaacaacattttggaaatgagttgcctagtaatcccctcacttcaacttctctctctctctctctctctctctctctctctctcacacacacacacacacacacacacacacacacacacacacacacattgtatgtatataaacaggcttttagccaaattggaaacttttcagtcctctattaagccctgaagattgggtagtgtatgcccgaatcattcactgacatgctgagatttctataggaagctcatacattaataccatacattttgagctgttttttcaatggctggagtagctttgtgcctacctcccacccatgcaaattctatcaatgctctcttgagatcaagggtacttatttggcaagattagatatacatctctgatcatagtgctaaggaatgtgtcttggcctatgcagagctagaaatcatggctcaggcctcattggttcaatcatttaatcaatggaatgcgctagccaagaataataagtagaacatctgtataagtcaactaatatgttcaagaaaggaaaaaaagaaaactaacatctactgaacacttaccactaggcagccctgacttgttgaatcctcctaactcctcaaaagacaaacttgttattctcatttcacaaataagaagactaactcaaataaaatgtgcaagtatataaaaggactgggattcaaatcagtttcacatcttatttccccatctggctaactatcaaaactacctgggaatttttcttttaattaggatgtctaggttcttcccataccttctgaaacagaattcctaagcctagcgacctggtatttgtggtaactagtaattctattacttactgacatgataatagtgacttatagtgagtgagtttacagagtgaattagtgacagttcactaggcattctggagttcaacctcttcttttatccaccattcaaattgtcccaaaaaggattgactgtggtttggggcatgaattttgtttccacacacaaactaaagtcataatctccagacgtttcattggccaaggcaaagcccgctgagttctcacatacaaaaaaaaatgtatctatgtcatgatacagagaaaaaatattctgttcatatcttggttaacctagtaagaggaacaggagctaatgtattgaatatctaccatatgccagaccctatcatgggtactaaacatgttacaggaggctcagaatagcctatgaaatagatgtcattatcattttatagatgaagaaaattacgtatcagagaggtgcactcacttgtctaagaccacacagctaataattgggagaacttgatttgaaacccaatctttttgactctgaaacatcttccttgtcacaggtggagatggagtgggtgaaacaatatgcaatctcttattatccccttttattaccagcatcttcattcagtgagtatattccaaggacagccctggctgtggtctcctaggtcagacttgggaatacgtagcaccccaactagctgtggccccggccttcataaaagaaatggatcaatatttgttactaactcttggctctcattctctttataggtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttc

SEQ ID NO: 2008 - DNA, 115689 bp, Homo sapiens
ggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctgtaagtagataactaagttcaagaatgttcatcaattttggttgggtgcagtagctcacacctgtaatctcagcactttgagaggccaaggcaggcagatcacctgaggccaggagttcaagaccagcctggccgacatggcaaaacctcatctctactaaaaatacaataatcagctgggcgtggtggcgcatgcctgtaatcccagctgctcgggaggctgaggcatgagaatcgcttgaacacaagaggcagaggctgcagtgagccaagacacgccactgcactccagcctggatgacagagcggacccctgtctcaattaaaaaaaaaaaaaaaaaaaaagaaggttcctcaattttatgacatgccagaaaaggatcctacctttttgtctttatggggcttattgtgagcaaatgggtagcttactgcacagtgaaaaaattgtagcaagaaatctctgggaacaacaaattcctatttcctataataatatgcaaatcaaaaaggtttctcatgggctttggattcaaacaaacttggttcaaatctcagctgcctcactcactagtggagtcacttaaaacaagttaataatattagctgccagattttgagaaattagtttatgtcaggctctgtgctatgccaacattatgttattgttctgatacttctctgaggtggccactatcatgtccatctcacagatgagaatgggaggctggcgcagggtcaaacagtacgttggaaacctggatttgttcacagccgctgctgttaaagtgttcttctgaactttaaagtatgcatagatttgtttcttaaaagatcttttttctctctgttttgtttgtttatagaccttctgtgggtgccaaaatataaatatccttgaatctgttcttcattatttaattaatttatttatttttgagacagaggtttgctctattgcccagatctggggtgcagtggtgcgatctcggctcactgcaatctccgcctcctgggttcaagagattctcctgcctcagcctccagagtagctgggactacaggtgcatgccaccatgcctagctgtttttgtttgtttgtttgttttttagtagagactaggtttcatcatgttggccaggctggtctcgaactcctggcctcaagtgatctgcctgccttggcctcccaaagtctttggattacaggcataagctactgtgctcgaccctgttccgcattatttttattgaaaatattaaatatcctagtattttggatttcataaagcttcatatcaaatacaattgaaatgtttaagctaaggccagcctaagacattaaagtttgtagtttctaattacccccctgatgaatgtaatataaattggcacaattttactagagggcagtagggcaatagttataaaatgcctaaaaaatagatataccaatgaaatgattttattttttggcattatggtggactcagtaccttaaagatgtccattggatggaaacaactaaaatactgatacacacaaaagctaaggactgtgtagggaacattatcaaattgaaatcagaaacttcattagataaacaggaaccaatgctagcttcatccttgaggatttttgccacattctattaatagcaacttcatatttctgttttgacagctttgcaaagaatggaagataactactccctccacctaaggaggaaagcatgtgacccctttgtataaaattgggatgttcattgtagggatgaacaagatataaacccactaaataaaaatggacagtgagggctcactcagccttagcatggaatagagggggataaagtctcttctgagaattcataagcacacactgatttgagatccatgttaattatttatgtggtccaaaaaatgttgaagtaaagaatttaattaaaaatagtcacaggccagtagtgtgtccaggaaactggctgacataaatgcaaatcaagtgtgaagggatgcagcttcagctcagactccaaataataaccccagataaagttgcaaggtatatgagctcacagtcaaaaatcgtaaacacacaaggaaacatgtatcattagaatcaacaagagaaattatataggataatcaactcccaaagacttcagatataaaattaaacaatgaatataaaataactatgtttactatgtctaaaataaaaaaggtaggtttaaaaagatgattaaagaaggccggacacagtggctcatgcctgtaatcccagcactttgggaggccgaggcaggaggatcacgaggtcaagagattaagaccatcctggccaacaggtgaaaccccatctctactaaaaatacaaaaattgactgaatgtggtagcgcgcactctgtagtcccactactcgggaggctgaggcaggagaatcgcttgaacccaggaggcggaggttgcaatgagccaagattgcactactgcacactccagcctggtgacagagagactctgtctcaaaaaaaaaaaaaaaaaaaaaaaaaaggattaaagactaaaaaaatctgggatgctgaggtgggcagatcatccgaggtcaggagtttgagaccaacctggcctatatggcaaaaccccatctctaccaaaaatacaaaaaattagccaggagtggtggcacacacatgtagtcccagctactcaggaggctgaggcaggagaatcgcttgaacctgggaggtggaggttgcagtgagccgagatcgcaccactgcgctccagcctgggtgacacagtgagactccatctaaaaaataaaataaaataaaaaataaaaaattataaaaatgaataatcatgtttaaacaaaagtgaaatagaccatctagaacttaaaatgtaattgaaattaaaagctctgtagatgaattaaacatccttcatagacacagttgaagacagaagtaatgagctggaggatcaataccagtaaattacccagagctcaacacaaagagaaaaaatatgaatgaagcatgagacctagtctagttagacttttagaagaagataataggaagccaaagggtaatatttgaagagagaatggctgagagtttttcagaattgttggaaagcactacttcttacatctggaaaactcagtggatcccaaaggggataaatacacagagaaatcccaactgtacccatcataatgaaacagcaaaacactccagttaaaaagatctgaaaaataacagagggggaaaaaaaaaaaaccaagttacctgcaaagaactaaagattagactaatagatttcttaggagccacaatagtagtcagaagatagtagaatatcttcaatagtggagagaaaaataacatcaatttagaattgtgacattgtttcacccagtgaaacaattcctaggggacctgggagaaaataaatgcattttctgacaaacaaaaacctaagtcatttgccaataaactctgaatggaggaaattcctcagaatatgtttttggaggaacagagaatacctcagctggaaagctcaaaacacaagaaggaatgtcaacaaaaatatggaaaatatataggtaaatctaagaaaaagtatgacttgcataaaacaataatattgataatgactgatttgtgaggtataaaccatatgttaaaactaagattcaggacaaaaacattatataaattgggaggagcatgattagaatgaaagaatccttcaggttttatttaagatggagggtgtggtaagtggtgtgcaaacaggctcccctggctccaatgagccacacatcctgtcacttacgcctttgtgtagtctgttctcacaaagaatcatggctcgccttatgcagccaatggaaagcagcagaagtgagactctatttgacttcaagtctaagtcataagaagtcttgcaacttccactgggtctccggaagtgctccttctcagaacccagtgccacactgatgaaagctccagtcacatgtttccctgtgggtgcttcatttgacagcctctgctgagctccccgctagcaactgccaccagctgccaaccatgcaagtaagccgtcttagacactgagtcttcagatggctttagccactgctgccatttgatagcctgagataccgtgcaaaaactgcttagttcaacccaggcagcccacagaaccatgagagataataattgctacttaaagccactgaggtttggggtggtttattacacatcagttgataactggaacagataataaagactgttaggaatatatattaacatggttaagatcatcattaaaagaacaggtgtagagatgataacttctgatctatagagggaaaaatggaatgagaaatttaaaatgaaccctgaatctaaaagaggacaagacaggaggaggaaaaaagaaacaaaaagcatagaatgtattaaaattacagaataagaaaataaattttactatatcagcaatcataataaatgcatctggacaaaaatcttccattaaaagattaagaatggcagattggctcaaaacaaaacagtcatattctatttgtgagacatacctcatatataaagtcacagaaatatttaaagtcaaagtatcaggaaaaaagatatgccacccaaaatctcacccaaaataagggctagtattgctatatcaacagcagacagtgtatagttcaggacaaaaagctccctacagataaagagggtcactatataatgataaaactgttgttgggagagctatgacagctttaaacttatatgcttctaacaacacagttctaaaatagataaaagtgaaaatcacaggtagagcactggagactctcccgcctccctgtgttccccatgcctttttgtgccattctccctgctgtagtccccatgttttctatctttgttgagcctgtgattcccctgacagaatgtaatggaagtggggctgtcctggtcccaggcccaagcgttaagatggcctggcagcagggctggcccaggagaggcacgcagggtatcctgggtactcactcccagctagggcccctgcatgaacctgagagtgaacacctccttccatttttgaaccctgggtccctctggcctcaccctagttcgagcctttgctgggagctttcagttttgtgatcttgggagccttgcactaccatgtaaaaagtctggctactctactggacataccacccagagaggccatatcgtaagagagaagtgtgtgcctacatggaggagaattgaggagcccagcctccagcaagaaggaaggccccatgtcactcttccaggcacaccccagcccctttgggccaccctcactgaggcacaagacacatgagggaaaaaaaccgtcttggaggttcttgccccaacagatacccctactgtaccctgtctgaatctctcacccatagaatcatgagcaaataaaacagagtagccactaaatttgggataatctgttatgcagaaatagttgaacaaaatagcaggtcttagagggaacttataaccttaaatgcttataacagaagagaagaaaggcctgaaataaagttcagagtttacctctaagagcaagaacagtcgaatcaactcaaggaaaacagaaaataaaggacaagagcgcatattaatgaaacaggaaacaagcatctggtagaggataaacaaagccaaaagtttgttctttaaaaagcctaaagaaaaaaaaaatctgacaagattaatcaggaaaaaaagaaaaactttcaaagtaatgtgaaaaggacataatcacaaatgttgctgaggttaagcaggtaataaaagggcattatagatccacaatcctttaactaaatccctcgtgactagttgtgtttcagaaagcagaatttaaaaaattagtttcttccattgatgaaatattattgaattccacccacaagggctggagagattttccataattacacacgttaggatatctgtggtaaaaatgtaagaatattttatatatgggatcaagactgtagagtaacctcctgtcacttcaagtccaattttgctgcttccagtttttagggctttatggatttaaagggattggggacctgtataaaaaaactgcatgccaataaatttgaaaatatggggtcccagaaaagtttcttaaaatcaacttaagaaatgatagaaacccattaaattgaatcgttagttttaaatcctcccgccaataaaatggtcggcacaagtgcctttataagcagtcctaccaaagattcagggattgggtatgtcccaaataaatacaagttcttggaagcagaaagatggagaatactttttagctcactttatgaggctagcataatgttgatatcaaaataagacaaagacagtacaagaaaggaaagttaacggccaatctcacatagaaagagaaatgaaattaatgttcatgccttgctcatgaacatggatgtaaaaattcaaaaaaaaattggaaaggaatctaatgatgaactaaaaagatatgattatgattaactgatcatggtattcatgattggcttaatactagaaaattgattagtctaattcatcaaattaacaaaggagaaaatctaataatctcaataaacagagacaaaatcattcgataaaatgcaatattcttagtaataattcttaacctaataagaatataagatgactctcatatgtatacaaacctttaacaaacaccatatgtaatgataaaatattaaaagaatccctgtatagtaaatgaggatgcctgttgtcatgagatcctagctattgcagtaagggaaagaaaaagcaataaaatgtactaggatttgaaaggaagaaacgaaattgtcattttttgcaggtaatatattctctacttagcaaatggaaaggaatgtgaattagaatgaatatagaagttcaaaattgctggctatgaagtcattgaataaaaacccattgcatttttatatactaacaatgaacagaaaacatttttctatttacacccatgccaaagaatataaagtacctagtataaaactgacaaaataactctaagctcattatggggtaaattgtcaactattgaaagacattaaggaaagcctaaatagagtaaccgccccccaccccgccttatctgaggggaatatattccaagacccccagtggatgtctgaaactgaggatggtaccacatccgattgttatcagtcagaacacatttttgttcatgccttccacccacaaatgtaacggcttttccatcgtaactaagcatttgctatgcactgtgaccataacttttgtagtttgaagtgcgacaggagaactaacaggaatttctttttccattttcacaatttcacggattaaagatttcttcttaccctagatcttagcaagctcagcatacaatttattttttcctcattaagttgagaattttcacctttttgtgtaaaggaagccttttacggcttcttttcagcatgtctgaattaccagcgtcactactcttgcactttgaaccaaagcactgtgatgcagtgacagtcgatctggtaacagaaggcagttaccagatctaatactaagtgactcatgggcagcagcatctacagtgtggatctgctggacagttcctgggcaggacgggctgggatggcacgtaatttcatcttgctactcagaatggcatgcaattataaatttatagattgtttatttctggaattttccatttagtattttctaactgctgttgactgcaattaactatgaaactgtgggccatgaaaccacggagaagtggggggactacggtatttcccaagaggtagaccacattttggacaggaagattcaaatcataaagttagtttctctccacccccgtcaaaatcctaacaagattatttgtcaagcttaatgagtctaaatttgtgtgggaaagcaaaggttcagggtaatctgaaggaagaaaaataaggtggagaggcttgccaactaaaggttcattgtaggtataataatcagggcagtgtggtaatttgcagggaattttgacaaaagacagatggaccaggatagagatcccagaaacagacgcatactatatgaaaatttgatgacggctttgtgaggaaaggatgtgccactcaataaatggtgctgggagtgttcgttattcacatgggaaagaaaataataaccaacctcatgtagtagaaaacttgtaaaaattaattctgggtgaatttatggtataaatgtgaaaaacatctgacatcgatgacagaaccttctggattccaaattcatttatccagcttcctggtgaatgccaacccttggatacctagtaggcacttggaacctagcatgatcttcacctgcattcaatccactcttcccacacttttcctatctcagtaattccagccttccccttgctcagaccccaaacatttaaaaaaaaaaaagttaaaatggaatctttataactgaaaaggttgcaacctatcttagaagccagcgtattttcagaagtaaaagcaaatttaaattttcattgatgtcctgaagcttccaaaacagctgctactaagcccacacagtgtttcattttttatattaggcaactcctgtcccctggccaagtcaactgcaaggcttaatgacttattttatagacattttgaaaaaaaaaaaaaaggtggttcttttgtggtctgtgtgtttggttttattttattgactgcctgttcagttacagaaatagaggaatgaataaaactgatctcacctaaaaatccagctaaattttagcagattgggcatggccgatgagtggggaaagggctgaaagaatcacctgcgtccagtgcaaatagcacagtggcgatcggggggacagaactgtgcccaggctgcagtttgtgagcaatggatgtgaggaaactctgaggtttctgggtgatggtgttgttaaatcaagcagaaaaagcgagtgctgtttctctatgatggaaatcttagaaaatcttttgtacaaagaacttaaacaaatttacaagaaaaaaaacaaccccatcaaaaagtgggcaaacagacacttctcaaaagaagacatttatgcagccaacagacatatgaaaaaatgctcatcatcactggtcattagagaaatgcaaatcaaaaccacaatgagataccatctcatgtcagtcagaatggcgatcattaaaaagtcaggaaacaacagatgctggagaggatgtggagaaataggaatgcttttacactgttggtgggactgtaaattagttcaaccattgtggaagacagtgtggtgattcctcaaggatctagaactagaaataccacttgacccagcaatcccattactgggtatatacccaaaggattataaatcattctactataaagacacatgcacacgtatgcttattgcagcaccattcacaatagcaaagacttggaaccaacccaaatgtccatcaataatagactggataaagaaaatgtggcacatatacaccatggaatactgtgcagccataaaaaaggatgagttcatgtcctttgcagggacatggatgacgctggaaaccatcattctcagcaaactatcacaagaacagaaaaccaaacaccacatgttctcactcataagtgggagttgtacaatgagaacacatggacacagggaggggaacatcacgcaccagggcctgtcggggtgggggctaggggagggataacattaggagaaatacctaatgtagatgacgggttgatgggtgcagcaaaccacaatggcacgtgtatatgtaacaaacctgtatgttctgcacatgtatcccagaacttaaagtgtaataaaaaataaaataaaataaaagttccagagcaggaaaactaatatgatttgatagtaacaagtccacattattttatgggttgtttactgggtgataaattaggaaactttttgtgatgatgtaaacattgacttctgtgtggagggggcggatgtgatacaaaggtgtatttattttctaaaattagttaaatgatacccacaaaatcatttcactgcatgtaaattataccacattaaaatattataaaaagttttataacatctgactcttaaaaaaaaaaaagaaaataagttttggctatactcggaaaatttcctgaagcagttgaataaatgaggcattgctctaatgaaaagagctctgatttggtgtgacatacgtgtgtatgtgtgtgtgtgttaatagggctccttcagtttggatttggcttattacaaagaacagtttaaaatccaacatttaaaaatatgccttctcagccgggcgtggtagctcacgcctgtaatcccagcagtttgggaggttgaggtgggtggatcacgaggtcaagagatccagaccacagagcgagactccgtctcaaaaaataaaaaaactaaaaaaagtaaaagagatcgagaccatcctggccaacatggtgaaaccttgtctctactaaaaatacaaaaattagctggacgttgtggcaggcatctgtagtcgcagctactcgggaggctgaggcaggagaatcacttgaaccctggatggggaggttgcagtgagctgagatcgcgccactgcactccaggctgggtgacacagcgagactccatctcaaaatatatatatatatatataatatatatatttatattatatataatttttttatatattcatattttatatataatatatattcatattattttatatataatatatatttatattattatatatgtatttattatatatatatatatacctaccttctccctctaccttttcctcctcttctttccctttgttcccatggtgatttttatctgtgctatgggggacctagtgactaaggggtaataagaagtgaaaattatatacataaaaggataatgctacaaaagttactttttacagtcagctatttgtaaactgtagtgcattttcccattgaaacaaagtaattcatggctggcttcccaggccaacccacaaaagcatactgaatctttaatgtctatgtggtatatagtattgtgctaattgtactgtaagacccaaccagcatcctgaggttcccatggataaatgcatttcgttagaattggattccaggaacacattgttctttgcttccctgaggggatggtggctgcgctgtcccaaattcttgcccacttcctcctccctaccatcaccactatcgtcagagctgacatgtacagcgtcttgtgcattttctcatctggtttagagggagcactctcagcttgagaccataggtcatgactctgggagtctggggcagaggagcccagaagaccaagagctggagggagatgacttacaggtagacggaagttaagggttcagtgagaagttgtggggctgcatccctgtgctaaagagccctgtgtggatactgtattctaggaacctgggacagtctactccctcctttccttgatagccagtgctcgtatggggcccctggaccaggagcagccctgcttcattcccctgtggctgaggagtgtgatcatatgtggctgctgtgacttcctttgagaagggacagtggctgcaggcactgagattgatatccccagcacaatgtttcccaaagacgcccgtacatccggtggtacccagggggatttcacttgctacatgcaggaaaaattttttgttttaaatgttacatctttatagttaccttcctttttatttcttttgagacggagtcttgctttgttgccaggctgcagtgcagtggtgccatcttggctcgctgcaacctctgcctcccaggttcaagccattctcctgcctcagcctcccaagtagctggaactacaggcatgtgccatcacgcccagctgatgtttgtatttttagtagaaacagggtttcaccatgttggccagaatggtctcgaactcttgaccttgtgatccgcctgccttggccttccaaagtgctgggattacaggcgtgagccaccgcgcccggcctttaccttctatatataccgagagatactggttttccatttatggtagtgatgtatatttcctattaaaattttaagcccaaagtaaattgatttaaagaaaaaaagtacaggaagcgcatgtgtgtgagagactgctgtttggtgaactgctcttgtaaaaggttacactgtcaagtgggaaaaagcaggctacaaatagtataggttgtgagattccatttttattttattgttatttattattattatgttttgagatggattctcgctctgttgtccaggctggagtacagtggtgcgatctcggctcactgcagcctctggctgctgggttcaagtgattctctgcctcagcctcccgagtagctgggattacaggcatgtaccaccacacccggctaatttttatatttttagtcaagatgggttttcaccatgttggccaggctgtctcaaactcctggcctcaagtaatctgtccaccttggcctcccaaaatgtgggattacaggtgtgagccaccgttcccggccagattctagttttaaaaacacacgatgtacatttcaacgtatagttacctcacgaaaagataagtctggagagacagaaaccaaagtgttgacagtggttggttatcaatggaaggtgggattaaaagtgattttccaaattatttattttttctcttcttgcttagattttctcgttcttgtctgcactgacagtgtattccttctgtgataaaaacataactggaaagcccatgtcactttctgtcctcctgtcatctcctctccgcctcttcctccagttacatgcttgcttcttcctgttctcctcaagaaggaacatgggtaactgctgccttctttgtgttttgagtgaatgtttaactatttcttcctccaacttaagatgccagtagatttcatttcactaagaaagtaaaaaatgcatttaaatttatgcacaaatggttcttggggtggtaaactatatgctgcctttaagtgcctttaagtcttgctgccttgatgggccacaagacagggtagcagttgggagggattgtcaagatagtccctctgagacaaccaccagaataagactggaaagcctgcttctcctctcttcgctttattaactcactgggttaccttagcttaagcaagacccctgggagtccccatttctgcagctgggtcagatgatattccagatgcccagattccatatgaatgaatcagtaagtccagggacatgaactcacagtttggaggaattgcttgagaatggtaactgagatggagctagactgttagctttactgctgttcataggtgacccattcatcctagtttgcccaggactttcatttttttaatgccatgaaagtcctatatcttgggcactcccagtcctgggcaaagagagacacttggccaccctaaccatagatgtttaggccaaacacagtggtactggcaacatggagaggataggggaaactgtgtagtcaaatatcttcctagtcagtctccaagggaaagatagtagatactcaatatcataaatgtaatacctttctaatgaaatgtcattttgaatacaagtttagttgacagcaccacttgtcctgaacgatgtaccccaaagtggctgcaatatcattctcaccttttccaaagattatctgacctcatgcagtggctgctgagctccagtagccagagggaaaaaaatggcatgtcctcacctcactttttgtaatcttattcatgtttgcaattgtaatcatttctgcagagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacagtaagaaatcacatacagtgcttgttagaacaccctgaatcttgaggggaagtcctgtgtttgtgattatgtctttccaagttttgtactgagcagtatatgacatcatgacagttaaaagtgaagggagctggtggggaggaaaagagggctgagagtagtgccaggggggataggaaagggcagggagtagccaagttggctagccgctggcaaggcctggatcgtgcttcactaatgacggcgggggaggaattagtggaagtgtcaaacgtgtgcttccaggtctcacgttgttctccaggcgtcagtgtccaaggtcattgatatgttaggagagcacctgccgtctacacaattgcccttgtaatcatgacagcagagcctcagacttctgtcacattctataattttcaaagtgccctcatggaccttggcttatttgatgtcttctagctgctgacacatgacaacttgtcagccaacagaagctaggttagtggttcccaggagtctggcctgggtacctgatgccaagtctgagctttctctgcatgcaacctgccagagccaggccagagacaggccccagtttttgtggagtgccagaggctacaactctgggcagcaccctggccttgtggtggaattctgcagcatgtccccagagccctgatgtcagaagaaaagggaatgcccaatgagtgtgagtgaattcaccccccgtacatgtgtgtgaatgtgcacacatacacacacccgtaagcatattattcagcatttatttcactagatggtgccttcccctcatcttttgtgttctctcctaccctgccaccctgtatacctaaggactattgtcagaaaaattatcgcaaacttggaaatagaccaaaacgattatttcagtccaatgcttgcacctttggttgagtagcctgttttacaattctgtaggaatggtgattagcctgtagatttttgtccattaggatgtaaagaattcctgtctggatagagctaacctcaaaggttatggtttattgtcttacaggatgtgacctatttggtatctaatctagcaatctttttttttttttttttttttttttttttttttttttttttgagatggagtctcactctgtcgtccaggctggagtacagtggcacgatctcggcttactgcaagctctgcctcccagattcatgccattctcctgcctcagcctcccaagtagctgggactataggcgcctgccaccacgcccggctaatttttttgtatttttagtagagacagggtttcactatgttagccaggatggtctcgatctcctgacctcgtgatccacctgcctcggcctcccaaagtgctgggattacaggtgtgagccactgtgcctggcctaatccagcaatcttattctttccttttcctagtaaatcacctgaagtatccagctcttcaagtgcaaagaatcatttttatcatctcactggttgcctcattaattgatttgttgaagttgaataaacctctgatagatgtttattttatatttgcattagggttatgattttacctttctgaaaattataaattaacactcttattcataaacacatgccccttttgtttcttttcaagctgtcttctatgacagtatagtgctgggctgtccaatgtggtagccaccagccttatgtaactaacgagcgcttgaaatgtagctagtctgaattgaggtgttccataagtataaaatatgccagatttcaaatacttcgtaggaaaaaaagagtgtaaaatatctcattaataatttttataatgattacttgttaaaatgatataatttgaatatattaggttaaatattaacttaaatattaaacattaattcacctgtttatctttattcttttttaatgtgtctactagaaaatttgaaatgacatttgtggcttgcattacttttctgctggatgtaaccagtatagagcctttaaggcttaatgcagtatctatcccagggatatttgcagctgaagtaatgatttttatcttaaagctaaagaataaatcttgcattgtaatatttatgatggaagagagaatttgggagacaaatcaagcaagtaataagccatatgctcctgaggctagtcctattcaggatgtaaggcaaatgctgagtgagattattgtgggattaaatgagtgaatacacagcaagtacttgaaatcatgtcgtcgtcatcgttatctggacttttgggatttgtgttgtttgccttttgggagttttcaagctcatgaatcaaaacatggttttcctcttgcgcttttagtcaccgtacaattctttccgagtgcttctgagtcacacaccatccgacagaagtggggacaaggcacacagaagtgccactggtcccacaaagctgtccagaaaattattcaaaaaacaagaaacctaggcagcacctgtgctgtcctgatataggtaccagcaccaccctcaccagtcagccagtctacatctgcactgtttccagaatttgaagatttgttcataagcacaggggtaccgagttgagtggaccaatgtgtggatgtttgaaccatttactcattatttaggccactttaaaagtctcagaaggaggagacaaagctcttttaaaacttggaagatttaactggaaagtcttgctagaatcttgctactgtgagttttcagctcccaggttttttggatcccaagagtaatatttgattctgactctgggaatgttgaacaaaacaagccaatggattctgaacgtggcatctgccttccatttttcaaattcataagagcatctctccctcctgtcacatgaatagagcagcagctgctgactcaagagcgccgggaaaagggtgattgtctttcacttggcatagacacccctgaggacaagactactgagttaataatcgatttcactcccctgcaggctctcccgcagctcattcgtgagggcaggaggaagggcgggtgctctggactcatttacagtccctgtttccttaaataattgtgagtaaggaggacagaaggcggcaaacggagtcagtgagacagctcaaatgccgcctgggtgttgcatcacttagacataaaatatcaaccctaaatgccaggctgttctgtgtctgtggatgccccgaaaccctctttccaccctgtgctgacctagcccgaatactgactcagcctttaatccgtgttctctcttcttctgcagcccctgaatacgttgttcatgcacctctttgtggccgtggatgagtattctgttggctgttgcaaagagattcttcggtgagtggatatggccgtgcagtggtgaacatgaaagagactgtgtggatagttttgaaatattttttaaaagacatgaaattctttggggtgtttaatttgcttgtaatttgtggctatattaaaatatttactttgaatagcaatgatatttctgaaaggagatagttctttgaatctattgtccattctgcacgctgttatcatttgaggcaaacagatagtgcagtaatttaaagaaatggatttaggttgaggggagtaggagaagaattaagtgtcgcaagcttggacatttctaaaaactgcttttctttatcttatctttagaaatgtttattaacatgacagacttcaaagcatcctgaataataggatgcatggaaaatgaccagcagggctaccgagtcatggcgatgtgtctctgacagcctctgacagcctgcacagacatttgggggtggtggtcacagctttcaagtcactttgtaatgtcacaccagaccgtccagatgccaggtcaaaggttaatattagcagaaatctggtgtgccatatgaacatggcaccctttattctctctgcctccatgggacagatcgaaaaggggccctttagaacccaaggaaaagtagagaagaaaaagaaattgccttgaggctgttcttgccattgcaggtggggagcaaaggagcccatgtggatttaggaacacctcacctttttagtgacagcatttgtcttcatcaagtgccagctgatgggattgctttgttagtaacactgccccaccctctctttcctcaccagaaccgtgtataaggcagtgccagagctgcacttcatatttctcatcgtgccatcctacatgagcctaggtaaggcccgcccaaccacctctggtccccggtagcaaacattgaaaattcactcccagaatggtgctttggggaatgagaaataagagtggtctccaggtcctcaatgtaccatgtgcatattttattagaacaattaagcacaatttagaatggaaactacattttgttctgacatcccaaatttatttcttgataaataaggacatgtttctttatctctgtgatttaggctcaactctcataactgtttttgaccaagtggggaacatcccgtgtctgacgtatgaggaagactttgcagtgcatatatgtcacaggcacagccactatcctcagctgcacgttcgcaaagccaggtacagttggagtcatgccttgtgtgacctaagcttcactgggacagtcatcttcccaagactctttaaactaccaatgctaagtgactatagcttagatcaaaattttttacaatactcataagcattacttcatttggatatctttatagttccccttaatgacattatttgcaggactatctgatgatactcatttggttctatgtggctataacattattcattgactccttaggggtttctgaaaacacacaatcctaggtcccacaccagtaagataactttcaaataaaacaagcttaaaaatgaacctgcctattcagttttctcggtaaaacccacctattttctgacattcagtgaatgaggatgctgttgaccccaaagaggggttttccaaattgaaggtctctaccatcaggtgccccaagtccagcagtcttagggagatggctgtggcagtgttttccaaagatggctgccacactactttccaccccgcaggctactctttgatgtgactttgccactcctctcttcaagccttgggcgctccgtcctctcttcctgaagctgggtgggttgtgactgctttgaccagtagaccgtggccaaagggatgctctgggacttgtgaggctgggaagcttctgcctggctctctcaggatgcttgctctggaggaagccagccatatgtaagaagtctggagaagccacatgttcgcaaggggaggggtggttgacagccccagctgggctcccgctgacagttagcttccactgcctgtggtgtgaatgagccattgtggacacccagcccaggagagccccatatatctacagcacagctgacatctgatcgcagccacatgacagaccccaagtgaggatgcccagctgagccctgccagagttctgactcacaaaaccatgagcaatgtagagtggctgtttggaaataagagtgcattatgaaatcatctcacagaggtggttgcttggcttatcagtgaagaataaattgtatcttttgggatcagccattgctgtgtttgaggaatgctgactttctttagaaaagtattttaaaagttttaaaaactttataaaagtaagagcctatgatttaccaggcatgtagcagtggtatggcatcgttgttaagagtttgtaatgctggcatcggatagatctggattctgatcttggctctcctgctcacgaggtgggttaacttacaaaaggaacgtgacatctgcgggggtgtaagttccctctgtcagtgggtgtaagcgtattgtctacagcacaagattgtgatgattgtgagctaatgaacatcaagcacttagcacacttcctgccacatgtaagggcccaataaatattaaatattattatgacaaaggggcttagagttaagtggtggggagagactcatcttcagttaactgtcatgttggtagctgagaagcgggatgcacagacagagatgaagacagcttcattacaactgctcctccgcccaaaaaaacccctctaaatgtccatccaccagttaatgttgtttacccttataaactgtggtacatccatacagtggatgctactcagcaattcagtggaatgaaccatttacatatagtagcatgaatcaatctcagaaggtttatgctgagtgaaggcagacttagaaaagcatatacagtactgctgattacacttttgtgatatacaaaatgggtgaaaagcatccacagagataggaatcagatagagatagaaaccaagatcatggagatcatgacacaggctggaattctagcagcgacaggtcacagagatccaggttgttgacagcaagagtcagactctgtaaaatgtttgaagaggtttattctgagccaaatacaagtgaccagggctttgacacagccccaggaggtcctgagaacatgtgcctgaagtggttgggctacagcttggttttatacattttagggagatataagacacaaatcaataaatgtaagatgtgcattggttcagtctggaaagacaggacaactcaaagcagagaagagccttccaggtcataggcggattcaaagattttctgattggcagttgattgaaagggtttatctaaagacctggaatcaatatgagggagtgtctgggttaagataggggttgtggagacagaggttcttattgtgcagatgaggcctccaggtagcaggcttcagagagaatagattgtaaatcttttttatcagacttaaaaatatgcctgactcttagttaattctctcttggatcaggaaaaatgcctggaaaggaaggggattcaccacagaatgtagaattttctccgaagagacagttttgcagggtcatttcaaagtatgtcaaagaaatatattttggggtaaaaaacttcagtttatttcagggcctgccctgctgtcatgtttgtatcttattcctacaaagagtctgttctgtcattcttaagatctctgttttcatgttaatcctggtcaaatgttcctaaattccaaagggaaagtataatgaggcatgaccgaccacccaatcccatcatgcgctgaactggtatttcaggtttatgttagaatacccttggctgagaggaggagtccattccattggtttgggggagcttagaattttatttttggttacgtggtagggaaaggatcaggtcaggtgcatagatacagagagacatgttagagagtagcgcttggctaccagttggatggaggagttgagggatgaggagtttatggtaattcagggttttcaagtttaggggaaatggtgctttcattaactgaaagtagaaataatagatttaaatggacaggagaaggtaggaaatagaaacagagggagaagccaggtttgagatacacatttgtgagttgtcagtttgtcagtaagtggggagatcatgaaatgaaggagattgtcttgctgagggggagattgcacagtgaaaaagcacaggaccagggcagaactttgaaagatgaaaatgagctatgaataatgaaaactagaagagagggagaggaatacagaagaaattaagactcataaagtggcaaaagatgcagggaaatgaaattatttaagtaaaagagaagccattagatttggcaatttaaaaaggcacagataggatgaataaaactgatacttccagccaaactgaccaagaaaaaagacaaattgccagtatcaggaatgaaagaggtggtatcacttacagatcctacaggcattgaaagattaatatggggacattacagataactcaatgtcgataaatctaacaatttagataaaaatgggccaactactttaggaacacaaattaccaaaactcatttaagaaaaaataggtaacttggatgcttccgtatctattaaagaaaaatcagatgaactttgggtgagaggaagggggccctcctgcccagacattggcctctccccaacccacagcctgatttgctctttttctcctctttttctcttgttctcatgactctgaactctgccttcctcaggacctagtcctcagttttctctcaagctcatccctttgactcctctgtgccaaccttgccactcagtaaccagtgccctacttctgaactcttggtttggggtgtggtcttgtcactccttgaagggcagagtttcacaggagaggccaaattgcagtgagcggaataaatgggaggtaaggaaatgaaagcaaaggagtagtcagtgctattttttttttcctttttgctggagaaagtcactgctcttcagagaagttttgtgttgaagggaagcagagagagggaggccagaaacctacctgcagatgctgaacattatgcaaacagtgtaatgtgatcccgtttttcctatccacgtggagcattttatttgcattctgagagcggggcagcatgtctcttaacgaagttcaccaagaagcagatgaacttcagatacatattatctacctaatttagtttgagagaagaaaattcctcatataaaatgatctttcattactttctttttattaatagctaaataatcctctctttataaaaccctttgataatgatacaaatactaatgcaagccaaaggcagtctgaagaaatggaattttgtgtatgaaatgacatttttaattggttctctcatgtctttcaaatttttattcctgatttataaagtgtctcttgttagtgtcaggggaggcaaatagaccctcctgtccttcaggaaattatattttttaaagaaatattaccttcagtttttaaattacaagaatctccacaaattaattacttaggatcttgtaagtagtgtaacaattgttacacttttatattcattttaaaatctctcattttttatgccatttactaattttttggggagatgggtttatttaataaaatgaattctagtttcaaatcataaaacttaaaagtaaaagttattctttcatttttctgtgtatgtaactatacacacacaagtatagtggcatacatgcactctctctacatatatacctatatatatctccatgatcatatgttctgttaattatatttttcacttaacatagcatctcatcatttatcatctttagagatcaatttctttcttttctgatggtgcctggtccatgatggcctaaccatcatgtagctctaatacaattcatttagctcttgcttatttatggaaatttaatttaagttgtttcctgtaaaaaatttaccactttttctataaaaaataatactgtagtaaacagcattgtacatatatcatccagcattcatatatagtagtgtacaacagataactaaatgtggaatttggtgtaggaaatacccagatgtttgcaaattctaagatttaaaaatagatgccaccaaattattcaacgtaaatatcatatccatttatattctgaccaaatagagttgtttccttacatcttcatcagtgctgagtattttcagttattaaaactgtttcctggccgggcacagtggttcacacctgtaatcccagcactttgggaggctgaggcaggcagatcacgaggtcaagagattgagaccatcttggccaacatggtgaaaccccgtctcttctaaaaatacaaaaattaactgggcgtggtggcatgcatctgtagtcccagctactcgggaggctgaggcaggagaatctcttgaacctgggaggcggaggttgcagtgatccgagattgtgccattgtactccagcctggcgacagagcaagactccatctcaaaaaaaaaaagaaaagaaaaaaggttccctgttagaccaaaatagtattttgttgctttaaattgcatttgtctaaatctgtgagagtttgagtgccattttacaggttccattttaaatgaataaaatacttgaatttaaagtaacttccagttaagctatcatcctaccagatgattaaacatgttcctacaaagtaggcaattctagacaattccaaaggattgggcaggggatagatatgagttacttacaactgacaaaggcaaatttctaaaagtattttcttaagttttagtcaggatacccgatttgtatcttgggaattatcattttctggaggtatgtagggcttaattaaggactttcaacttagttattcagcaagggattattgtaatagaaaacttgtatataaatccaacactgaaaatgacatgtatagaagcagcccattcaaaaattccctattcctttcactttttagtaaggtattgtctgttaatttactcgctaatagcctacttgtcactcaggatgcagggtgcaggagaaaagatgtgggatgtgctcagcccagtgccaggctcccagtaagcatttggtaacagatggttatggtttggtctccctttctgcctcctttcctacaccccttccttcttttcttccatttttctcttgaaaacttgagtgctatggactataaccttcagtggacaaggttcacaaaacttgaaataaacctggataccttaacctgaggtcttgcacatacagcccctgatgtgcccatagaaaatctgaaagaagcaaaacacaagaggaatgatagcaaagaggtgacagtgggtactttgcagtgaggaagggatgtttattagaagataagtggacagtagtgaattcgtgtggaaatggtgacagtatggcagtcagtgcctttgcctgcagaaggtagagagtgtggcacattttagaaagccctctatccacatgttcagattcgagttttgatacttgcaggcacagaatttcatgtatctggagattgcagttgtgtggactacctccctccttaacaacgctagaaaaatggagactttacagaacatcaaatgggcgtggctgtgtgcctcttaggttgcctcctttctcttatttccctcacatgtattttttgacatccgtttcaacgatagttacttgcactgatagttaatggtgaagaacacaattcgtaagacactgaaccagtgaagggtttggggatgtaattatccttcagccatttggctagtgacacattcaaaaccaatgaattaacactgtaatcccctgtcctgtttctttgatttacccatgtggaaaattatgctgtaatctgcccatctacttagacagtaattagtgaagttactgttctgtacttttcatactatctgaaataaagcatagctacttctggacacacctctaaaatctacagtgggcttaattaatcatccatggtggatttgagatgtgttcagatttagaaactactggcatgctctttttctgggggaaaacctgtctttttcaagtcctcctggggctgggaggagacttggccaaggaaaggattatgtgctttcaaacaatgttgtgaaataactggtttccttagtggagtattgcttctttgttgataacaatggttgattaaattggctcaaccttgttgctttttaaaatagatgaaaaatctctaatcatcagggaaatgcaaattaaaccacagtgagatactactaccttactcctgcaaggatggccataatttaaaagtcaaaaaacagcagatgttggcatggatgtggtgaaaaagaacacttttacgctgctggtgggaatgtaaactagtacaaccactatggaaaacagtgtggagattccttaaagaactaaaagtagagctaccactcaatccagcaatcccactactgggaatctacacaaaggaaaataagttattatatgaaaaagatacatgtatacacacgtttatagcagcacaatttacaattgcaaggatatggaaccaacctaagtgcccatcgaccaatgagtggttaaaggaaatgtgatattcatacaccgtggaatactactcagccataaaaatgaacaaaataatgtcttttgttgcaccttggatgaagctggaggccattattctaagtgaagtaactcaggaatggaaaaccaaataccgtatgttctcacttgtaagtgggagctaagctatgaggacacaaaggcatacagagtgacatagtggaccgtgggggctggggagggggaggttcggagggggtgaggaataaaatccaacctattgggtacagtgtacactgctcaggtgatgggtgcactaaaatctcagaattcactactaaggaactcatccatttgactaaaaaccacctgtattcccaaaactattgaaattaaaagaaataaaatagatgaaaaaaacattctttaagatttaagatgggtggtttgtaattacaaacttttaactcttaaggcaatcattttaatgaaacatttgatagtcccatgtcatgctttttagaaatccacttaaacttgacttctgagcaatttcatatgaataattatgaatatcctaaagcattccaaaagaagggatagggcaattacagatttcccccaacaatcttcatgaataagactggtaagtgaccaccaagtctatggtggagccaagtccagctggagccatactagcccaggatggacgtttagatcagatgtgctttgaaaagcacatgacaaatttgagcttaaaacccttcataatttttaaaatcatgacattttccaaggactagaagctaaatgactccaaaacccatttggaagttctacagtggaatactatatggagtttagaaatgatagatttgattttcttaaagaagaccactagaggtcacaagagatcttgaaaagaaaaagggtgcttggttttgcatacctgaagtgaaagaaaaatctagttgacgccgatcttaggttctcctaccccatgttgagatggtgttcatggtaaaaagttggcttaactagaacacactgcattctctatcactaccactaaattagattttctatgacttgttttcttaattcactggtttcttaaaatacacacacacacaggtttgaagaaatatatttatggtgtttgaagtgacaacattcagttgtacattttacaactgtacattttaaagtccagctttaaatacaaatcctctctggatatggagaatatcatcagacaggaatgaggaggctgtgccaggattctggatgcggaggtggcctgctgctgctgctgctgctgctgctgctgctgctgctgtcactccagtccttaagtgtgagttttccatctgtgcatttgcagtggtttctgtgctggcagggaagtgatgcacacctctcagactcgagggaagcaggcctgcaggttttcctctggggccgtaatcatgtagtgcagcagccaggctgtggaggtgatgaagcaatgtcaggatctgcgtgtcacccagagacccatcaggctgcgagggagagttctgcatgttctggatgtcgcggtgctcctagcaagctcagctaaccgactggtggaagtgctgagggagtttgtcctcacttctccccaccttccaggaagccagtgagagctaccggctcatttctagctgtggacttagaagacacccatttcccaagtagggtgtcctgaaagggggttgatttccttaaggtgtgtgttcaactccatttcacatggcacagttttcagagtctgatggaaatctgggtgtctgagagattgataagtgtttatgaggtggaccttttgtttcctccagggaagttaaaataaaatattgtataattgatgacgttaacaagcacattgctgccccctccaagacacattcagaatggaagatataaagtaactttgcttttcgctcagagaattgtactatttccgttgcactctgtgctgatctataaactccgcatcttcatcgccactggaacactgtgcggcctgtcagtgccagggcatgtgacgctgcggtgccaaattcacagtggctctccttgcatcctgactttgacaggcagcgctcattgcctcagaacagtcacgttgaaacatttgactgcatgagttgttttccatagctggggtgttttgtttctgtggggctggactttgtcatatgccatttgagactatgtgaggctgatgtcatactttatcattagcactcgggctgatgcaagatcataaattatcaattaccccaaggaatgcatttagcagaacaagttcctctttatccattttgggaaagggcttaagagagagcctcttcagaactccaagatttggatgtttttctatttttcccagaagaattcgtgttgaggtatgattatggataactttgttaacgggctgctgaggttcatgagcaggcctagggctctgggtctttcggaacctttattcctgatgtttatagctacagagtaatatttctgtgtccatcgtatatttaaaagcctatggtgcacagttgattgtgtgtgattgctgtcttcattcacttaaatgattaggttattgaattatttttccattatttaaaatgtctgttaataaatattgatgcaaccttttatttttggcaaaacgtttgaaaatggatttgttgactactctctcctagaattttttacaaattattcttagccaatatcatcaaggactcttttttacagagaaaagccaccacctcttattagcaatgcccttttggcaggttaagtggggaagtgagttgttcctggaatgttctaggctttttctgccaaggttctgagggctcacgtggagaacaaacacttgctaaggacttagtgtgccccagagagcaggctttagtgcgtcatctgtgtcttgcagctattcttgtccctacctgttttttgtacatgagaaaaccaagtcttagcattgaagtgactttgccagtttcttttttttttttctttcaaattttattattattatactttaagttttagggtacatgtgcacaatgtgcaggtttgttacatgtgtgtacatgtgccatactggtgtgctgcacccattaactcatcatttagtattaggtatatctcctaatgctatccctcccccctccccccaccccacaacagtccctggagtgtgatgttccccttcctgtgtccatgtgttctcattgttcaattcccacctatgagtgagaacatgcagtgtttggtttttttgtccttgagatagtttgctgagaatgatggtttccagcttcatccatgtccctacaaaggacatgaactcatcattttttatggactttgccggtttcttagtcagtagagtcagaaggctaagtagaggggctgtgatgccaccagcatgggaccataggttcagactgcccagacgctgccccttgggcataaaaattctgcccttcactgctgtcagtgtaaatgggacccttggcaaggtctcagcacaaggtaagggcccagttcacgttggctattgctgctgggttacatgctaaagaactgctacagaattccttctgtgtccctaaagagcattttccgtggttgggaagatgccacaccttggccgtaagaattagcaccagaactggacaatatatatccagtgatgatcccatcattgggttcctgggaagggaagttgggagagaagagtcaccggagggtgtagggtggagatgagctttggaggatgctggaattggggataggcaaggggatcagagcactggctagaaatagaggtgggaaggagggaagatggtgaagtctccttctagagacaataagtaaatcaacttgtatcattattggtgactagggtggaaagatgcaggcaaagaattttgtgcccatcccagaaacagtggggagcttgcaaaagtggagttttaaaaaaataatttcaatttttattttagatttagggggtacatgtgcaggtttgttacccgggtatattgcatgatgctgagatttggggtacaattgatcccatcacccaggtactgagcatagtactcaacagtttttcaacccataccctgctccttctctcccctccctagaagtccccagtgtctatcgttaccatctttatgtccctgagtgcccattgtttagctcctacttataagtgaaaacatgcagtatttgtttttttgttcctgcattaattcacttagggtaatgaccttcagctgcaaccatgttgctgcaaaggacatgatttcattatttcttatggctgcatgtaaaagttttaaagtaagatgaagaaagcagggttttaagaagattagtgatggtggatggaatgacagagtttctccttacagtagtcaatgggaagtgagtgcagtgattcaagcttctgtagtaagaaactctcttattccacccactgactgtagaaattcttcagttctttttggtttctcctgcctaagtaataatgataataacaataacattgcacataacccttttttaacgtttgctatttttgtgacagatgcacacacggtaacatagagaggtaaagtacccaaggtcacagctgggcagaagcaggatccagacccaggcagcctggctcccccgctcaggctgtgaccactatgctgtatcatttttttttttctaatctcttcaagagcaccataagacttaatgcatttatggtggcgcctcagtccactgggccacaggtgaccaccgataatgctcagtgatcacatgcagaaatagatggacaagtggtcaaggccctaccttttgtaaattattgcagggctgaaatagcttgaaaaatgactgcagcatcagtagtacagtcatacccattcaaaaaatggttgacatttgtttctggcttcctgttttagcctcatcactagaaattcctgctgatgcccttgcatcatggaataagactgtttggtggtgatgacatcagggccaggttgacagttttaaaaaacaaaggatctggttgcctggttaaggaccctttgctgtctctccttccagagagttttgacaagaggtgtattagtccattctcacactactataaggacatacctgagactagactatttatgaaggaaagaggtttaattgactcacagttctgcagcgctggggaggcatcaggaaacttacaatcatggtggaaggggaagcaaacacatctttcttcacaaggcagcaagaaagaacaatgagagccgagtgaaaggggaggccccttataaaaccatcatatctcctgagaaccttctcactatcatgagaatagcatgggggcagtcacccccatgattcaattacctcccaccagcttcctcccatgacatgtggggattatgggaactacaattcaagatgagatttgggtggggacacagccaaaccatatcaagaggttaacaagaagattcaacctgtggagtcatggtgatggtccctcccatcccgagttgtcatcttctgtgtgtgttttttcctccttgtaccgtggtcttgttggctggctccctccttccctctgaagttttatagaccagagacctggcttttcaactgtgtagttcttccatcaagatacttactgtttttaatgaaaaaccagcatcatttcaaccgttacacttgtgtcagcagaggcaaaggtttcatcctgggagcagggtgaagattttcatccagagtgcatgcggtcattcagtttaaagcatttagacttaggaagtgcagctgtggcaggatcaggggattcgttcctgcagggcgcaggaggaatggtggcagggctggcaggacgataacctctggcccctagccaaggactcccctctcaactcttttgcttccagctacaaatgttcaaaagaagagtcaaaataaaggaagattttgaagtgcattgtcagcttagcagagtgtgaaggcagggcttaagtcactagaccagagctcatatcacggctctgctgccaactatttctgtcatctcaggcaaagcatttcctcatccccatgggccttgctctcctccctctgcaaagtgaaaatggcagtgccaccctcctgggatcactgtgagaaacacagtagcagaaatcatctggataaagccctgagctttatatatatatatatatactgatcactcagtagatggagctgctattaacgtcaaagagaacatactagaagataaaatgggatgatgaagatggtagcatagtaaagctagggggaggaaatagacattagtagccaaagcagatatactagaaaaaaataacacaatgctgaaacatttttacagaaagagtatcagagaaaaaaaaaaaaaagcaaagtataagaacatcccacacaggtaaaaaagagcactaaacttacccaagaatgtgctaaaaagaagaaaggagtgttaaatcctgcagcaagatggaacacaggagctagcctccccaagctgcaataaatctggtttttgttcccacctgccaccgccccctgtgccagactagttgtcaaggtctctgtagagggtcctgagaatggaagcggagtggatgtccccaggagggtgagcagtgctccatcacttcaccagccttcccctccatggcaagtgcagaggcatctcaggaataaaggatgccatgggccagtgtttgaaaaatgcataaacaaggttaaatattctttactgtagtgcttctcagagtctttaatatgtaactatgaaacaggaagggacttatagtggttactgtttttaggcattggaattctttgggctgagaggatgctcgggacaatatcatagtggtgtttcttagaacatccttgggaagtgctgcccctagtctcttgtcctttggcccatgacaagtgcttccctgcatcccacacccacacatgccaactgtgttccctctgcctgcaatgttccacttctaggtttcaacatagcttcttccctttctgttcattcagctctcagctcagatgaccctcctcatagaggtcctccctgaccacttgaccctctcactctctatcccaaagcatgtatcattatttgaaatgtttagaattgtctaaattggttacatctttattgtctgtttctcctattagaaggaaagttcaggccaggcgtggcagctcacatttgtaatcccagcactctgggaggccgaggcaggcagatcatgaggtcaagagatagaaaccatcctggccaacatggtgaaaccctatctctactaaaaatacaaaaattagctgggcgtggtggtgcatgcctatagtcccacctactcgggaggctgaggcaggagaatcgcttgaacccgggaagcagaggttgcaatgagccgagatcacgccactgcattccagtctggcaacagagtgagactccctctcaaaaaaaaaaaaaaaaaaaaaaaagaaggaaagttgatatcatgagtgttgctctagccccggcacttagaacagggtctggcacacagttggtgccctgttgaaggaaaaaaatgagtgaacgaacactgaacttcagcctttctattaaacagggtggaagaccatgacgatctcatgccaatatttatgcgctatgacacaattctgaaggaaacttacggtgaatacttcctggccgaactaatagaggcccaagatgaagagaatcatgctgttgtgtgtgaggtcagtgactgattcatgtgggaacacacttagtgagaggaaggagggatgtgagtggtgttgctcttgcgttgctgggcacccctggagctgccattgtctccctggccaccccggccctcccactgcccttccaggtggtgcaccaggccagcttcctcccctgggttactggctttaggttgtcttttgcgaggtccttccagatgcccacgatgctgtagattcttgccttgtccctagagtgagagggaatggaaaagaccccccaggggtgcgtagggggatttctgaggatccccaaatctcagacttcagaagtcacaaaccagcgttctgctggcagatggattttgtttgagttggaaaggtattttttttaactttttgttttgacatagtttcacacttaaagaaagtttataactacccagattccccaaatgttaacatccaaccccatttgttttatcattctcttgttcaacctttctaattccctctctctctctctttttctctcttgctggctctctctctctctctcatgtatattctgaaccatttgagagtaagttgcatacataatgcccctttacctgtaagtatttcaatgtatatttcctaaaaacaaggacactctcttagataactgcaatacaatgatcaaagccaagtaattatgattcctgtaattattattattattattattttttgagatggagccttgctctgtcacccagactggagtgcactgtcatgatctcggctcactgcaacctccgcctctcgggttcaagcaattctcctgcctcagcctccctagtagctgggattacaggtgtgcgccaccacgcccagctaacttttgtatttttagtagagacggggtttcaccatgttggccaggctgacctgaggtgaactcctgacctcaggtgatccgcccgccttggcctcccaaagtgctgggattacaggcgtgagccaccgtgcccagctagttcctgcaattcttttatctaatctacagacttcattcagatttttctgacagtcccaggaatgtcctttatggcagaggtaattccaggccattcattgcattcaggtgctctgtttcttcagcctttttaaatctggaacaattctccgatccgtctttatcttccatgacaattacagttttgaatagtacaggtcagttattttgtagaatgtctccatttggatttgtacaatgttttctcatgatttgattcaagttatatatgattaaatatttttgaattagcagctattgtaaaaattatgaaagtctatgtaaaaattggaatttctagcttttctaaacaaatcagaaggcccagcctattgggcccaaaaggcagcccacaccctctaattcatgattcttcatctactcatttctcattatttgttaaaactgtaagagctgtttaaagaatattacttttcttgaaacttggaatgaaaagttctcttacttggatgacatgagcagtttgaggctttgttctacatcagtggttctcaaacttggcatatatgcagatcacctgggaggcttttaactatccataccatgccaatgacttggatccagaatatatacaaagaactctcacaacaatagaaaaataatccacataaaatgtgggcaaatgattcgaatagacacttttaaaaaaaatgaataaataaaagatacaactggccaataagcacatgaaaagacattcaacatcattagtcattaaggaaaggcaaatcaaaaccacactaagataccactttacctctgctaggagggttataataaaaaagcaggacaatagcagatgttggcaaggatgtggagaaattggaagcctcatccattgctggtaggaatataaaatgctgtggccattttggaaaaagtctggtattttctccaaaagttaaacatttgacccagcaattccatacacagaattgaaaacacatgtccacacagagatgtgtacgcaaatgttcatagcagcattattcataatagccaaaaagtggagacagcccaaatgtctatctactgatgaatagataaacaagatgtggtatatccacacaagggaatagtaccaggaaataaaagagaacgaagcactgatacatgctacagcgtgtatgaaccttgaaaacatgatgctaaagaaaagaagtcagtcataaagaccacgtattgtatgatggcatttagatgaaagcctagaatagacacttctgtagagacagaaggtagattagtgactggagggaaaggggaaggagaagtgactaatattgggcatagtcgttggttggtggggggatgaaaatgttctgggattagacagtggtgatgggtgtacaattttgtgaatatattaaaaaccattgaattgtgtatttcttttttttttttttttttgagacagagtcttgctctgttgcccaggctggagtgcagtgatgtgatcttggctgactgcaacctccacctcccgggttcaagtgattctcctgcctcagcctcccaagtagctgggattacatgcatgtgccaccacaccaggctaatttttgtatttttagtagagatggggttttgccatgttgaccaggctggtctcaaactcttggcctcaagtgatctgcctcccaaagtgttggaattacaggtgtgagccactgcaccaggcatgaattgtgtacttcttgaagggttgtttttatggtaggtgaattatatcaattatatccatttttaaaaatcctgttgcaggggtacactcaggccaattaagtcaatcttttgggggtgagacacaatccatatatttatttttaattttggacactcactatgttgcccaggcttttcttaaactgcagtcctcctgcctcagcctcccaaagtgctacggttacaggcatgagccaccatgcctgacctcaatctggatttttaaagatctccccagatgattccaaggtgcagtccaggtggtgaaacactcatctacatgagggtaaaacatacctggtgagaatgacatgactttatagagatgtgggtattagtttctgaaggtgacaattggcccctggaaattagattctgaagtactacattgaaaggatttttatttattttttaaatgtttattttattttcttatatttaggttttggcatggtttctcaaagacccgctttcacgtattcttgtttagccattagccccaggctaccaggctagccatagaagggagggttggaagcatttgggcccagcagtaccatttggaaagcttgtctttacacaactagacagaaactcctgagaagtgaaatgattcatacagaccccaataaggattttcatgaccaaactttacttatcaggtttaatcagggtctttgtttttggaaggcttttaattatttggttccaaggtactagttttactctgaatcacttgagtcagtgctttgtagagaagctgcagtgacctcttcccccacgttctttctctctcttgccgtatgtttcacactttcagtgtgtgtaaacatcagagcaaagctgtaggctgaaaactgcagttccaaccctgcaagaatcctttggtgtctcgaaagaggcagagggcatccagccccatctccttccagaggccgtgctgcctcaagcatcagaggctttgtgttctgtggaggggagaccacagacctcgatcttaaaatggaagggcagaaacaagactgtgagccgggatctgggaggggacgtctaatctgaagtgagccatgtctgatgtctgaagccttttggggttcaagatcaatgctgttgctaccctttttcctgcctccctagggggcttttaggcaatggtgtgctggagccagcttgctctggctctcaagggctgattgttaaatcctcaggaactctgcaaactgcttgttaaacacagctattattaaaaattaaattatagaaacctacagtgtaataaattatattaaaacaaagttaataaatacttgaaattcatcaccttccatttttttttactattctccatgttcttgagggtttttttttaaatgtctgggtctctatacagtagatataagaaataatggctagctactgcgcattccctcccaactacatgtttagtgagatcacactgttcacttgacattgaccatgatgacagcgcttacacctcagaaatcggcaaatgctacagatctgggcttttcccccgcaaatgctgattaggcatttacaggcacacgttactttaaggcaaccactgtcaaccagaggaaacagaaagaagtccatcaagtttgtctttctgaacagccatggcagttccaggccaggcatgcagcatgcctgagggcaaggctgtgccctgtgggaaacccttactactgaaagggtttttagttacaaggactttctttggcttgatagctagtttggaggagtttggggccatcacttcatacaagttccttgtcataactgtaccctggcttaccttgacatctggtgtttactccaagctgaggttttagggaagggtagttggaggccagcggcggctcctagtgacagatgggcagagcgtctgctttggcatcatccagggtgtgggcagcagtggtccgagtaggcaccactgacctgcaggcagggaaagcctgccaggtcagccatgcgcttggcatcaggaggagaggatcagagccagcagtggtcacaatgagggcaaaaccctcacagtggaatattgtcacccaaaagggatgggtggctgtagggctttttggatggaagcataaatgagaaaatacacacgtttctgtaaatggacctgtttgggaagacaaggccacagtacacatagttttctagcaatctaaaccttatgtgtcatgatgtagatatttacaggacaagcaagaacaacaaaaccttcagttttgttctccagtataagataattgaagacacttgtggtgaaaagtacttctgtcaccaggaagatagataacagccagcaatcaatgcctttctgttgtacaagttaaaaagtccattaaatccatttttttttcagtgcatacacaagaatacatttggatactcctgcaaattcatatttaagaatagtgtttctcaaatcggttatttgaaagaaactcaaaggaaaaagcagacacttccacaatatgtccttgctctgttgtagtctgtaattgtgaacttttgtaaattgttacaaccctggatgaatgatgggaatataacaggttgtagaattggagaacgttaaatctttgttcctaatggcaaaacatgtttttctcattttcatcagaatgtgtgatccatgccatttgaaatcaaattccaaacacaatgagccattagtgtaatagctcattactaacagcggtcttataaataatacattcttatcatacacatgcagctcgctgtgaagccagcaaaaggtatttcaggccatcgaagttttgttgcgccagcgcggctgtagattagaaggacatctccatgtgaaccaagatggatgccaattttccctgccgagagtcaggctggccgtctctttctgcacatatggtagatggattggttaatcagcgtctgctgagtcttgggcctgaaattacagagaagctagacaactgcggctatgcagcctttgttcacgagtgcaaacaagacaaacaatcacttgttatttgggaaaaaaattaaaatgtttattttggacttttattaaagtgtcaatggctttataaaacagctgtgtaaatccaggctttttcagcaagtatcattttagggggcctgtaaagaaaggaatatacatgaaaaaattaatttttaaaaattcccctcatatttcagtattgagaagaaaatagaggaggtctcacttttattttgcaaacacgtttgagaacaaatgatttttaactgggagacatattcgagaacaaatagtagtttaatacctatttttttttttttttttggtgtcatttaaaaaactgagtattattgtagcccgattctctgttttaggagattaaagcattttctctgactgggcatttatggaaagatgctgcgttcttgggaatagagaatgcctgtgattattgagttctgctactttctgaatgcaatggttatctaaaagtctgaacacttgagagataggacccagtaaatgcaggtttctaataagagctatcagagtctaatcagtcaaccagaatttgcttaaaatctactaataattattttatgtgaaatttaaaggactatgtattttctctctctttttaaattttaaatactttccttgcagaaaacaatgaaatacagaattacttaagggatatattaaggagtttcagtcacagccgtctctccatgtggaatatgatagaattaaagtctgttgttaatttctaatgttttggtaccaatcaggtacctggtacccaaccaaggttcagatcagctagttactcatcttctcgcctatgtattactcatcaaagactgaaaatcatggggacgactgcaagagcttcagaaccaggcatttcagggtgatgggaagttcaacatttgcagatcagacccacctggtgaaccagcctagcctgactcaagtttacttcactggaacattttccaccaaacttccttccctcatatctcctccctatcagactatccagttaataaataagtgacttcaagacaaattgaagagtttctacctgataaggagctagggaccgtgaactttctctgtactgggggctgatcagatgggcactggaacaatgacctgtattcctgagaagtgtgcatggcagagggaaagaaagtagacaggagcgccaggcttatggtggggtacaaacacaagacaccaaatggcagaggatatggagcaggcaggagcatggtctgagcagagggcaagtgttccaatggttgaagggtcaagaactctggcaatttccctgttacttatgcaccactaggtgtgtccccagtggtcacttattgggacattttttgagcatgttttatgtactgaaggaagacacttattcctcccttaaatctcaaggtgactgccaaaccaccagccgaccacattctgagggctctggaggtttcctgatgagaatcatttgacctctgataaagtaatgaagtgttttggactgggtgtggtggctcatgcctgtaatcccagcactttgggaggccgaggtgggtggatcacttgaggtcaggagttcaagaccagcctggccaacatggtgaaactccgtctctactaaaaatgcaaaaattagctgggtgtggtggcgggcgcctgcagtcccagctctgcgggaggctggggagaagaattgcttgaactgaggaggcggaggttgcggtgagccaagatacaccactgcactccagcctgggtgacagagcgagactttgtctcaaaaaaaaaaaaaaaaaaagaataatgaggtgttttggatatttcaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaaggtacagtggctatcacagggacacactgggaaattaaatctatgctttatacacattgcgctcttcgctaagtgatggaactagataggatgctttatatttccttccccagttccccttaaggagtagttcccatggttggtcacatccttgtgaaatacctacaagcacagatagtcacagtgcaggggtggagttagacatagtggacttggggccttagggctcccacattcaggatgctcacttcttgaatgttcattgctagagtacatgtaagttatgatgaaataattactggtgtttcaggtttcacacacacacacacacacacacacacaaccaaatacaacaagtgaatttttcaaatcaagaactcaggaaattttttatgcttttaagttttaatcccaactttcagtgcttctgtttttgtctttgacaaatcattatgtagtataggtctgttgcaagtagtcatttttaacttgcttaagttacttctagttatatgaaataataccatcaattttaaaatattgtctgtatcaagattttcaccacgttcaattaggtaacctcaaactttgatgttttaatttagtgaggtcttactgtatccatgggtatctttgcggttacatatttgggttcttacagaagacagatgcagacaggcaagttaccatgggtacatcaattcacttctccaaagctggatttcttcatttgtaaaatgggcataatagtaatacctcccacacggggggggggttgtgaagtttcactgagataagccatgtagagtgctttgcacagtcaacactcaataaatgttgatcatcaccgttagcaattattttttctttgtgtcggccttccaccaacttgaatcttcctagggtaaaatcagggtatttcaaattgctatgctttctcctgtctgaaagattacaccaagattgttcagaaatggggaaaggagcacttggctggtggcaaaggacttgccaatctagacaacagaaggcagtgacttggctaagcttatcccctgaatgcataaaccccgtgcacagtgtctagacctcatctgaacatacacacttatcacagagaacctgcaaagccacagatagaggagtttcccttttgtgctgatgataacaacaccctccccaaaagagatttggggtccttattgtttaatagtgaagccttgcttgccatgcttcccagagaagaactctaccataggagagttctgagggaacttatcagtgtgagacagtctggaaccataagttgtcattgttattttccaatgcttaaattcttctttgaaagcagcactaaatggcctttttttttttttgagatggaatttaactcttgtcacccaggctggagtgcaatggtgtgatcttggctcactgcaacctctgcctccagggttcaagtgattctcctgtctcagcctctggagtagctgggattacaggtgtgcgccaccacgcccagctaatttttgtatttttagtagacacagggtttcaccatgttggccaggctggtcttgaactcctgacctcaggtgatttacctgcctcagcctcccaaagtgctgggattacaggtgtgagccactgcacttggccctaaatagcctttttatggctgaatattctcacatgtaaaatggagataaaaatagtatctaacccaaagaattgaggggacaattaaatgttagaatctatgtgttgtgcttagctcagcgccaaacacaaagtaagtcctgaacatttaaaaatattttttcccctgtggctgttgtaatgaagaacaagttgaaaagatgtagtcccttccagtgtgtttctgagtggctctgatgctactgtttcctacatagaatgaatggaaaattccttagaaactttatggggcagtgaaattcaaaatttaaactgaaccctggacttaaaaacatacgtaagctagtatatctctagcaagagcccacagagatatgggcactaaaagaagtcctacttctgtttacctccttcaatatttttacctaaaataagtcaatctaggacagatggtaagtaaaagaaataggaaaacttatcttctgtgccttgtttatttttgaaagtcagctttatgttcattgacacaaagatgattccttatgaaattttcaccagggagctggcattgtagacttccacataacttccagggattgagtcacaaatcatcaacagctcattatatctaagaaaagagtcatcagcacattttgctgccatcttcctatcaacaacaacaaagaatgaggctccagagaaaattctaaatgtactgtgatctgttactttcctttcctgatgaaagtctcaagttaaaggaaatataatttctctaaaatatgaactaaaattcttgtttcaaatgagcacacatcactgtgtctcatatcttgtattttgtttagtgcttttttccatttcaaaggatttttatatatgtaatctcatgttatcctataacttggtgtaggagagctagggaaggtgaggttctctccattttttacttgctaaagctcatccaagcttttaaagctcatcagtggctgacccagaaggcagacccagcctctctctgctttcgtgcatgatgatagtcttggcaaggtaacgtcttatcttggatggttttgacagaaaactccaatgacgggtctgctacacaagatacatgatgagttttttcactttatttttattttttatttttattattgttatttttttgagatgaaggcccccctctgtcacccaggttggagtacagtggtgcaatctcagctcattgcaacctctgcctcccgggttcaggtgagtctcctgcctcagcctccccagtagctgagattacatgtgtgtgccaccacacccagctaattttttttgtatttttagtagagacagagttcatcatgttggccaggctggtcttgaactccgggcctcaggtgatccgcccacctcggcttcccaaagtgctgggattacaggagtaagccaccatgcccggccagttttttcactttaataagttatttaatgaatgatcacttcagtgggtgatcagtgacctgcccatatccctccgacttttattttgtatgtgtgtgctccaaacaactcctatctgctggaatcttcacctctgtgtctgcaggcttttttaaaactgtgaaaggccactctgacctatgcaggggtcaggctggaagtgtcaggaaattatcactcaaggaatagactctgtttccctatgtcacatcccagcttccctgctggtgctttctccattgactcccaaataaatggttgtaactgaatctttaacttaagatttgcctctgaggcaagtgagaccaagacactactagttaggtcttttcctaccagctgtgaaagcatttatttatacacagctgacttgggtgagagtataaataccccagctccctcactcctcaggtgggaggactcagatatgtgagtattggctggtttcccagagttcccccaagggattaagtttcagttgtccataatagtaatctgggtgataacacatgtgttgttgttttttaacttttaagttcaggggtacatgagaaggtttgttacataggtaaacttgtgtcatgtgggtttgttgtacagattatggcatcacccaggtattaagcctagtacccattagttacttttcctgatcctctccctcctcccaccctccaccctcaaaaggccccagtgtgtgttgttcccctttatgtgtccatggacaacacacattttattagttgcctttccttccctgtctctttcctcactctcctactggtacatcctggaaccacctccaaaataaactgcttattctcaagctcttctctcaagatctgatctttccctgccagctgtgaaaacttgcaatttcacaccaacctcaaccctttcaagcagaataatgtcaagactcagcattcttaaatgaatccagaggccctcctttttctagctcctaatacacatggtaattagcttactgtccttcatcatctcagccttatcaaaagtttccctggaggtctggctggtgttaacagaaaggagggcagagctggtgtggctgaccatggagaaagctgacttggctggtgtggtgcagagaagccagcttgtttatgtgcttattccatgactgcttgtcctgagcagaaagtgcttttcaggatctatttttggaggtttattaagtatgttctcaattccaacagtttaatgaagatctaaataaaatgctaggttctaccttaaaaaaaaagtttccctgaatctaaaatgtttaactgtgtacaatcaatttgtgttttacctgaataatttgtgtatgttttcatagctacccattttgcatgtataacctattacatacttgtaaactttggtttttatgtactaaacattgggagtaaactgggaccaatgggaataggttctaaggatgtaaattttgtccaagcataaggaaaaactagtagaagtgtattttttttatttaatggaggacctagtgtggaagtagcaagttcccagaatattggaagaattcataaagaaacagtcatacacacttacaaagggctttctgcttgtgtggaagattatactgaatgagatgtaagatccccttaaatgctaaaaaaaacttattgaatacatatcaagatgttccatatgcctggcactttatgaatattttccttcagtgacaataaaatggttcaaaacaatattttttccagttggccgcagcactggccctgcctggtgtttgcaaatcaagctgtgtcttttgttagctgcatcacccaataaatattttggaatcaagcttgagctggcaattttcttgataatgcataaggcaaaatagggcacaacctgcatttccacagctgtactggcattgccgcatttaatagttaaaataaaaaaataaaaacaagcaaaaaacaaaacttttgttcctcatgtaggccgttgagatctgggcagcatgaatctctgttttaaaagactcctgcaaggttccgatttgtaaatctcattatatacccagggcccaccttacaaagtctctgcagaacttgatgtgctccttggcagggagagatttcactttacataatagagttatgggcattcaaaagaataactagtgtagccccttgtcaccaagtcatccaggaaaactgttgctcactatacatataaaagacccttcaaaatagaatttttgtaatgtctccacgtaaaacatcgcaatattgcctttaactttttttttttaaattactcctgctgtcaggaaatgtctttatatgtcttatttcaattttatgtcttgttttattgaactcacatttgcttcttatctcagattccctcatctcttgggttaggaaacacctagacccactctccctgtgtcggagctaaaaaacaatggctacattaagtcttattgattgtgtattaaatcatcccaggtcttttcgcctctcttcctaaggttccattttatattcctggattcccttctattttactttattcttcttttaacatggattccaaacaggactggagcacgtatctacagggtgtgttaggatttctgctgccgtctttacattacagatctcggaaccttgtttttaacagtcagttcattctgtagttaaccagtgacccaccaggacttagtctgccagggctgccataacaaagtgccacagactgggtggcttaaaaaacagaaattgattttctcacatttgtgaggccagaagtcaagatgttggaggggtcagtttcttttgaggcctccctccttgacttgtagacggccatcttctccccatgtcttcacagggtcttccctctgtgcccatcagtgtttttggtttttctttttataaggacaccagtcacaatgcattagggctcacctgtaactttaactcagttacctctttaaagactgtctgcaaatacagtcccattctgaggtactaggggttaagccttcagtgtacgagttttgggggtgggaggaggcacactacagcccaggagaggctctatggtatcgtactgccttcctctggtccctaataggggggcggtatgtgttcagggtggggaatgtttggatgtctacatcctctcataagcccatgttcttcccctggctggatgtaagccgcacccacccaaccttctgtgcccgaggaaagtccctgtgtcccaccaatgggcttctcattgttcctggcatgggtttcagatccccctaggagaggagttctgttcttacaggcttctgtgccctggtcacctccacttcccaggaggctagggtgagttctggggcccattatagctctcactcagtggccacacagcaatattactcacttggtagcagttgccaccaaatttgccattttctcattgtgatctgggctttgagcatctcagttctccctcctccccttttctttccttctcctagatcctgtggtgtggttctttgatgcctgtactcaaggctctgatagtaatgcagacagtggcagcaaagtcggctttacttaatgttcatacatagccctaatatactaacttatacttgttaaaatttgaattatttatttatttatttttattgttttgagacggagtctcgctctgtcgcccaggctggagtgcagtggtgcaatctcggctcactgaaagctccgcctcccaggttcacaccattctcctgcctcagcctcccgagtagctgggactacaggcgcctgccaccatgcccggctaatttttttgagttttttttttttagtagagatggggtttcactgtgttagccaggatggtctcgatctcctgaccttgtgatccgcccacctcagcctcccaaagtgctgggattacaggcatgatgaatttcatttttttaagccactgaatgtctttagcatatgaaggcaacatcttcgaaagctttagctactcttgcctatatatatatatatatatatatatatatatatatatatatatatatataaaatttgattttctagaatctactttgttaattctaaagctttgcaagagatgttgataaaacaaataaatcataccagacctatacccaggcatctccaatgttgagagtttagactctttcagggctttcagggcagagcccctggactggtaggataccaggaagactgtaatccagacctgaagcccagaacttgttgtcagggacatgaccccaaagccatcttggtgagccttttggttatttcataaaacctgttgtcaattctccatcttaattccaaagctgatttctaagccttttctaatgtcttcaaaaacaaccatagcatcaaaggatggcaaccacttaagaatctattattttgcagacagcaacatgactgagatctgcattcctcctttcctcttcagccctgggagcgacctgtgatatcacagccttgttctccaacagtcagattcatttcacaatggtggaaatacaagcgcatttttgtatggggcctggaggtcttcagaagaaaagtggctttatttatattcgttatgatcattatgtgctgggattattttctcagtaggggatgtctcttttgcccatatttatgaagcaggggagaaggcatttaatgaagttcaagagtgtatttgactgtaaaacacatctcagtacattcacatgtaaataacccttttatttgttctctctggtgacctttttcctgttggggtagatcacagtttgttgttgttttccattttcagatggaaggctgaaagataataacgaaagattatgcaaaaaaaatccgtgtttaaaataatgttgatatgccacttgtgttgcaggataattatagtaatttggctattacgctatatggagtcagcagttagttgctagaaaacacggtgataggggtgattcaagggattttcatcccaactgggtgtttgatcctgctgacttttctcttgaaaatcaattgcttgcactgaatactttgaattcccccttgattaaattggccatcagtgggtcacacccattgcactgaggtcactgtgagttctgtttacaaagagtttttgatgattcttaaaatatcatggaccaaatttaatctgagccaagcggctaaggaagcaattactgaaaagcacagtttttgcacatggcaacaaacaaaggaaaatttattaattctgaagctcaacatgaagccagttatttgactactgggtcagaggccttctctccactgcattttgcttggactttcggtattttcagacctccatggacagataggctcactcagtagaagacctggtagaggcatcttggaagcatctttgacaacttttccatttctcctcaaggtagttaatagattcaggttttctatttcctttgaatcaattttggaaataagattattctagaaaagcttaatttagtatatgaagatgaaaaattagcatacagtagtggagatatatataggagtatatgtataatatatgtgtgtatatatgtatccaactctgtggaaaaatacttaaaaaaattttttttctttttttcagagacaaggtctcattttgttgcccaggctggggtacagtggtgcaagtatggctcactgcagccttgaactctttctgggctcaagtgatcctcctacttcagcttcctgagtagctggactataggtatgtgccaccataccttgctaatttttacatttttttggagacagggtttcgttttgttgccaggctggtcttgaattcctggctttaagcaatcttcctgccttggcctcccaaagtgctggaattgcagggatgagcaaccacacccagcctgtcttttttattgagtactgatttaagtctacatgaaatattctaaaataaagagaaaagcaaatcacaaaagtagttatataaaaatattattcataataaatgtgggaaaatattaaacttccctaaaactgaaatgcacattaaaacccaagatctttttctcccccattttgcctactaaattgtaaatatgcattgtaattaaaacacttagctctgggcaagaagcactgtaatgagcactcagattttctgatgctctgaaggttgactgatataacattctggagtacaatttagtcatggttatcacagaatgcattagatgttcatgttctttgacttcaactatagcaaatttgaggaaataatactaatactataaaaagatccatatgcaagaatttcactaagcttaatcataatactaaaaatgaacaaacaaaaaatatccaaataaacaaatgtaaaaaccccaagtctcccacaaggagatggctaaacttgtgaatatcccttagatagatatgcagaagcctttaagaagaaggttacaaatagtgaggggaaatggttcagatataatctcaggtgaaaaaaaaatcaatgcaaaatgaattgcagtatcagtaaagtcacctaataaaacacatgttatgaagagtacagggaggcaatgaactaaaatgacaaaagggctggagtcatagaagtggcaatagagcaacgcttttatttcctccctatattttttaaaatgtggaaactattaaatctacagaaaagttgcagatacgtttttttcttcctaatccatgtcaacgtaagttgccaacatgaagttgttggagcaccttggaatacttttgtatgtatttgctataaagagggacattctcctttgcaacctcaaacatccactgatatcaggaaattaacatgaatatgttactacaatttaatccacaatccaaagacaccagttacatttcttcatttgtcctgaggatgtcctttgtggcaaaagaatccagtccaggataacaaactgcagttacttgtcatattgtctttcaatgtggaacagttgctcagtctttccctgctttttatgacctagcccataattttgtagaacgtaatttatttttgtttgtttgatgtttattcatggtgagagtcatgtcatgcatgtggaactctgggctctcagtccatcctatctggtgtgatacattttcagtctgccctgttactgatgatgatgtgtgtcactttgatcacttgactaaagtgactcttttaggtaaaaattaaaattattttcacttatcccagtctgtgcagaagtctgtaataatgtctttcttcctgaactctgtattagctctaccctgattttcacttggaatcaactgatcctgttttactccttgcttggggtttcatctttgcaccacccagcatcccaccacaggtacttgaggctgttgagctctccttgggtaaatgatgctcttggttgttccatacgtcagtccttctatgcttgagctggtgtcagcctctggtaattgctgtgcgtggtccatttcaggcagatggctcctgacttactttgtagccagaatagacttcagcaaggcagactcccttccccctctaactagggtgctcacaaacgacatggacccagctcccaagtgctcggtctaaagctttacctacaatttattctctcctgtagctgtgattatatctctttcttcttaaagtcatctttgctttttactctgtcttgtcttttaattaggttttcctgtttggtcttttcaaagagctagctcttaatctatcaagtctatgggtttctttttgaatttattaatatctgctttcattttgtgacctctttctcctgatttctttgaatgtgttttgttcttcctattctaattgtctaattgcctgattcattcttttttttttttttgagacggagtctcgctcttgttgcccaggctggagtgcaatggcgcaatctcggctcactgcaacctccgcctcccaggttcaagtgattctcctgtctcagcctccctagtagctgggatcgcaggcatgcactaccatgcctggctaatttttggtatttttagtagagacggggtttcaccgtgttggccaggctggtctcgaactcctaacctcaggtgatccacttgcctaggcttccttgttttaaaataaaagcacttcttgggaagacaaagttttgctctaccaacttaggtccaagcgggtgggggcctgcaaattgaccaacagattaacaggagaaaaaagtattatatataaaataatatataatactatgtataaactggtttggtggttgttaagctcttcatttcccccatttgaaacttctcaaaaacattcacaaacaaggagcagggttgattgctatggagagaagactagggctacaagttccaaggaaagaaatctgcaaaaggagacagcaacatagattagaatgcggaaacaaaaataaaaatcaagattaatatctggagcaactatcaacctagtttctgagaccaaagggcatccagtcaaaaagacttttaaacattgggtttgaagcgtttctagacaggggagtgagcatggtattggcaaactgacagatttcccagtttgcagtttgaaggttgttggtgatggcgtagatagcaaatcactataaccacggtcatggctgtttcctggagcgcagcatagaagatgagtgttatagtgagcttcctgagtggcccacacagcagcagctccaagcacgaggcccatactcacacttgatctattgtgatgatgactattttgaagttcatgtcaagccatctagcttcagctcacagggcttcttaagaccttggagggaaaggggcaaaacaagacaacctagagtctcaaggttccgggcagtcagatttttcagtgatgccaagtcaggaggatgggagaaaatttggaaacattaattactggcaacatgtgtaagatagcaggattcagtttacaaaaaggtagaaatggctcagaggtaatgagcaggattagaatctgataactcacatgagcagattatagttttccattgaaatatagaatttataatcaccccaattttgatcaaagataataaaattaatattattttgtttgtaaaataaatctagtttcattaaatttggtttgattatttatatgaatacttcaaaaatggtaacagaccacattaaagtttgctttgctgaactgagattaggaatctcaaactggacttttaaaagcctgctgggactaggaagtcaggccaagaacttgctaccggatttcacctataatgcctatagatttggatggattccttttctcaaggtcccccaaatatcctaagattcctgggcctgccgggaagtagccttactaactcacctccaaggctgggaaccctgaatgcaggcaccagtatgctttttccaagagggctttgtaagcataggctccataaagtcaaccttatttccttaaagctatcattctcaaatgacattccaatctaatccttggtcataaccagttatgtcttgttacaaggaggacagattctcattgaaactatgcaaacaactatattgccatgaaaatggggacactcaataagagttttggaactctggagggatcaggcagggagaaaaataagatatttcatttctgtttacaaaagcataatgtacgaaattgttgtaagttatagatagctcacaaagaaaagagagacgggttccttaaatccaggataaaattttaaacaaagccataattttattcatcagttcatttagtccaatgtaattaattcttgttctgcttgatctaaggttagtagttttttatgaatcccccagcttctccactagagttttggaatatatgatataatctcaaagttatttatgcaataccttcagaagcctgcaccctagagtacttggcatattccttttccatgggtttccttttgttgaaaacaagtattatagcttattatagcttctagaaaaacttcagaataaaacaataactatccaggataagaagagacttaaatggtgtgattaatgatctgatgagagttcactataaaaatagcaaaattgatgaggaaatttggttgtttctgtggcatagaacttctaaaataaaaactggaattatgactataatattatgctattgttgtctaatatcaggcaaagcaataccagcacacatcatagcgtgggcattgacaaatttctaggaacttcatatacttcctgaaatatttatattcataacatttacataaaatatgtgtaaaaatataaccttgggaaagttatctcttcttacttgacaaagcttttcatgcatttcaacatatctaattttattttattttattttttcatttttccatcactccctatcctaattaatttttgatatctctttttttaataaggtaaaataacaaatcctttgagattttccaggggctttctggaaagtcaggaatttatagcagctgaacttgaacttccaggataaaagggtcatcattcttctcccacactgtaaactcctttgtgggggtgagggagtcaatggaagccgtattttcaggaggctctgcttaagtttaatgtttctttctgtggctgctgattgttcgaatgttttcagtttaaaataatcttcaaccattttggtgggctgttcatcacttcacatttaaagccatgcatcttccactcagtattgccttgtctttatcccataagctattaccaagtgatattgatattaacatccttattctcattgtagttattttatgaatatctgtggttgtgattttaatcttctcttttatctgaaattttttagggaagtggtttgattttcattgggtgtgattattgtgtgtgcttgtcctcttgtctttaatttctaaatttttgcattgtggttagaaaatatgacctgtgtaatttctacttttgttttaaattaagatcttttattacagcctcatataggatcagtttcatagatgtccatggactttcaaagagaatgtgcattctctgtttataaggctcaaacttatgtatagtgtggttaaatatagcttactatgatattcaaatcttccataacttcattattgttgacatggtctatcttattctgagaaagtaaaatttcccagttcactgtggtcttatcttctccacttatcactgcatttgtaaaacttttgctttatgtatttagatactgtgctctttggtacctgcagtttcatgacaatgaggttatacttgtggatatcttttatcaatacaaaataagtatcttcgctccatctaatatgtttagctttgaattacatttaatctgatataatatttccattcctaggcccacactgtaccacaataaattttatagtgaagtgttctaagcaatgtcctccaagtcttgggcatagataattttgacatgggacaatgaagaatggatcttagacaactttactcaagtctcctgccccatgttgttttgccttttacatttagatctaccacccacacgtaatcgattttcacatatggtgtgatatagaaatcacattttatttttaaaaatatgaatatccaattgactaagtaccatttattgaaaaggtcattctttccccctattgcagtaccacctgtgtcacagattaaatgtccatatatgtgtacatttgttttgggattctctgttctatttgtcaacaatacactgtcttaattaccatagacttatgataaatcttgatactggcagagtaagtctttccaccttgttttttaagattatcctttttattcttagttgtctaatttttccacataaacatgagagctcaaaaaaaaaaaaaaaaaaaagcctgggtgccatggctcatgcctgtaattccagcactctgggaggccaaggcaggcagattgctagagctgaggagttcgagaccaccctgggcaacatggtgaaatcctgtctctacaaaaagtgcaaaaaattagccaggcatggtgacatgtgcctgtggtcccagctactcaggaggctgaggtgggaggatcacctaaccctgggaggtggaggttgcagtgagccaagatcacaccactgcactccagcctgagcagcagagtgaggccctgtctctaaaattaaattaaattttaaaataatcattttggggatcttgaatgggattgcttcaaatttatagatcagtttgctagtggggaaactgacatttttataatatattaagcctcctaatctctgaatgtggtatagcccacaatttatttattgaaggataattaagtgtcttagtttcctcctataatgttttatagatttttatagagaggcttcgcatatctgttgttagatttattcctagatatttgatatttttacactattgtaaatatcttttaaaaatcatttttcaaattgttcatggctgttatgttgtagtggaatgggcttttgtatattgattgaccttatgtctggcaacctttctacacagacttactaattctaagatttatctgtatattattttgtatttctctatataatgtaaatttttgttctttactttccaaactttataatttaaatttgtttatctactggctaataccttaaatagaaatggcattaacaggcatccttttgttgatctcagaattaactgaaaagttttcagtatttcatcattaaggataactttgtgaatactcattatcaggtcaaggaagtgtctgtatttctgatttgctaagagttttattaggaatggtttgtttgttttaattgaattgaattttataaaatgtttttttctgtgtttcctgaaatgatcatatgattcttctctattctgttgaagagatgaattacattgattgacttttttatgtatttattttgttaatttcaatttagtcttgatatacaattctttatatgcagtgctggattttgtttgctaatgttttgtttaggatttttgcacctatattcatgagtgagattggcctgcaactttcacttcttgaaatgtccttccttgccagactttggaaatgaagtcatgctggtctcataaaacaagttgaagagtattctctcttctattcatttcaagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttattggtgttttattctttcttactatcaccagtgatatgttaatttaattggcattttcaaagaatcagcctcaagattttgttgattctattacttcttgcaactgcgtcaataatccgttgccacaataatgctactaacaaacagctacaaaactacagtggcataccacaataagcatgtattgttcatgcatttggtgtcaactaggcagctctgctgatcttggctgagtctactcacatgtcttggagtgttttggctgacaggtgatctagtcaggctttggctctgttgcatgtccctctcatcctttaggaggctatcttgtacaggttctcatggagagggcagaggcacaagagagcaaatggaaacatgcaagacctcagaaggtttaggctttgaactaacacatgccacttgtccaagcaggtcacatgattaaacccagaatcagagtgagagggggccacatgaagcaaagggcctaaatacagggaatatgaagaatcagagtcatcattgcaacccatgttcacacacaaaaagaagaatgctgatgacttttgtcatggtcttctttttcctgacctaaggagacacaaacttcagcttaagattggtctcctgatttgtgatacaatgagaatggggaaatggtatctgttttcctggaggaggctaagaccttatcccaagtctcatctcaagatggtgatttgggaattgtcaacgtattaagctcaagtttattgtactggttggcctggagtctacaccacatcccaggtaggaggagtttcactgaaaattttgagaaaagccctttgtcctttcatgcaacccgcctagtatctttctttgtatcactgtggactttattatcaacctcttgtcattcattcagtcattaaacaaatactgagtgcatcccatatactagactttaggaacatagtctagtatgtagtgagtccagtaccagccaatgacaagataaacatgcaagacaaacaactttacaataacatcattgtcttgaaggataaaagagtgtggtgggaccagagcagaattacacctaagtcatcttgagagcatccacatagacttcatagcctccacatagacttcatagacctcaaagcttttgagtaaaacttcaaagcaaattggagctttctaggtgaataagcagaaagattttcctagcagtgatatcaaagagtgtagaataaggagatattcaagaccatggcttattgggggaaagtacaagttcagtgttgctggagcatcaggtgagggagtggcaggagacaaagcaggacaggagaactgaggccaggcaatcaagaccttgcatgccttgcaagagagtttggattctattctattacatcggtcatatgtgatgatgaaccattggaaatatttaattagaatgcattacatgctcagtttctagttcacaggaagactttacaaaggccactatggcgtccaggaaggagatgaggagggattgaaccagaacaataactatggattagatctgggaggtattttagataattaatggaacttgatattttattggatatggggaaaggagattgtggaaaaggggactatcaaggatgatttcagaaactgggtagatggtggaaccattttgtgaggtgagattaataagagtgaatggattatttgatgaagatgctgagatggtaacaatcatttctgatttggacaggtagagagtttgactttcctagtaagcatttgggtaaatacactgcattcagtcagccacaggtgcctattaaagtagacagaaaaatggcctcactaaagacacccttgtataatctctggaacctgtaaatgtcaccttttttttttttgaaaggtctttgtagttgtgattaaagatcttgagataaggagattatcctggattatctaaggtgccctaaatgctatcacaggcatcctgtgataagggagagacagagggagattataaagacagaaaaggaaaaggcaatgtgattatggaatcagattggaatgatgtaacgagccaaggaatgccaaagccaacagaaactggaagaaacaaggaacagattctcccctagagcctctggagtgagcataggcctgctgacaccttgatttcagcccagggatactgatttccaacttcttatctctagaattgtgagagaataaattcctgttgttttaagccactaagtgagtggtaattttttacagcagcaacaggaaactaacacaattatgaagaagacaaaaggaaatgaggccaaccatggcacaaaaacatgtcaagaaataaggacttactcactcttcagaaagaactccttgaaagaattgtctgtgctcaatgttaattttttgctttttgtttttttgtgtatccattgtatgtttttagatttgagggatgaggcttgcaaataatataacccattattttaaactgatgacaacttaacactgattgcataaacaaacaacaactaacaagcaaaaagaaaactaaaaaactacactttatctcctggcttttttgttgtttctatttatatcttactgtactatgtcttgaaacattatagttattatttttgatcttttcatctttctacttatgagtagtttacataccataattacagtgttataatagtctgtgcttttctgtgtatttactgttaccaatgagttttgtatcttcagatgatttcttattgcttattaatgtccttttctctcagattgaagaactccctttaacatttcttgtaggactggtctggtgttgatgaaataccttttgtttgtctaggaaagtctttattactctttcatgtttgaaggatatttttgccagatatactattctagggtaagagtttttcttcttcagcactttaaatatgttatgccactctttcctggcctgcaaggtatccactgaaaagtctgctgccagacgtattggagctgctttgtgtattatttgtttttttttctcttgctgcttttagggtccctttttttacccttgacctttgggagtttgattattaaatgcctcgaggtagtcttctttgggttaaatctacttggtgtttatacttcttagacttgaatattgatatctttctctaggtttgggacgttctctgttactatccccttgaataaacttgtatccctatctctttctccacctcttctttaagggcaataactcttagatttttccctttgaggctattttctagaccctgtaagcatgcttcattcttttttattcttttttcttttgtctcctctgactgttaactttaaaatagcctgttttcaagctcactaattctttcttttgcttagtcaattctgctattaagagactgatacatttttcattatgtcagttgcatttttcaactccagaatttctgcattatttttaaaattatttcaaattatttgttaagtttatctgataggattcgaattccttctccatgctatctagaatttctttgagttttcctcaaatcagctattttgaattctccatctgaaaggtcctacatctctgtctctctgggattggtccctggtgccttatttagttagtctggcgaagtcatgtttttctggttggatctgatgcatgtggatgtttgtcagtgtctgggcactgaagagttagatatttattgtagtctttgcaatctggacttgtttgtacttttccttcttgggaaggctttccaggtattcaaaggaacttggatgttgtgaactaagtttttggtcactgcatctatatctgcattaggtgggtacacagagcccagtaacattttggttcttgcagacttgtagaggtgccaccttggtggtcttggataagatccagaagaatactctggattaccaggcagagactcttattctcttcctttactttctgtcaaacaaatgaagtctctctctctgtgttgagccacctgaagctgggggaggggtgacacaaagcacccttgtggccaccaccactgtgactgcaaagggtcaaaccttaaggcagcacagccatgggtcttgcccaaggcccactgtaaccactacctacattctctcaaggccctagggctctgcaatcagcaggtgatgaagccatccaggcctatgtccttcccttaagggcaacaagttcccctggccctacagaggtccagagatgctgtctgggagccagagccaggagtaggaaaccttagaaatctatctggtgctctgttctactgcagctggcctgactgtgacagcactaggcaaagtactttccgctcttccctccgtttttcccatgcaaaggagtctctccccatgtccaccaccaccacaggcccacagggagtactaccagggtactactgatgttcactaaaggcccaagggctcttctgtcagcttgtggtgaatgctttcaggcctgggactcatccttcagggcagtgggctcttccactggcctatagtaggtccagagatgccattcaagagccaaagcctggaactggggaccctaagagcctgtttggtgctcttccccactgtggccaagctgacacctaagctcaagacaaagtcccctttactctttcctctgcttttctgaagcagaagtggtctcttctcgtagccactacagctgagaatgtgccggtcacacctgaagtcagcacagctcttagtctcacccaaggcccatggcgagtactacctggctactgctgctgattattcagggcccaggggctctttagtcaccacatgatgaatcctactaggactgggtccttcatgtcaaggcagcagcttcccttccagtccagggtgtgtctaggaatgtcatccaggagccagggcctggaatagggaccttgtgactctgccaggtgccctatccaactgtggctgagctgggatccaagttacaagacaaagtcctcttcactcccctctcctcttttcaagtggaaggaaggagtcggagtctcttttggagctgtgagatgcggtgcctgggattaggggaggggtaacgcaagcactcttttagcagatccagctggtgttttactagctcgcatgtcccctaagtccggtagctcagtcctcgtggcctagacagcctttcaagtttatttaggaccccagagcacttttgcctgtggtggcacggcttgccagaactcaggttccaaccagcaggatgggtgattcccatctggctagggctgatgcaaatgctccctcttggggtgccagctgagttctgcctggtgttgacagcactgcattccattgcaaagtcccacagtcactgcactttctctccccaagtgtacagattttccacgccacgtggctactgccaggggaatggggaaaggttagtgttggcaattcaagactgtctttcctgccctcttcagtgcctctttcagtgatatgaagttaaaaccagatagtgtgatcactcccctgatttttggttcttatgaaggtgctttgttgtgtacataattgttaaattttgtgttcctgtggggaggatgattggtggaagcttctatttgatcattttgcttcacttcctctagcactatttattgtacagtttgttctttccccctaacttgaaatgccatcttcatcatatatcaacatttcataactgtctgtgtctatttctggccttcattctgttctattcttgccccagtaactctctgttttaataactatgtctttataatgtcttaatattcagttgggaatttggctctctttttgttcatctttcttaaatttttgtttactgtttctccatatttgctcttttagaatcaatttatttcatcacacaaaaattaagatttttgatggatatttaaaataaatgtaaaaagcacaaaattatattattatttattcctgaagccctcaacatgtattattttgcactccgtatgtattattcctattagataaagagcggggtagatccagagtcttgtgggacctaaagtctgacccattcaagagccctttttaaggagagtaatgcaaaatgatgaatgtggcattagatgctgtgccttggcggagcctgtgctgggaagatgcctgaacctctaagctttattagcttcatggtaaacccgcttcagataagcagtctcacttagagagaaagtcctgacaaattgtgcctttactcccactagagtaaaccaatagttcatgacttctaaactacttagatggtataagccataaaataacaattaaatcgcgcagcttcagttgtatttttagtcatgtgttacacaataccactgcctcagctttccccaggatagcacctcttatttgaggatctcaggggacattatgaacattaagtaattaaacctcgcaagaccccagagacactggagagagagatccagcttcaccttgcccagttctgaaatgcagtcacctctagggatgaacgtggcagctgcttagtaataaactgcaacacctcacgacagtttagtcaagcaattagtctttgtagttggtaactgtctcatgaacattagaccattgacagttaagtcaccaggattattagtttactgaaaatctaatccagtctttaagactttttacttttttgtaatattttcctaattataaaagaagcatgcacagtgaatgtctacttttagttgcattttttgtagttcttcaaacttaaaataggaaagaaatatctttgtaatacattaaaataggtagttactgataatgaggtttttttaattcacaagttttctgctgatcaaaagtaatcaatgatagtaaaagttggaagagtggatacctttgagaggagtattgactggacggggagatgaggggaacctctgggtgctggaaattttttttttttttttttttttttagtgctgtcttgttgcattttttaaaaaattttttattttttattttattattattatactttaagttttagggtacatgtgcacaatgtgcaggtttgttacatatgtatacatatgccatgctggtgtgctgcacccattaactcgtcatttagcattaggtatatctcctaatgctatccctcccacctccccccaccccacaacagtccccagagtgtgatgttccccttcctgtgtccatgtgttctcattgttcatttcccacctatgagtgagaacatgcggtgtttggtttttttgtccttgcgatagtttactgagaatgatgatttccaatttcatccatgtccctacaaaggacatgaactcatccttttttatggcaatcattaaaaagtcaggaaacaacaggtgctggagaggatgtggagaaatatgaacacttttacactgttgatgggactataaactagttcaaccattgtggaagtcagtgtggcaattcctcagggatctagaactagaaataccatttgacccagccatcccattactgggtatatacccaaaggactataatcatgctgctataaagacacatgcacacgtatgcttattgcggcactattcacaatagcaaagacttggaaccaacccaaatgtccaacaatgatagactggattaagaaaatgtggcacatatacaccatggaatactatgcagccataaaaaaggaaatgttttatatgttctttttttttcctttttttttttttgtttttggagatggagtctcactctgtcatctaggctatagtgcagtggcacaatcttgactcactgcaacctccgcctcccaggttcaagtgattctcctgcctctcctgagtagctgggattacaggtgtgcaccaccatgcccggctatgttttttgtattttaagtagagacgaagtttcatcatgttggtcaggctggtcttgaactcctgacctcaggtgatccaactcccttggcctcccaaagtgctgggattacaggtgtgagctactgtgacaagccagttttatatatttttataggcgttggttgttcaggaacagacatatgtagaaattccctgagctgtacacttttcatatgtgtgttaatctcaacaacaaggtcaataagcctaaaaagcatcctgctcttgtcatgatgagagtgctagaaaccccagatagtcttatttggaaaattctgcagggtgcaggacatatcgggagctagagatatgacagtttttattttcctcaaagcatctttcttcagaagagggattctaagtgatttaccctctcttctcaggacattttctcttcatgccaaaagagctacctttcatgctagaatgtgactctctgtctcattgtgccttcaacattatgtacctcttcgactatgccatttacacctccctaggcatctcatttttatcttagaatttcattcatttacctacatctttgccagaagtaagtataatgcattagtgacccagatatttggggttgagaggcatctgcaggggccattgttgtaactggcactagaagaataccatgggagaggaggaagcagaggaccctggctgctctggctctgcagtgtctgatgtgatgcttgaaaacaagaaggcagagcagcatgcccacactcacggagacagcagcagtctctggagccttcagcaggcccagggtccctcctacatctgtggcagcgcttctgaggaggggcagccatgagcagggtgtcctagggctgctctgagctgagtcccaaaggctgagagcagatgtcatggctgagaactcccagcagagcggacaccactgggtgaggcacaaaggagaggacatcctccaatgatgtcttctcccaggtctccctctttaggcatggagagattacaaaagagaaaaaaggaggggaggaggagggtgaaagacctttgtagacaaaatgggaaatttttagtaaaggttaaatacatgaagcctaagctaccctgattattgactttccagaacttactaaaaaaccaatgctcagctccagttcttcttgaaaataatttctattacgaaatagaaaagtgagcattgtgaccgctggcagagcatgagttcacagtatttccacacaaagagaaagcagcccttgtgctaagccttggcattcaggtaacactgatgtaactcactgtggccttttccaccttctgcctggagatcatttcaaagcccaccatcgaggaagctgataacccattgtttgtaaacttcaaaaggggctgctatgaaaggaacccattgcccagggactggcagaggttgagggcctcctgtggcccaggcctgggccaggtccgttgcccatcttcccatctccacaactcccctgggcagcatcatgtgaatgagggcaaagagaggtggagggagggaggaactagcccagaatccctcctcagtgtcaaaattcgggggggctgcggagacctgctcttcccacctcaaggtactgctctctagaataaaattctttagatccattgtagtctaaaaccatgtgaccatgctgtctaatttcctgtgattctgcagatatttatcatctattttctgtcattattctatcccttctctcaaagatgctgagctcaggagtagcagccaaggttcccaaaaaatagtcgaggagttgcaggaacctgtctctccagataccatggaaaacatccaggtgagagagactatccctccatgcctagggtggggggatgggcctgggggctacctgtgacatcaggggcatctctggtgctggcgtcactacggagaagttctaatgcctgatgcagaaaaggcctcactagcagtaagcacaccgcgagctgggggaaacagaggcctctgtgtttgtaacagacaaatcaaagcctcactggtgtgctccaaaattcaggtcagaacagagtgtcagcctttctctaccttcctccctgacttcaggaggctgagacagataaaactgctcatttaaactcactgggaaatacaggctttctgaagagactgacacactatctgcatactccaatgggacagcattttccttactgccctgactggtccctgcagacatggaaacacttgccccatctcccagcaaagtcccctcccagcaaagaggggactcgggagatgtgagtcttttaaagaagattatgtggcatggattagattgatggaaatgaagctgatttaatggaattagttttttttaagtgcagcattctttttacactaaggtgcagtaacggagactggatttactctcctgcctaaaataaccaaagtgtggctaaaatatagaaaacactgttcatcactgtaacaaaggccagcgatgcctgggagatgggaaacaagccaagcgaatcctgtggctgccccagttgtttgccttgacagaccttctaggtcacaacgcagggcaggaagagccagaagacttcccgagtctttaagtccatgcagactagagtgactaaagtctgaaggacagagtactagaaaggacagagtgcacagagagagacatcattgatcagcagatcagtcaggcagtcagctgagtgctgatcacaccaggcatgtgaggaaaccccttaaggccaggctgagaaaagaacctctgaaaaggatgaggattaatagtgcccatgcctgtacaaagttaggaatagtgcctgttctcaccagccagactggaaaagcttatgatttgcaagagagtacacaaaagagtcttgtggagaataattagttctagagagggcaccgctccagtcctgcttaacaaatctttaaagcaagaactaaaagaatcaaagtaacttaactgagtcccagaacaaagtacaagactatctgtaggaatacagaattacttggcacccaccaagatgaaattcacaatgtgtggaatccaataaagaattaccagcactcacaaaactggtaatatattatgcataaggtggagataaatcaatcagttgaaacctacatacatatgaaaacatgttagaattaatggacaaaaacattagaacagttatcataactgtatgttccaaaggttaaggagagacataaaagatataaaaatgccccaaatcaaacttctagagattaaaaactacaatcaatcaagatgaaaaatacaccagaaggattaactccaggttaggcattgcagatgaaagattagtgaacttgaaacaaatataaatgagatgttttttcaagatacgtatcagtgagtttggggacaacttcagagacctaatatatgtgtaatagaagtccacatgaagagagagagacgctaggacagaaaaaaaaaacacattcgaagaaataatgactgaaaaatgataaatttgatgaaaacaatatactcacagatacaagaagctcagcaaacacaagaacataaagaaaactataccaaagccagtggaaaaccagtgataaagagaaaatcttaaaagcagccaggagtagatttgggggaagtcaagttaggaacagagaaacaaagatatgaataacaggggatttcttattggaaataatacaagcagaaagatagtaggatcacatctttaaagaaatagaagaaaataaactccaccctagaattttatacccagtaaatatctttcattcaaaataaaatatgaaataaagagtttgccctacacagaaaaggtggaaaggtgcatcaccagcagacccacattacgagaaatgttaaagaaagccctttaggcagaaggaaaatggtatcagatggaaatttggctctacacaaagagttgaagagcactggaaatggtaacaaagtgggtaaatatataagattttatccttaatatttatatctttttaaaagatagtgacttcacaaacaaaaatagcgccgggtttataacatatgtaaaaataaaatgtatgacaagaatagcacaaagagcttgagaggagacccagaggggaaaagtatactattttaaggttcttatatctaaagtgctataatatcacctaatgacagtctgtgatcagttaaagatgtaccactaatgttataaatcagattcaaagagttatatctaataagcctatagttgagattaaatatcatcataaaaatacaaaattagaccaaaagaagacaaaaagagaggaaaaagggagcaaagactagatgggacaaattacaagatgacagacttaaacctaagtatacaataattacattaaatgtaaacgttccaaatgtcccgattaaagatcatgtatataaggcagatatagagtggataaaatgcaaaattcagttatatgtagactataaaaatgcactttaaatataaagatacaataggctaaatttaaagaatggaaaaggatacaccatgccaacactaatcaaaagttagctggaatggctttactaatttcagacaaagtagattccagaacacagaatactataagagataacaaaggccaagagaatgtaacaatcttaaatacttatgcacccaataacagtgcttcaaaacatacgaagcaaaaagttgtagaactgcaaagataaatcaataaaaattatagttagagatttcaatatgctcctctcaataattgatagaataagtaggcagaaaatcagtaaggataaagaagattttaatgacagtgttgaccagccttgccccacctcctggcctgggtagctgaagtgcagcacagtggccctcagcatcccatcaaatgtgacacactgtgaacaatgtggatcttgtgggctgcagccctggtggctgagggaagtgctctctggatgctgcatatggaaccactgtgttctcagtgtgtagattcacagatagacatgagtgaataataatagaaaatggcatggaacagtgggcatcaatgtcaagatgatactgggtaacaccctacaactggatgaactaatgagtgaagaagagtatgagaaatatgtaaaatccattgaggagtgagaatgggacctctcaataaactagaatgaaacaacttaattcagcatagttgtcttaaattagtaatagatggaagacataaaatagcaacttttggtattaccagtggataaagaaactactcccaacactgctgctggaagaaaataccccttttctaaagatttcagacaaacacaatatgcatctttttcacaatactctatgatttttaggctaggctctagttataatatttagaattcatgaagttttctgtggtgagaactagctgtaaaaattatatatcttgaggataacattatgtcttcagctttatataatattgtaacttgcttatatccattcctggatttgagtcaaaatacttaatgatctttgcattgaaaataatttgggagtggagaaaacttttgttagttgtacaatgtcagatgaagaacaatactgtctttttaagtttcaatagttttggggctaaagtggtttttggttacctggataagttctttagtggtgatttctgagattttagtgcatccgtcacctgtgcagtgtacactgtacccaatatgcagtcttttatccctcacccctaccggccaagtccccaaagtccattatatcactcttacgcctttgcatcctcatagcttatctcccacttatgaatgagaacatatgatatttgcttttccatacctgagttacttcacttagaataatggcctccagctctatccaagttgctgcaaaagacattatttcattcctttctatggttgaatagtatttcatactgtatataccatattttctttatctacttattggttgatggacacttagtttggctacatatctttgcaattgcagattgtcctgctgtaaacatgcatgtgcatgtgtctttttcatataatgacttcttttcctttgggtagacacctagtagtgggattactggatcaaatggtagttctactttacctctttaaggaatctccaaactgttgtccatagtggttgtactaatttacattcccactggcagtgtaaaagtgttcccttttcaccacatccacaccaacatctattgtttttgatgttttaattgtggccattcttgcaggagtaaggtggtatttcattgtggttttaatttgcattttcttgatgattagtgatgttaaacattttttcatgtttgttggctgtttgtacatcttttgaaaaatatctattcatgccctttgaccactttatgatgggattatttgtttttttcttgctgatctgttcgaattccttgtagattctggatactagtcctttgttgggtacatagtttgcaaatattttctcccactctgtgggttgtctgtttactttgctgattatttcttttgctgtgcagaaactttttagtttagttaggtccaatttatttgttggttttttgtttttttttttgcatttgcttttggggtcttagtcatgaattctttgcctaagcaaatgtccagaagagatttttttaatgttatcttctagaatttttatggtttcaggtcttagatttaagtctttaatccatattatgttgatttttgcataaggtgagagatgagtatccagtttcattcttctacatgtgacttgccagttttctcagcactatttgttgaatatggtgtccttttcccactttatatttttctttgctttgtcaaagactagttggctgttaagtatttggctttatttctgggttctctgttctgttctgttggtctacatgcctatttttataccagtattatgctgctttggcaactataaccttgtagtatagtttgaagtcaggtaatgagatgcctccagatttgttctttttgcttagtcttgctttggctatgcaggctcttttatggctccgtatgaattttcagattgttttttctagttctgtgaagaatgacgatagtattttcatgggaattgcattgaatctgtagattgcttttggcagtatggtcattttcacaatgttgattctacccatccatgagcatgggatgtatttccatttgtttgtgtcatcagtgatttctttcagcagtgttttgtaattttccttgtagatctttcacctccttggttaagtatattcctagggtttttttgttttgttttttgtttttgtatttgtgggttttgtttgtgtctgttgtaaaagggattgagttctctatttgattctcagcttggtcattgttggtatattgtagtgctactgatttgtgtacattaattttgtaacctgagactttactgaatttgcttatcagatctaagagctttttggatgttttagtgttttggatgttttgtgttttctaggtatgtgatcatatcatcaggaaacagcaacaatttgactttctcttttccaatttggatgccctttatttctttctcttgtttgatttctctggctatgacttccagcactatgttgaatagaagtggtgaaagtgggcatccttgtcttattccagttctcagaaggaatgctttcaacttttcctcattcaatatgatgttgacaatactttcttaattttgcaatacactgaatttgctggtgctatttatatacagtgaagcaaaagcttggcagtagaataagaaacaatatagtaataaaacaacttcattactcatgaaaaaacatgcagacaaaaccactactgaccgatttggcgtaattgacatatataaaatacttcactcaacaacagcagaatatacattcttttcaagtatacatagaacatggacagtttaccaagatagaccatattatgggctataaaacaagactcaataaatttaggattcaagtcatctgagatatggtctctcatgacaaaagacttaacaagaaaataaaactgcagatcagtatttctcatgaacattgatgaggaaattctaataaaaacttagcaaactggaagatggcagataggaaacagggctgacatgcagctcccacttggatggacaaaacagcatgtggagattcacaccatgaacttttgcttcggaaaccatcacaggagcatgccaggaaaaccaaaagaaaccacagatcctttgtaagaagcagcagactgctgcaattgccacaagacaggcgaaaacctgtgaattcccaaagtgtgaggggggaaacttgcttctgaacacacatccccactggcgaatctgaaaatccagattacaggagaaagatttaaccttacctgccactgaaatggatttagtgtgaaatataaaagtagaagcagcagtaggaagaaccttctaggcactcccattctccagctcaagcccagggaagccatccctgactatatctcacagacatcctcggggaaggcagtccagattttggaaggggtcacagggtgaaagaaacttccaactgaactttgtaataattttgactggccacaaaccctcttgagcagaatcctggggatgaatgggaaccactgcagaaaggagtgcaggagtcacagccagcagtgtggggagatgaggaggggcatggcctgaaagccatacttgcttcttcagtggagaaacttatagcatggggctgggtctgagtcctacacacaggctgcctgtagataaacttgtcgctcttagcagagcatggcaagagcgagactggcctcaccaactccatgggagtggggtgaaacctattgttactggctttcccccacttccctggtgacagaggcagccatgattccctctggaacataaccccatgcgcccaccacccccctacactccaaagtggcttcagtaagccctgctcaaggagggtctgagctcagacctgcctattcctacccacacctgatagtatttctctacccaccccagtagccaatcacaaaagacgtaaaagcttgggatctttatggccctgcccatcacctgagaaacccaaattcttatcctggccaacacagggcaagcttatatcccccttctactattgcagctggtgctctctcgaaagtgccacctcctggcttgaggccaaccaactcaggacattacagcaactcatgacagaacaaccctgctccaagaaaggagaaaacaaaaaccaattccactgcctgaaacatcctggataaccagtggtcctgagtctgtccacatgacagcttcactgctagcataactagcatttgagaaagccagcacactaagcatatctacaaccaaggactctcacagagcctacttcactcccctgccacctccaccagagcaggtgctggtattcatggttgggagacctgaagatagattgtatcacaggactccttgcagacattccacagcaataacccagagcctggtagccccactgggttaccagacccagaagagaaataacaatcactgcaatttggctctcaggaagtcccatctgtaggggaagagggaaggcaccacatcaagggattactttgtgggacaaaagaatctgaacagcagcccttgagttccagatttttccactgacatagtctacccaaatgagaaggaaccagaaaagaaattctggtaatatgacaaaacaaggttctgtaacacccccaaaagaccacactagctccccagcaatggatccaaaccaagaagaaatctctgaattgccagataaagaattcagaaagttataaagctcctcaaggagataccagagaaaggtgaaaaccaacttaaagaaattttttaaaaaaatacaagatatttatgaaaaatactccagagaaatagatgtcataaagaaagaaatatagcttctggaaatgcaagacacacttagagaaatacaaaatgcacttgaaagtttcaacagtagactagaacaagtagaagaaagaacttcagagcttaaagacaaggctttcaaattaacccaattagacaaaaaaaaaagaattattaaaaaatgaacaaagcctccaagaaatttgggattatgttaaacggccaaacctaaggataactggtattcctgaggaagaagagaaatctaagtttggaaaacatatatgagggaataatcaaggaaaacttccctggcctcactagagatctagacatccaaatataagaagctcaaagggccaggttcagtggctcatacctgtaatcccagcactttgggaggccgaggtgagcggatcacgaggtcaggagattgagaccatcctgactaacacagtgaaaccccgtctctactaaaaatacaaaaacaaaattagccaagtgtggtggtgggcacctgtagtcccagttactcgggaggccgtggtgggagaatggcgtgaacccaggaggtggagcctgcagtgagctgagatggcgccactgcactcctgtctgggcgacagagcaagactccgtctcaaaaaaaaaaaaaaaaaaagaagctcaaagaacatctgggaaattcactggaaaaagatcatcacccaggcacatagtcatcaggttatctaaagtcaaagtcaagacaaaggaaagaaaattaagacctgtaaggcggaaacatcaggcgacctataaaggaaaacgtatcagatttacagcaggtttctcagcagaaacactacaagccagaagggattgggtcctatctttagctcctcaaacaaaataattgccagccaagaattttgtatccagcaaaactagcttcataaatgaaggagagagaaagtgtttttcagacaaacaaatgctaagagaatttgccactaccaagccagcactacaagaaatactaaaaaaagttctaaatcttgaaacaaaacttcaaaatacatgaaaatagaacctccataagcataaatctcacagggcctataaaacaataacacaatgaaaaaaaaaacaccaaagtattcaggcaacaactagcatgttgaataaaacagtacctcatatctcagtactaacattgaatgtaaatggtgtaaatgttccacttaaaagacacagaatggcagaatggataaacattcaccaatcaagtatctgctgtcttgaagagactcacctaatgcataaggattcctataaacttgcagtcaatgggtggaaaaagttatttcatgcaaatggaaaccaaaaatgaggaagagtaactatttttatgtcagagaaaacatactttaaagcaacaacagttaaaaaaagtgggacattataaaatgatttttaaaaaatcagtcctacaggaaaataccccaatcctaaatatatatgcacctaacatggtagctcccaaatttataaaacaattattactagacataagaaatgagatagatggcaacacaataatagtgggggacttcaatactccattgacagcctgagacaggacatcatgacagaaagtcaacaaaaaaaatgcacttaaactataccctagaactaatggacttaacagatatttatagaacattcaatacccaacaactgcagaatatacattcttttcatcagcacatggaacattctccaagatatgccatatgatgggccacaaaacaagtctcaataaacttaagaaaattgaaattatatcaagtaccctctcagaccacagtagaataaaattggaaattaactccaaaaggaaccctcaaaactatacaaatacatggaaattaaataatctgaacttgaatgatctttgggtcaacagtgaaatcaagatggaaataaaaaattatttgaactgactgataatagtgacacaatttatcaaaacctctgggacacagcaaaagtggtgctaagaggaaagttcatggcattaaatgcctacatcgaaaagtctgaaagagcacagatagacagtctaaggtcacacctcaaggaactagagaaacaagaacaaatcaaacccaaacccaacagaagaaaagaaataaaaagatcagaacaggactaaatgaaacggtaacaaaaaaattcaaaagataaacgaaacaaaaagctggttctttgaaaagataaacaaaattgatagaccattaccaagattaaccaagaaaagaagagagaagatccaaatagcctcaattagaaatgaaatttctaattgatattacaaccaataccacagcaacattcaagactgctgtgaacacctttaggtgcacaaactagaaaatcttgaggagatagataaattcctggaaatatacaaccctcctagattaatcaggaagaaatagaaactctgaacagaccaataacaggtagtgagattgaaacaataattttaaaattgccaacaaaaaaagtccaggaccagatgaattcacagctgaattctatcaggcattcaaagaagaattggtaccaatcttactgatactgttccagaagataaagaaagaggtaatcctccttaaatcattttatgaagccagtatcacactaaaaccaaaaccgggaaaggacataaccaaaaaagaaaactatagactaataatcctgatgaacatagttgcaaaaatcctcaacaaaatgctagctaaccatatccaacatcatatcaaaaagataatacaccatgatcaagtgggtttcataccagggatgcagggtttaacatatacaagttaataaatgtgatatgtgacataaacagatttaaaaacaaaaatcatattatcatctcaaaagacacagagaaagcatttgataaaatccagcattcctgtaggattaaaaccctcagcaaaattggcataaaaaggacatacctcaagtaataaaagccatctatgagacacccacagctaacattatactgaacaaggaaaagttgaaatcattccccctgagaactggaacaagacgaggatgcacattttcaccacttttattcaacatagtacttaatgtcctagccagagcaattagacaaaagaaagcaacaaaagccatccaaattgataaagaagaggccaactgtcgctattcactgataatgtgattgtatacctagaaaaccctaaggactcatccaaaaagctcctagatctgatatattcagtaaagtctcaggttacaaaatcaatgtatacaaatcagtagcactgctatacaccaacagtgaccaagctgagaatcatatacagaactcaatcccttttacaacagctgccaaacaaaacaaaacagcaacaacaacaacacacaaacaaaaaaatcccaaaacaacaacaacaaaccttaaaaaaacaaacaaaaaacctaggaatatacttaaccaagaaggtgaaagacctctacaaggaaaactacaaaatactgctgaaagacatcactgatgacacaaacaaatggaaacacatcccatgctcatggatgggtagaatcaatattgtgaaaatgactatactgccaaaagcaatctacagattcaatgcacttcccataaaaataccatcatcattcttcacagaactagaaaaaacaatccaaaaattcatatggagccataaaagagcctgcatagccaaagcaagactaagcaaaaagaagaaatctggaggcatcacattacgtgacttcaagctgtactataaggctatagttaccaaaaaagcatggtactggtataaaataggcatgtagaccaacagaacagaatagagaacccagaaataaagccaaatacttaagagccaactaatcttcaacaaagcaaacaaaaacataaagtaggaaaaggacaccgtattcaacaaatagtgctgggaaaactggcgagccacatgtagaagaatgaagctggatcctcatctctcaccttatacaaagatcaactcaagatggatcaaagacttaaatctaagaggtaaagccgtaaaaattctagaagataacattggaaaaaactcttctagacattggcttaggcaaagaccaagaacccaaaagcaaatgcaacaaaaacaaagataaatagatgggacctaattaaactaaaaagcttctgcacagcagaagaaataaccagcagagtaaacagacagcccacagagtgggaggaaatatttgcaaactgtgtatctgacaaagaactagtatccagaatctacaaagaactcaaatgaatcagcaagaaagaaacaaataatcccatcaaaaagtgggcaaaggacatgaatagagaatcctcaaaagaagatttacaaacagccaacaaacatacgaaaaaatgctcaacaccactaattatcagggaaatgaaaatcaaaaccacaatggaatgtcaccttactcctacaagaatggctataatttaaaaataaaaaaacaacagatcttggcttggatgtggtgaaaagggaagagtttttcaatgctggtgggaatgtaaactagtacaagcactatcgaaaacagcatggagattccttaaagaattaaaagtagaactaccatttgatccagcagtcccactactgggtgtctaccgagtggaaaagaagtcattatatgaaaaatacacttgcacaagcatgtttataacagcacaatttgcaattgcaaaaatatggaaccagactaaatgccatcaacatagagtcttttatctgcacattgggtacagtatacactgcttggatgatgggtgcactaaaatctcagaaatcactaaggaacttttccatgcaaccaaacaccaactgttctcccaaaaatattgaaataaaaaaatttaaaaattagcaaactgagtcaatatacaaaaaggataatcatgactgagtagggtttattctaggaatgcaagtttggtttaacataagaaaatcggtgtaattcaccattttaacaaactaaaaaaaaaccatatgtttatctcataaatatataaaagacatttgaaaatctaacattaattcctcataaagactcttagcactttttcaatttgacaaaggttatttttgaaaaacttacagcaaacgtcacacataatggtgaaggactaattgtttcacccttaaagtcaggaacaagttaagaatgccttttctcaccacttctaatcaaaactgtactgaagatttgaaccagtgcaaaaagataggaaaagaaatgaaaggcatccagattaaaaaggaataattaagactatctttcactcacagacaacatgactacctatgaaaaaaaaatctgatggaatctacaaaacagctactataactaatatataaaaaattaatatgcaaaatttagttgtatctctgtataatagcaatgaacaatcagattgaaataccatctacaacagtacaaatatgttaaatacttatagattaaatctgacgaaagatattcaagacttctatggtgaaaactacaaaacatttctgagagaaattaaagaagacctaaatacatggagagatattctatgttcgtgggatattgaatctttaaatcagttctttgcaaatttggtaaaatcccaatcacattttcagcaggaatttttatagaagtttaattaattgattccaaaatttatatgaaaatggagataacctaaaacagccagagaaactttgaaaaataacaaagctgtaggataacactaactgatttcaagattaattattgtaagattcttttttttctctctctctattgcccaggctggagtgcagtggcatgatctcagctcagtgcaacctccgcctcccaggttcaagtgatactcatgcctcagccttccaagtagctggtacaggtgtgaaccaccacacctagatttttttgtatgtatttttagtagagatgggggtttgctatgttggccaggctggtcttgaactttcagcctcaagtgatccgcccaccttggcctcccaaagtactggaattacatgtgtgagccattatgcctggcctaattattataagattattgtaatgaagatagtgtaatataggtgctaaggtcaacagtaggttaatggaatagaattaaacaactcagaaataggctcaacatatagacaactgatttttgacaaaggcacatggcaatgtagtggagaaagaatagtcttttctctctgaaacaattttatatccatatacaaacttttaaaaaactcaatccatacctcacaccatatacaaaaattagctgcaaatgaatcatagacttgaatgtagaattcaaaccaatataacctctagagaaaacataacataggagaaaatgtttgtgaccttgggttaggtaagatttcttagaaacaacattaaaagcacaatacataaaagaagaaattgaccaattagatgtcatcaaaatttaaaaccttttctttttgaaaagtactttaagagaatgaaaagacaagctacagactgggagaaaatatttgcaaattacatatctgacagaggacttgtttctacaacatattttttaaaactctcaaaacacaataatacaaagtaaaaaagctaattaaaaataggcaaaagatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccaccatggcacatgtatacatatgtaactaatctgcacaatgtgcacatgtaccctaaaacttaaagtatattaaaaaaaatagattaaaacaaatatcaaatgaaaaaaaaaatgtggccaaatactgttattgtggagaagcctgaatctggcattaaattacaccaagtggacctttgaaaaaaaaaaaaaaaaaaagatttgaactttccaaaataagacatcacatgaaatgacactcaatctcattagtcattagagaaatgcaaattaaaaccacaatcaaatacaactacacgtctattagaatgaccaaaactagaaagattaagcattccaagtgttggtgaggatgtgtaagtgcatccacaccaggatactattcagcaacaaagaggactaaaccactgatgcgtgcaacagcatggatgaatttcaaagtaaacatgctgagtgaaagaagccagatcaaaaaagaataaatactatttgatttcagtaatataaaattacagaaagtacaaactataatgacaaaaatcatatcagtatttgcctgtggttggcagagtagaaagggtgggagtgagaggcacatgggaacatggaagcttggggggcgatgtgtcatgttcattatcttgatcacagtgatatttttatgggtgtacacataaatcaaagcttttcaaaaaggatacttcaaatatatgtagcttattgtatgtcaattctattaggttggcacaaattacttttggtgcacaaataattgcagtttttgccattactttaatgcaattacttttgatataattacttttgcaccatcataatacctcaatacagtagttttttaaagaaaaaacttagtgcacctttcaagttaaacagaagaataggaataatggagtaataactaacatctccagagaatcaggaggcacctgcactatgcaaagcatctgtttctctatctgtctgtctttattttatcctcataacagccttatgaaatagatgctcttctcatccccttttcacagaggaggaaactgaggttacataattttcccaatgccacaaggccagtaagctgtagagccagggtctgaaccctggcagtttgctccagagcttggactctaaaccactgtaggtgtcgattaattttcatgttttgctgtcatcatttccagggaaatattgccagagaagctgcatccgaggaagctttaacagcagtccaaagtggaaatgttagtgaaccggaggtagggtttgacgagggcctttgcgtgccttctagccaccccatgggtttcacacctttctacctcagaggatttgtgccctttcctcctcccaatctccctgcctgtctccaccagttcacacctaccacctcctttaggacttgctgcaccaagcctcacctccttacctcttcccctgctgtgattaatcttttcttctgtatcctctgcatggcctggactgtaagttgcattttctacataaattatttgcaaaaattttagtaaatacagcttatctctccttcccattgcccaaaaagaaaacattttggagaggcaaaacatttgtaagagttttctctgtatcatatgcacatacatacacttctgtccgtgtctaggtgtgttattaatatatgtcatttacattcatctcaggattttggaagtcctccctcctgttacaaattcaggccaaggggcatagcatcttccaccagtgcagtggctatccctggggacttcaccatcctttgttggtttcccttcaccccacccatgcctttgcaggtggtccgttgaccactccattggagtgtcccttctgttccctgccagaagcctggtggttcaggaagagattggcagggtcctgtgaaccctgctcaggatctcagacttttcctaagaagcagaggagggtgttgtaggcttttgagtgggaggttggtacaataaagcattttcattccctgatgatgagcatagtcctggaatttcagtagtttcccaagagcctcttggtgatggatggactgactcagcaacagaagcctagagaacccttgagaagggaatggaacatggggcttggtcatatccatagaggcactgggacagattcactgaacactaagcccagacactgaagttctgccagaggaccaggttctccaacctgtctcctctccagattctgaccagtgaaggagtctacccagaagtcagctagggattgaagtacccctttctcatggctaacactgaaccagagaacaaagcttggaccgagaacacaaatgggcttcccatttctccttactgaattaagtgcccccatgtggttgtaggcaggcctcacctgtggggcagggtctccccactcccagctaattgcatggaggggaggagaaaacacacaacctgggagcaggatgtgctgtcagaaagagaaagcacgatgtaggcacagggtccagtttttgaatctcacattagcatatgctgttggagccccacccatatcctctagcacgtattcttcctgagcactctgtgaagacaaggactgcaagtgcctggtctttcttccatgccatgtttgcagcagggcaggctgtttggggaagcagccatcagccagtgactgaagggattggagaatcaatttgccagctccttcacctcttaggtgggaccactctgcactgtgttctctaggctttcggagatccaggtggggttgattcaccatagtcacccacatcttgaaacaccccatgctggcagcctccccttcctcacctcgcatgccactcctcttacagaatttcctggctttgctccccaagtaaactactgactctcagacacttaattcagggtgtgtttctggggcaacccacactaggagactcactgaccagttggtcactccctgtgccctagggaggaaagtcagggtgtagaagaggacagcagttttctctctaatattcctaagagggtagccgttccgttatgaacccaagcaaggatgtggttggagggacaggatgcctgcccccaccactgcatcaaacatggttggaaccccagaagacacctgagtcaacaaggtggattgatctcctatttttatctcctctccctaccggagaaaaacactgaaatgacagtaaagggataaaaagggcacaaatccacaaaggtgagatggagaggagatattggaagataagcactttaaaaatattgagaataaaaaaatcaatggaagagtttacattggcttagcacagctgaggaaggtgaaactcaggcatctttatgggaggagagactggtgaaaagtgtgtgaattctgcacaaggctgaagactggaggtttgcagaaggtggggtgaggaattgggctgaaaagctgggcagtctgatgtggagtgactggaacactggatccctgcagactccagttaggttgtcagccacaccccaagtgagaggataaaatgactattctctagagaaattgaacagaggctgctgctaattcagatttagcctgtgctgcatgggcgttgtaacggtgaggaatagagaacagacaagtaagtggaattctccacttcgaacagaggaatccacagcccctcctccagccacgccctctcaatgccaggagccaggccttgtattaagtttctattgctgctgttacacattaccccaaacttggtggcttataacaacacaaatttattattgtgcagttctggaggttagcattccaaaatgggtttgagtgtgctgagcttcaggtgtagacaggggcgtgttccttctggagactctaggggagaatctgttcccttgcctttgccagcttctagaagccacttgcattccatgccctgtgtccccttcctccatcttcagagctggcagcgcagcatcttcctccctctgactcagacctgctgcctccctcttagcagatccctatgattcctctgggcccacccggatcatctaggagcatctcctcatcatagaacccttcatgtgatgacatctgcgaaatccctgtgccctgaaagataacatatttacaggttgcagggactagtacctgtaacatctttggggaccacagtcctcaatacagaatattggagaacttaagtcccaaaaaactgacaggcccaaggaaaatgccttcagatgatgtcactgaaggtggccacccagtaataatgccagatctctgcctgatcaccccatgaagtgccccagttagccagtgtctgtggagttttgcctctcaagcatgttgcttttaggaagctaaaaatgtgctctaacgatatgagggcctaaatgatgaacaaaaaagacaaagaaaagacctggaacttacaaaataggagctgcaatacaggcaggacggcagagctgcaagtccagattagaggggagaaaaaaggaagctcatatattatctcaaacgcctgatcatttggaaaataatagtgaccaacacttggcaaatctgataaaggaagtgaaaaacttagcaaaccaagtgaataaaaactaagcacacagatgaaaacattgtcatattacactactttgctcagcaacaacagaacttacacattcatattagtgtaaatacttacggatttaaccctgaattgtgatgtaattttcctgggggataagatgtggggaagagggtagtatgagagggattaatctagccactgcatcaatattgaataggaaattctaaaaactaatgaatttagaaacagcaccataagcatattgttcagaaatatagaggtaaatatatacccaaataaatgaaaacgttgaaagttctgttcaatgggggtagagacttggaaggacagagaactactgattttcttaataaatgtttggtgctaatattattttaaatttttccatatgcatgtattactttgatttaaaagaactccatgagggatctcaaagggaatcatcttctgagttatgacacctttttaggtgcacctaaaccaagacagaacagcctcagccctgactttccaggtggctgtggtccactggaccttcctgggctccacctccccacgatagttactcccaggaccacctgagcagtcccaagattcaaaaattcttgtatcacaatgaaaacagctttggggacagagggattttgcttctggagttattataatatgtatataatactatcacgctctaatctctaccctgggatgcagttaaaatatggaccctatgtcaaaggccaactgaaactatttgtcttgtgtgagaccttcatgtgagaactagttttttttttctttattattattattttttaaattttattttacgttctgggatatgtgtgcagaacgtgcaggtttgttacctaggtatacatgtgccatggtggtttgcggcacctatcaacccgtcatctaggttttaagccctgcctgcattaggtgtttgtcttaatgctctccctccctttccccccgacccccctgacaggccccagtgtgtgttgttcccctccctgtgtccatgtgttctcattggagaactagtttttaaaaacattttatgaattttgagtatctcattaagaacctctccttaaaaccaggcctggcccaggatgagttgtttcgggtgacagtcacacctgtcctcagaacggtgtcatgtagagataatgcagccaccagcccactaaattacagggcattgacaggattctcattggctcctcctgtctccttgctctaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggcaagtactgaccttctggctggctgtcacagtgagaatcttttctggcattggtggcccaacattttaactttacagagccagtaatttccaaacctggcccacatcctaatctcctggggaattttttaaaacacaaattcctaagccccatccagagattctagtccatcaaattttaacaaggcctacagaagtgggctagaaatctggcctacctatgtaacaattgggaatctggaaaattatcacttacataaccacatgctgctcccattctgtaaagtttgcatctcttggataatttgaatttgggttactggttgtctagagtctttggttgcaagtaacaggaaatccaaccaaactggctttgaaaaaaaaattgaataattgcctcacataactaaggataactctggtggtgagactgttttaaatatggcttgatctaggatttatttagattaccaaatcaaggaccaagtttctctctctacctcttcaccctgtgtgttagtctgttttcatgctggtgataaagacatactcaagactgggtgatttataaagaaaaagaggtttaatgaactcacagttccacgtggctggggaggcctcacgatcataggggaagatgaaagccatgtcttacatggcggcaggcaaagagacaatgagagccaagtgaaaggggtttccccttataaaaccatgagatttcatgagacttattcaataccacaagaacagtatgggggaaccacccccatgattcagttatctcccacagggtccctcccacaacacgtgggaattatgggagctacaattcaagatgagatttgggtggggacacagccaaaccatatcaccctacttccctgctgttggaccccttctcagaggagtgccccatcctgggcctaagaccactgacattctcaggtctcaggtctgcatcagaatccagtgagaaggacttgccgggatgggcccagctttttccagccaaagtctcatgaggcctgacaggactgtgtgttcattcctgagccaacggctgtgacaagcccatgccacaaggagatggagaagatgggctccatcccttagctcatgctccatgccaaatctgcagctggagtctcagctacatggaatatctgagcaggggataagttgacacccaacagcaatccagggctacagcaaagaggaggcatgcatggtgctgggctttgtctaaagccccggcgcccaccagacctcacagccacccaccctgcccctccagaacacccacatgttcagtgcttgctgttctcctgtggtctggacactggacgctgccctcagtgcctggattccacatctccttagcacccacccctcatctgttcacagaaccatctcgaagaggaaataattggcccattttgatggagtggaaggctctagggtgtcttttagatgagcaagaatagctggacagttcctcttcagaggatctgtttaaacatgttcccagtctcccagcatcccctgttgtactttaacttttttcatctcgagtttttagcttctatggagatctgggacattgaaaagaaattctttttattctaattatgttgtagacatataaaaccttgtaaagcctttctatatttgttgctttatatttcttttatctgtacatttaaatatgattgtgcttagagtatactttttgaattttgaaacaggaatttgatgacccagtgtggtttgcctatgaatgtacatctacagctagtcagaaaatcttcaacagataaaagggaaacagatcagaagcaacctataatatttcccacctctcctcttaactcttccaaaacagaagggaaggatcggaggcacagaatgaccaattttgtgttggcttttcaaatgcacagagattgttaattgatgtgaaagtgccttcagttctgcagaatactttattactgacatacgaagcttgcgacttatgcaccccattagtgttcacctagacacacattctgactagtggttggctaatcgctgcccgaggggagggagctgtaaatctctgtaaacgtccactgatgttgcatttgcttgcagggcactgacagtgcttactgtcttgtttacaggtcgctggattttatgaattttgttttcagtcttttttctgtaagtacatgctgaattttgagaactgattttgtaagcttagagaacttatagaaaagtaaaatgccataaatttattatgctgtgaatgttgaggtttgtgttcggagaataaggtcaaatggcatgtcatgagctcataaaaatacaaaatattgtcattttcaagaatttttaagtcatgctattttagcagttctctttaaatgcaaaatttctgttacacatagctttaccagtgttttatcagaatcaaatcattcatagtaatacatgaaaatgttggaaattaaagtgaatgacactgttattttatagattatgttggctccaagtattctgaaaccatcatattgcttttctgagggtagcaaagtagggacttgttgattttgaggttggcatttctttccctactagttcctcaggcctgacttcatgcctggctggtagagggggctcaacccacattgatgaatgggcctgcaggctaatatccaagtacaaataagattctccatgccagggtgtcccgggcttctgcctacattcttgtctcattattttctagggatgaagatctaaccaaactcttacacttctttattgaaggaaagaaaatgaggaaggaagttttgagggacaaaatgcatttttataaagacaggcctgttaattaagtaaagtcaacaactgtacttctccagttgactgatttcaagaaaagtatctattgctttacttttcctggatactgtttctaatgaggcaaaaacaagtatagtttaattattttgtcttacaactatgtgatgttaggttttatttcctcatttgttattataatgaagctttataataaggcaatatgttctccatcataatttttaaaaattacttattaaggcactttccaaacaatgtagattaccctgaacataggatttacaaagtcggtttccctcaaaaactcctcaaataaatttcactaattttaattattttctactttaacgtccatgtaaacgtaaatatttaacattataaaagtaatgctggctttaaaaaggtaaaagagctgtttacatttcaattctatttgacttcggaacatggacgacaggaaaaaaaataaccttggttgcttcatccttaatccttcaaatccaagatgaagcaactcattatagttagtctctccctcccagaggaagcccacccagacttggcacccagtccttattttcaacttgagtatttcagcaacttgactctcaggttccccaaaaggagtcctactaatttgctaaaaagaaggaaggtaaggtcagacaatggttcactcctttgagttgcacaaatgtccccagggttttggattagcacaagtaatgccttcacagggttcaagaggaggcgagatcccaaagggacaaattagcttcgggaagagcaggctgcttctgcagggacctggcagaggatcaggcagctgcgtgaagctcagatagcctagagcagcactgtccagacatggagtgtgagccacattggtaattctgaatgttccaagagccacaaggaaaaaaaagaaaaaggaacagatgaagtttatatgataatatcttttatttaacttaatatgcccaatcctttttttaaagagatagggtctcactttgttgcatgcaatgtcacaatcatagctcactgctgcctcaaactccttggcccaagggatcttcctgcctcagcctcccaaatagctgggacatgccaccatgcccagctaattaaaaaaaaaattgtagaaatggggtcttgtcatcttgcccaggctgggctcgaactcctgggctcaagtgatcctcccatctcggcctcccaaagtactgggattacagaagtgagaactgtgcctgggcaaatttaatcatttcaacatataatcaatatgaaaacttattaatgagctatttacaatctttttctcgtactgagtctttgaaatctaatatatatttcacatttatagtacatcacaatacaagtactaaattttcatcagaaatagttcatctgtatttgtatgttataaaatttacagttggatacgtagattcacataatccaagcacacataaaacttttccagtaatggaattaagtatccatttttttaatttaaatgaatttaaatgaaataaaatttaaaatttagttcctccgccaatactagccacatttcattgtctactgtactgacagggcaggcctagaatagaatgaatggcagccctcaggacatgcaagacctcttatgtctgctaactaaacccactgcctgggtttaatcatgctcatggatctgttcacccaactgggatcacgtcatgataaaatacgtacacattggtttatggataatcacagaattttagagccaaaaaatgcctgaagtatcatcctcccatctcgcaagaggaagggaccactggtgtaaggtcacttagtaagcaaggggcctttgctaggacaccatgctacctcattgacttggtgacacaagtgaacttacctgtatgaattgtcttggtttaaaaactacttccacagaagagttatgctgaatgactgccattgtttataagattcatttattcaggtttcagtgagaaacaaagataccttttccctgctcttgtagttgcttatttcctgaattttatgtgattattttccaaattataggaaaggtaatttgaatatcctctccttaatcaacacattttgcttctatttttcttggtgttttttagaggaatttgttttttgattaattttttttattctttctctgtgtcctggtttttgatgatgttaggataagaacttctgtgtaatttctctgccccatctcacccccgagttcttcctcatccagaacttcgtgaaaatggtccctttcaacacctgcaccctcgagcaggacctctacgtcttccaccgggctggattgctcaagtgagtagacacatgtttggccacacaacaatccatgaaattacagaagagaagggaacaaggaactccctgctattataatttaataatttattttaaatatcatcttttattagaagaggtcttgagtaagtgattttaactaatacatttagagaaagaatggcacttgagaagagatttgtcctgtcagatattaaaacataatatagctccacaataatcaagacaatgccatgttgacagattctgtaggcagaacaatgtaacacaagaaacagatccagtatagtaggaactcagattgtgcagatctttgtatgtgagtgtgtgtatataatacattcacgacaaagtgtgtgtcacaacagtgggaaaaggaaggattcttctgtaaatcatgagacaaaatggaggtagaaactttttttatactctatcataaaatagattctcaggtgattaaagagttaaatgtaagtattgaaaacataaaaattagaaaatatatttacagtgctaagttctgtgccaagttctgggaacacaatggtgaacaacatgtagacatggtccctgccttttcaaggcttatggacacacagagtgtaaaactgcaactgtgatgggagtaaccagtcctgggcatgtggtactgagcatggaacattgggagagttggcccagccagaggaagctttcttgagaaagtaatacggagtgctggatgaggaaagtgagtgaagattgacctttatcctgtctcagaatgggaaagttctttttaaaacatgaaagaaaaagattaaggtgtcttatactataccaagttttttgaaccacctgattttattaaaatgtaactgaccaacagaaggatgttttaaacaaatatggcagacaaaaggtggatgtatttaatatataaagagctttaatgaatcaataaaaaaaatcacttaatacctaaatagaaaaattaataaaaggcatgaccagactgtttctacaggaaaaaacaaaaaacaaaaatcagtgtatatttaataccttctatcttatttttacaaaatgttctgaggctcatcaaactgcacccttgaaatgagtgcatttcattgtatgtaaattagacctcaataaagttgatgcacaatcttctgatgaaaagtttggtggaggagtgtcagagagctcactctataattgctgtgttaaccttttgagtgaaactttgagaaacatcctagatgttcacttcataattagggactggttaaatgaattttagcaaatgaatttagtacattatgatgacgacttgaagaaataaaaccagatttctatatcctatgtggaaagatagctaggatggtgagaaaagcagtcaaacaataatagtacaagtactaatagtaaggataattaacatttattgagggtttatagtgtgccaggcgctttcttaataatcactttccatgtgtcaacactcacagtgacctaattagttaggtatcattattatcctcatttcacaggtaagaaaactgagacacagagaggttgagtaactagtccacagtccacacagcagaaagtggcagaactgaaatcggaacccaggctgttagcttacagagccaactcatgaccaccccacatattgtttctcgacatggtgtggtcagtgtaatcccatttgattgttgtgaagtgttcacaggtagcagtcagcactaatactaaactgttgtatcagagtgacccctaaacacaactgccttgagccagttctgtctctgtcctgcagtagtccagacaagagcacgtggtctaaggagaataccagctttttctccatgaagttgtccaggaaccgaagttccttctcttattgcccctccattccatagagcaagggttacctaacatatccagagagaagcatgaggtgtgtgaatttggatggaaaggaaagctacatctttattccactaacctgtaagtgaagtttaatgtgtccttccattgtgactggagctagcaggtctcatagtgttagcagaaaccatgacttcatagccagtagaaatgacagatattttcgttcatgtttttgttgttgccgatgtctcaaaaatatcacataatatttaccctactttgaaatttcagtaattttattcttgaccataatttattatgtaatgcattaacaaagaggcacaggcattactgtaacacatttttaaaaacattttgctaactgtgtttcaatataatttataatcctttgtgttttatttaatgaatgtagaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttt

SEQ ID NO: 2009 - DNA, 308190 bp, Homo sapiens
caccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatataccttcatgtttaccttcttatttcccagcatttaatcttgtattccacttctttctgattttattcttctcagaatataccatctcctagttctttctacaagattctttgaattctttcagtctttgtatgaaattgtctttattttatcttcattttaaagtgattgtttaggtttatcagtctaggttaatggttattttttccttttatatttttaaaacactattctagtagttagaaaactatgggccgtagactaaattcagcccattgactattttgtatggactgtgaatgagctagggatatatatatatatatatacacacacacatacatacacatatacacacacacattttacattaaactttatatgtagtttacattttaaacattttttaaaaattacatggcacatgaaaattatacataagtcaactttcagtgtatgtaagtaaaattttgtgggaatacattcatgctcatttgtgccgatattgtctctggttgttactgtgctacaatggcagagttgactagttgtgtagacaacatgtggctcataaagcttaatgtatttattctctggccttttacagaagtttgctaacccccgtgctactggcttctaatgttgctcatgagaaatattctgtcagtctaattattttttatagacagtctgtcttttgtcaggttcctttaaagttttctgtttgtctttagggttttgtagttttactatatatttggagtttatttgtattttttgctctgaactgaaggttcatgtctttcatccatgctaaaagtaattagccattattttcaaatgtttcatttattccttttggaattcccataagacagatgtttttcattctgtcttacatgtgtctttactgaattctgtattttctgtttctatgtgcttctttctagataatttgttcataagtatcttccagtttattttctttattcttctgtttttaacccatcctcttagtttaaattttaataaccacgtatttcattttttaagtttctgttcttttttaaataatgacctgttctcttctcatgacttttgtttctctttctatatttctttattataaacatacttagtttgtagtctgtttcagagtctatcatctaaagttcttggtgactcccataatacacagattgtgtggactagaatgccatacccactttagtctagaatttggacttctcagcagtatttttgctttattttctacctagagctttgtgtagagaaagcttgtcactttcttgggctggtgagtttaatttttctagccccctcacttaccgaggggcccatccaaagtcccaggtagatgcatggtttaatttttaattctctgtttggagtgaggtccattctatccccaaaacctgtgtcagatcggctcacatcattgccacctggttggagaatttccctcgctcgctttctttcttcttttcttgttttctttttaccaaagtcagttatctaattaattatacttccttattttattcagaatttttatatacttgtagcattagtttatgatatgtttcacaaacaagatgtctcattccaattttgctttcaatttaaaaccagaacaaggaatgacaatatttatggttagcttcgataggagtctagacattattaatttctccttcattgttttccctgttttgagctcactggctagtatataataaaatggctttccctatgaaggaaagaagggagggaaagagagaagagagacttacagaaattgagacaatgagagagaaattgaaatcattttgtgacctactgtttttgtcaacagcatttcccaaagtgtccttctggaacgttaggttctccactgttgccgtcattagagattctcttcccaaagagtgtcggaaaggctgggttatacaaagaaaacaagttgctttattatggaacctctcaaagatgttaatgggcctggtggcccttcaggaagcctattgcgagcatttcctacacttaaccacagaacttttttggtctcaaaatatgtctcaagactgctgaccttcagggctccagtttggagaactctattaagaacataggcagcagctgtcagtatttccccagtaactcttcaccacatgccatcgtggccgattaaatataagaggaccctgaatccgtaaataattcctttcaatgtttttccaattctattgttagaattttttaaagcagctttgttggaaacaaagaatatagttgcagaaacttctaaacaggccagttctcagaaacttcattctcctatggaggaacgtcagctggtttgcagtgacagttgtcacagactacacccaggggaaaacgtgtcacaccagtattctcacaccatgttcactctgaccacatggaaattgaattagtgttcagttttgtgtgtattataaccaaactggcttatcatatcagattaatagtggacttttttctctcttttggggacaggataaaaaatgtcagtactcacttctccaagaggaaaggtagaagttgttcattgccgaagaacagaatcacaggatgtttattgtatcaaaagccttattagaaaatttacctgcaagctgtttgggaagctaaatatcatctatcttctgtaagtagataactaagttcaagaatgttcatcaattttggttgggtgcagtagctcacacctgtaatctcagcactttgagaggccaaggcaggcagatcacctgaggccaggagttcaagaccagcctggccgacatggcaaaacctcatctctactaaaaatacaataatcagctgggcgtggtggcgcatgcctgtaatcccagctgctcgggaggctgaggcatgagaatcgcttgaacacaagaggcagaggctgcagtgagccaagacacgccactgcactccagcctggatgacagagcggacccctgtctcaattaaaaaaaaaaaaaaaaaaaaagaaggttcctcaattttatgacatgccagaaaaggatcctacctttttgtctttatggggcttattgtgagcaaatgggtagcttactgcacagtgaaaaaattgtagcaagaaatctctgggaacaacaaattcctatttcctataataatatgcaaatcaaaaaggtttctcatgggctttggattcaaacaaacttggttcaaatctcagctgcctcactcactagtggagtcacttaaaacaagttaataatattagctgccagattttgagaaattagtttatgtcaggctctgtgctatgccaacattatgttattgttctgatacttctctgaggtggccactatcatgtccatctcacagatgagaatgggaggctggcgcagggtcaaacagtacgttggaaacctggatttgttcacagccgctgctgttaaagtgttcttctgaactttaaagtatgcatagatttgtttcttaaaagatcttttttctctctgttttgtttgtttatagaccttctgtgggtgccaaaatataaatatccttgaatctgttcttcattatttaattaatttatttatttttgagacagaggtttgctctattgcccagatctggggtgcagtggtgcgatctcggctcactgcaatctccgcctcctgggttcaagagattctcctgcctcagcctccagagtagctgggactacaggtgcatgccaccatgcctagctgtttttgtttgtttgtttgttttttagtagagactaggtttcatcatgttggccaggctggtctcgaactcctggcctcaagtgatctgcctgccttggcctcccaaagtctttggattacaggcataagctactgtgctcgaccctgttccgcattatttttattgaaaatattaaatatcctagtattttggatttcataaagcttcatatcaaatacaattgaaatgtttaagctaaggccagcctaagacattaaagtttgtagtttctaattacccccctgatgaatgtaatataaattggcacaattttactagagggcagtagggcaatagttataaaatgcctaaaaaatagatataccaatgaaatgattttattttttggcattatggtggactcagtaccttaaagatgtccattggatggaaacaactaaaatactgatacacacaaaagctaaggactgtgtagggaacattatcaaattgaaatcagaaacttcattagataaacaggaaccaatgctagcttcatccttgaggatttttgccacattctattaatagcaacttcatatttctgttttgacagctttgcaaagaatggaagataactactccctccacctaaggaggaaagcatgtgacccctttgtataaaattgggatgttcattgtagggatgaacaagatataaacccactaaataaaaatggacagtgagggctcactcagccttagcatggaatagagggggataaagtctcttctgagaattcataagcacacactgatttgagatccatgttaattatttatgtggtccaaaaaatgttgaagtaaagaatttaattaaaaatagtcacaggccagtagtgtgtccaggaaactggctgacataaatgcaaatcaagtgtgaagggatgcagcttcagctcagactccaaataataaccccagataaagttgcaaggtatatgagctcacagtcaaaaatcgtaaacacacaaggaaacatgtatcattagaatcaacaagagaaattatataggataatcaactcccaaagacttcagatataaaattaaacaatgaatataaaataactatgtttactatgtctaaaataaaaaaggtaggtttaaaaagatgattaaagaaggccggacacagtggctcatgcctgtaatcccagcactttgggaggccgaggcaggaggatcacgaggtcaagagattaagaccatcctggccaacaggtgaaaccccatctctactaaaaatacaaaaattgactgaatgtggtagcgcgcactctgtagtcccactactcgggaggctgaggcaggagaatcgcttgaacccaggaggcggaggttgcaatgagccaagattgcactactgcacactccagcctggtgacagagagactctgtctcaaaaaaaaaaaaaaaaaaaaaaaaaaggattaaagactaaaaaaatctgggatgctgaggtgggcagatcatccgaggtcaggagtttgagaccaacctggcctatatggcaaaaccccatctctaccaaaaatacaaaaaattagccaggagtggtggcacacacatgtagtcccagctactcaggaggctgaggcaggagaatcgcttgaacctgggaggtggaggttgcagtgagccgagatcgcaccactgcgctccagcctgggtgacacagtgagactccatctaaaaaataaaataaaataaaaaataaaaaattataaaaatgaataatcatgtttaaacaaaagtgaaatagaccatctagaacttaaaatgtaattgaaattaaaagctctgtagatgaattaaacatccttcatagacacagttgaagacagaagtaatgagctggaggatcaataccagtaaattacccagagctcaacacaaagagaaaaaatatgaatgaagcatgagacctagtctagttagacttttagaagaagataataggaagccaaagggtaatatttgaagagagaatggctgagagtttttcagaattgttggaaagcactacttcttacatctggaaaactcagtggatcccaaaggggataaatacacagagaaatcccaactgtacccatcataatgaaacagcaaaacactccagttaaaaagatctgaaaaataacagagggggaaaaaaaaaaaaccaagttacctgcaaagaactaaagattagactaatagatttcttaggagccacaatagtagtcagaagatagtagaatatcttcaatagtggagagaaaaataacatcaatttagaattgtgacattgtttcacccagtgaaacaattcctaggggacctgggagaaaataaatgcattttctgacaaacaaaaacctaagtcatttgccaataaactctgaatggaggaaattcctcagaatatgtttttggaggaacagagaatacctcagctggaaagctcaaaacacaagaaggaatgtcaacaaaaatatggaaaatatataggtaaatctaagaaaaagtatgacttgcataaaacaataatattgataatgactgatttgtgaggtataaaccatatgttaaaactaagattcaggacaaaaacattatataaattgggaggagcatgattagaatgaaagaatccttcaggttttatttaagatggagggtgtggtaagtggtgtgcaaacaggctcccctggctccaatgagccacacatcctgtcacttacgcctttgtgtagtctgttctcacaaagaatcatggctcgccttatgcagccaatggaaagcagcagaagtgagactctatttgacttcaagtctaagtcataagaagtcttgcaacttccactgggtctccggaagtgctccttctcagaacccagtgccacactgatgaaagctccagtcacatgtttccctgtgggtgcttcatttgacagcctctgctgagctccccgctagcaactgccaccagctgccaaccatgcaagtaagccgtcttagacactgagtcttcagatggctttagccactgctgccatttgatagcctgagataccgtgcaaaaactgcttagttcaacccaggcagcccacagaaccatgagagataataattgctacttaaagccactgaggtttggggtggtttattacacatcagttgataactggaacagataataaagactgttaggaatatatattaacatggttaagatcatcattaaaagaacaggtgtagagatgataacttctgatctatagagggaaaaatggaatgagaaatttaaaatgaaccctgaatctaaaagaggacaagacaggaggaggaaaaaagaaacaaaaagcatagaatgtattaaaattacagaataagaaaataaattttactatatcagcaatcataataaatgcatctggacaaaaatcttccattaaaagattaagaatggcagattggctcaaaacaaaacagtcatattctatttgtgagacatacctcatatataaagtcacagaaatatttaaagtcaaagtatcaggaaaaaagatatgccacccaaaatctcacccaaaataagggctagtattgctatatcaacagcagacagtgtatagttcaggacaaaaagctccctacagataaagagggtcactatataatgataaaactgttgttgggagagctatgacagctttaaacttatatgcttctaacaacacagttctaaaatagataaaagtgaaaatcacaggtagagcactggagactctcccgcctccctgtgttccccatgcctttttgtgccattctccctgctgtagtccccatgttttctatctttgttgagcctgtgattcccctgacagaatgtaatggaagtggggctgtcctggtcccaggcccaagcgttaagatggcctggcagcagggctggcccaggagaggcacgcagggtatcctgggtactcactcccagctagggcccctgcatgaacctgagagtgaacacctccttccatttttgaaccctgggtccctctggcctcaccctagttcgagcctttgctgggagctttcagttttgtgatcttgggagccttgcactaccatgtaaaaagtctggctactctactggacataccacccagagaggccatatcgtaagagagaagtgtgtgcctacatggaggagaattgaggagcccagcctccagcaagaaggaaggccccatgtcactcttccaggcacaccccagcccctttgggccaccctcactgaggcacaagacacatgagggaaaaaaaccgtcttggaggttcttgccccaacagatacccctactgtaccctgtctgaatctctcacccatagaatcatgagcaaataaaacagagtagccactaaatttgggataatctgttatgcagaaatagttgaacaaaatagcaggtcttagagggaacttataaccttaaatgcttataacagaagagaagaaaggcctgaaataaagttcagagtttacctctaagagcaagaacagtcgaatcaactcaaggaaaacagaaaataaaggacaagagcgcatattaatgaaacaggaaacaagcatctggtagaggataaacaaagccaaaagtttgttctttaaaaagcctaaagaaaaaaaaaatctgacaagattaatcaggaaaaaaagaaaaactttcaaagtaatgtgaaaaggacataatcacaaatgttgctgaggttaagcaggtaataaaagggcattatagatccacaatcctttaactaaatccctcgtgactagttgtgtttcagaaagcagaatttaaaaaattagtttcttccattgatgaaatattattgaattccacccacaagggctggagagattttccataattacacacgttaggatatctgtggtaaaaatgtaagaatattttatatatgggatcaagactgtagagtaacctcctgtcacttcaagtccaattttgctgcttccagtttttagggctttatggatttaaagggattggggacctgtataaaaaaactgcatgccaataaatttgaaaatatggggtcccagaaaagtttcttaaaatcaacttaagaaatgatagaaacccattaaattgaatcgttagttttaaatcctcccgccaataaaatggtcggcacaagtgcctttataagcagtcctaccaaagattcagggattgggtatgtcccaaataaatacaagttcttggaagcagaaagatggagaatactttttagctcactttatgaggctagcataatgttgatatcaaaataagacaaagacagtacaagaaaggaaagttaacggccaatctcacatagaaagagaaatgaaattaatgttcatgccttgctcatgaacatggatgtaaaaattcaaaaaaaaattggaaaggaatctaatgatgaactaaaaagatatgattatgattaactgatcatggtattcatgattggcttaatactagaaaattgattagtctaattcatcaaattaacaaaggagaaaatctaataatctcaataaacagagacaaaatcattcgataaaatgcaatattcttagtaataattcttaacctaataagaatataagatgactctcatatgtatacaaacctttaacaaacaccatatgtaatgataaaatattaaaagaatccctgtatagtaaatgaggatgcctgttgtcatgagatcctagctattgcagtaagggaaagaaaaagcaataaaatgtactaggatttgaaaggaagaaacgaaattgtcattttttgcaggtaatatattctctacttagcaaatggaaaggaatgtgaattagaatgaatatagaagttcaaaattgctggctatgaagtcattgaataaaaacccattgcatttttatatactaacaatgaacagaaaacatttttctatttacacccatgccaaagaatataaagtacctagtataaaactgacaaaataactctaagctcattatggggtaaattgtcaactattgaaagacattaaggaaagcctaaatagagtaaccgccccccaccccgccttatctgaggggaatatattccaagacccccagtggatgtctgaaactgaggatggtaccacatccgattgttatcagtcagaacacatttttgttcatgccttccacccacaaatgtaacggcttttccatcgtaactaagcatttgctatgcactgtgaccataacttttgtagtttgaagtgcgacaggagaactaacaggaatttctttttccattttcacaatttcacggattaaagatttcttcttaccctagatcttagcaagctcagcatacaatttattttttcctcattaagttgagaattttcacctttttgtgtaaaggaagccttttacggcttcttttcagcatgtctgaattaccagcgtcactactcttgcactttgaaccaaagcactgtgatgcagtgacagtcgatctggtaacagaaggcagttaccagatctaatactaagtgactcatgggcagcagcatctacagtgtggatctgctggacagttcctgggcaggacgggctgggatggcacgtaatttcatcttgctactcagaatggcatgcaattataaatttatagattgtttatttctggaattttccatttagtattttctaactgctgttgactgcaattaactatgaaactgtgggccatgaaaccacggagaagtggggggactacggtatttcccaagaggtagaccacattttggacaggaagattcaaatcataaagttagtttctctccacccccgtcaaaatcctaacaagattatttgtcaagcttaatgagtctaaatttgtgtgggaaagcaaaggttcagggtaatctgaaggaagaaaaataaggtggagaggcttgccaactaaaggttcattgtaggtataataatcagggcagtgtggtaatttgcagggaattttgacaaaagacagatggaccaggatagagatcccagaaacagacgcatactatatgaaaatttgatgacggctttgtgaggaaaggatgtgccactcaataaatggtgctgggagtgttcgttattcacatgggaaagaaaataataaccaacctcatgtagtagaaaacttgtaaaaattaattctgggtgaatttatggtataaatgtgaaaaacatctgacatcgatgacagaaccttctggattccaaattcatttatccagcttcctggtgaatgccaacccttggatacctagtaggcacttggaacctagcatgatcttcacctgcattcaatccactcttcccacacttttcctatctcagtaattccagccttccccttgctcagaccccaaacatttaaaaaaaaaaaagttaaaatggaatctttataactgaaaaggttgcaacctatcttagaagccagcgtattttcagaagtaaaagcaaatttaaattttcattgatgtcctgaagcttccaaaacagctgctactaagcccacacagtgtttcattttttatattaggcaactcctgtcccctggccaagtcaactgcaaggcttaatgacttattttatagacattttgaaaaaaaaaaaaaaggtggttcttttgtggtctgtgtgtttggttttattttattgactgcctgttcagttacagaaatagaggaatgaataaaactgatctcacctaaaaatccagctaaattttagcagattgggcatggccgatgagtggggaaagggctgaaagaatcacctgcgtccagtgcaaatagcacagtggcgatcggggggacagaactgtgcccaggctgcagtttgtgagcaatggatgtgaggaaactctgaggtttctgggtgatggtgttgttaaatcaagcagaaaaagcgagtgctgtttctctatgatggaaatcttagaaaatcttttgtacaaagaacttaaacaaatttacaagaaaaaaaacaaccccatcaaaaagtgggcaaacagacacttctcaaaagaagacatttatgcagccaacagacatatgaaaaaatgctcatcatcactggtcattagagaaatgcaaatcaaaaccacaatgagataccatctcatgtcagtcagaatggcgatcattaaaaagtcaggaaacaacagatgctggagaggatgtggagaaataggaatgcttttacactgttggtgggactgtaaattagttcaaccattgtggaagacagtgtggtgattcctcaaggatctagaactagaaataccacttgacccagcaatcccattactgggtatatacccaaaggattataaatcattctactataaagacacatgcacacgtatgcttattgcagcaccattcacaatagcaaagacttggaaccaacccaaatgtccatcaataatagactggataaagaaaatgtggcacatatacaccatggaatactgtgcagccataaaaaaggatgagttcatgtcctttgcagggacatggatgacgctggaaaccatcattctcagcaaactatcacaagaacagaaaaccaaacaccacatgttctcactcataagtgggagttgtacaatgagaacacatggacacagggaggggaacatcacgcaccagggcctgtcggggtgggggctaggggagggataacattaggagaaatacctaatgtagatgacgggttgatgggtgcagcaaaccacaatggcacgtgtatatgtaacaaacctgtatgttctgcacatgtatcccagaacttaaagtgtaataaaaaataaaataaaataaaagttccagagcaggaaaactaatatgatttgatagtaacaagtccacattattttatgggttgtttactgggtgataaattaggaaactttttgtgatgatgtaaacattgacttctgtgtggagggggcggatgtgatacaaaggtgtatttattttctaaaattagttaaatgatacccacaaaatcatttcactgcatgtaaattataccacattaaaatattataaaaagttttataacatctgactcttaaaaaaaaaaaagaaaataagttttggctatactcggaaaatttcctgaagcagttgaataaatgaggcattgctctaatgaaaagagctctgatttggtgtgacatacgtgtgtatgtgtgtgtgtgttaatagggctccttcagtttggatttggcttattacaaagaacagtttaaaatccaacatttaaaaatatgccttctcagccgggcgtggtagctcacgcctgtaatcccagcagtttgggaggttgaggtgggtggatcacgaggtcaagagatccagaccacagagcgagactccgtctcaaaaaataaaaaaactaaaaaaagtaaaagagatcgagaccatcctggccaacatggtgaaaccttgtctctactaaaaatacaaaaattagctggacgttgtggcaggcatctgtagtcgcagctactcgggaggctgaggcaggagaatcacttgaaccctggatggggaggttgcagtgagctgagatcgcgccactgcactccaggctgggtgacacagcgagactccatctcaaaatatatatatatatatataatatatatatttatattatatataatttttttatatattcatattttatatataatatatattcatattattttatatataatatatatttatattattatatatgtatttattatatatatatatatacctaccttctccctctaccttttcctcctcttctttccctttgttcccatggtgatttttatctgtgctatgggggacctagtgactaaggggtaataagaagtgaaaattatatacataaaaggataatgctacaaaagttactttttacagtcagctatttgtaaactgtagtgcattttcccattgaaacaaagtaattcatggctggcttcccaggccaacccacaaaagcatactgaatctttaatgtctatgtggtatatagtattgtgctaattgtactgtaagacccaaccagcatcctgaggttcccatggataaatgcatttcgttagaattggattccaggaacacattgttctttgcttccctgaggggatggtggctgcgctgtcccaaattcttgcccacttcctcctccctaccatcaccactatcgtcagagctgacatgtacagcgtcttgtgcattttctcatctggtttagagggagcactctcagcttgagaccataggtcatgactctgggagtctggggcagaggagcccagaagaccaagagctggagggagatgacttacaggtagacggaagttaagggttcagtgagaagttgtggggctgcatccctgtgctaaagagccctgtgtggatactgtattctaggaacctgggacagtctactccctcctttccttgatagccagtgctcgtatggggcccctggaccaggagcagccctgcttcattcccctgtggctgaggagtgtgatcatatgtggctgctgtgacttcctttgagaagggacagtggctgcaggcactgagattgatatccccagcacaatgtttcccaaagacgcccgtacatccggtggtacccagggggatttcacttgctacatgcaggaaaaattttttgttttaaatgttacatctttatagttaccttcctttttatttcttttgagacggagtcttgctttgttgccaggctgcagtgcagtggtgccatcttggctcgctgcaacctctgcctcccaggttcaagccattctcctgcctcagcctcccaagtagctggaactacaggcatgtgccatcacgcccagctgatgtttgtatttttagtagaaacagggtttcaccatgttggccagaatggtctcgaactcttgaccttgtgatccgcctgccttggccttccaaagtgctgggattacaggcgtgagccaccgcgcccggcctttaccttctatatataccgagagatactggttttccatttatggtagtgatgtatatttcctattaaaattttaagcccaaagtaaattgatttaaagaaaaaaagtacaggaagcgcatgtgtgtgagagactgctgtttggtgaactgctcttgtaaaaggttacactgtcaagtgggaaaaagcaggctacaaatagtataggttgtgagattccatttttattttattgttatttattattattatgttttgagatggattctcgctctgttgtccaggctggagtacagtggtgcgatctcggctcactgcagcctctggctgctgggttcaagtgattctctgcctcagcctcccgagtagctgggattacaggcatgtaccaccacacccggctaatttttatatttttagtcaagatgggttttcaccatgttggccaggctgtctcaaactcctggcctcaagtaatctgtccaccttggcctcccaaaatgtgggattacaggtgtgagccaccgttcccggccagattctagttttaaaaacacacgatgtacatttcaacgtatagttacctcacgaaaagataagtctggagagacagaaaccaaagtgttgacagtggttggttatcaatggaaggtgggattaaaagtgattttccaaattatttattttttctcttcttgcttagattttctcgttcttgtctgcactgacagtgtattccttctgtgataaaaacataactggaaagcccatgtcactttctgtcctcctgtcatctcctctccgcctcttcctccagttacatgcttgcttcttcctgttctcctcaagaaggaacatgggtaactgctgccttctttgtgttttgagtgaatgtttaactatttcttcctccaacttaagatgccagtagatttcatttcactaagaaagtaaaaaatgcatttaaatttatgcacaaatggttcttggggtggtaaactatatgctgcctttaagtgcctttaagtcttgctgccttgatgggccacaagacagggtagcagttgggagggattgtcaagatagtccctctgagacaaccaccagaataagactggaaagcctgcttctcctctcttcgctttattaactcactgggttaccttagcttaagcaagacccctgggagtccccatttctgcagctgggtcagatgatattccagatgcccagattccatatgaatgaatcagtaagtccagggacatgaactcacagtttggaggaattgcttgagaatggtaactgagatggagctagactgttagctttactgctgttcataggtgacccattcatcctagtttgcccaggactttcatttttttaatgccatgaaagtcctatatcttgggcactcccagtcctgggcaaagagagacacttggccaccctaaccatagatgtttaggccaaacacagtggtactggcaacatggagaggataggggaaactgtgtagtcaaatatcttcctagtcagtctccaagggaaagatagtagatactcaatatcataaatgtaatacctttctaatgaaatgtcattttgaatacaagtttagttgacagcaccacttgtcctgaacgatgtaccccaaagtggctgcaatatcattctcaccttttccaaagattatctgacctcatgcagtggctgctgagctccagtagccagagggaaaaaaatggcatgtcctcacctcactttttgtaatcttattcatgtttgcaattgtaatcatttctgcagagaaaaggccaaccttgctgttaccctctgcaatgacaaggaggagatcatggcccaggccaccttcctggactaccccaactggaatgttgccaagcaggatgactgggtgtcagtgttccgggagctcgacagtgacatcccatgcacagtaagaaatcacatacagtgcttgttagaacaccctgaatcttgaggggaagtcctgtgtttgtgattatgtctttccaagttttgtactgagcagtatatgacatcatgacagttaaaagtgaagggagctggtggggaggaaaagagggctgagagtagtgccaggggggataggaaagggcagggagtagccaagttggctagccgctggcaaggcctggatcgtgcttcactaatgacggcgggggaggaattagtggaagtgtcaaacgtgtgcttccaggtctcacgttgttctccaggcgtcagtgtccaaggtcattgatatgttaggagagcacctgccgtctacacaattgcccttgtaatcatgacagcagagcctcagacttctgtcacattctataattttcaaagtgccctcatggaccttggcttatttgatgtcttctagctgctgacacatgacaacttgtcagccaacagaagctaggttagtggttcccaggagtctggcctgggtacctgatgccaagtctgagctttctctgcatgcaacctgccagagccaggccagagacaggccccagtttttgtggagtgccagaggctacaactctgggcagcaccctggccttgtggtggaattctgcagcatgtccccagagccctgatgtcagaagaaaagggaatgcccaatgagtgtgagtgaattcaccccccgtacatgtgtgtgaatgtgcacacatacacacacccgtaagcatattattcagcatttatttcactagatggtgccttcccctcatcttttgtgttctctcctaccctgccaccctgtatacctaaggactattgtcagaaaaattatcgcaaacttggaaatagaccaaaacgattatttcagtccaatgcttgcacctttggttgagtagcctgttttacaattctgtaggaatggtgattagcctgtagatttttgtccattaggatgtaaagaattcctgtctggatagagctaacctcaaaggttatggtttattgtcttacaggatgtgacctatttggtatctaatctagcaatctttttttttttttttttttttttttttttttttttttttttgagatggagtctcactctgtcgtccaggctggagtacagtggcacgatctcggcttactgcaagctctgcctcccagattcatgccattctcctgcctcagcctcccaagtagctgggactataggcgcctgccaccacgcccggctaatttttttgtatttttagtagagacagggtttcactatgttagccaggatggtctcgatctcctgacctcgtgatccacctgcctcggcctcccaaagtgctgggattacaggtgtgagccactgtgcctggcctaatccagcaatcttattctttccttttcctagtaaatcacctgaagtatccagctcttcaagtgcaaagaatcatttttatcatctcactggttgcctcattaattgatttgttgaagttgaataaacctctgatagatgtttattttatatttgcattagggttatgattttacctttctgaaaattataaattaacactcttattcataaacacatgccccttttgtttcttttcaagctgtcttctatgacagtatagtgctgggctgtccaatgtggtagccaccagccttatgtaactaacgagcgcttgaaatgtagctagtctgaattgaggtgttccataagtataaaatatgccagatttcaaatacttcgtaggaaaaaaagagtgtaaaatatctcattaataatttttataatgattacttgttaaaatgatataatttgaatatattaggttaaatattaacttaaatattaaacattaattcacctgtttatctttattcttttttaatgtgtctactagaaaatttgaaatgacatttgtggcttgcattacttttctgctggatgtaaccagtatagagcctttaaggcttaatgcagtatctatcccagggatatttgcagctgaagtaatgatttttatcttaaagctaaagaataaatcttgcattgtaatatttatgatggaagagagaatttgggagacaaatcaagcaagtaataagccatatgctcctgaggctagtcctattcaggatgtaaggcaaatgctgagtgagattattgtgggattaaatgagtgaatacacagcaagtacttgaaatcatgtcgtcgtcatcgttatctggacttttgggatttgtgttgtttgccttttgggagttttcaagctcatgaatcaaaacatggttttcctcttgcgcttttagtcaccgtacaattctttccgagtgcttctgagtcacacaccatccgacagaagtggggacaaggcacacagaagtgccactggtcccacaaagctgtccagaaaattattcaaaaaacaagaaacctaggcagcacctgtgctgtcctgatataggtaccagcaccaccctcaccagtcagccagtctacatctgcactgtttccagaatttgaagatttgttcataagcacaggggtaccgagttgagtggaccaatgtgtggatgtttgaaccatttactcattatttaggccactttaaaagtctcagaaggaggagacaaagctcttttaaaacttggaagatttaactggaaagtcttgctagaatcttgctactgtgagttttcagctcccaggttttttggatcccaagagtaatatttgattctgactctgggaatgttgaacaaaacaagccaatggattctgaacgtggcatctgccttccatttttcaaattcataagagcatctctccctcctgtcacatgaatagagcagcagctgctgactcaagagcgccgggaaaagggtgattgtctttcacttggcatagacacccctgaggacaagactactgagttaataatcgatttcactcccctgcaggctctcccgcagctcattcgtgagggcaggaggaagggcgggtgctctggactcatttacagtccctgtttccttaaataattgtgagtaaggaggacagaaggcggcaaacggagtcagtgagacagctcaaatgccgcctgggtgttgcatcacttagacataaaatatcaaccctaaatgccaggctgttctgtgtctgtggatgccccgaaaccctctttccaccctgtgctgacctagcccgaatactgactcagcctttaatccgtgttctctcttcttctgcagcccctgaatacgttgttcatgcacctctttgtggccgtggatgagtattctgttggctgttgcaaagagattcttcggtgagtggatatggccgtgcagtggtgaacatgaaagagactgtgtggatagttttgaaatattttttaaaagacatgaaattctttggggtgtttaatttgcttgtaatttgtggctatattaaaatatttactttgaatagcaatgatatttctgaaaggagatagttctttgaatctattgtccattctgcacgctgttatcatttgaggcaaacagatagtgcagtaatttaaagaaatggatttaggttgaggggagtaggagaagaattaagtgtcgcaagcttggacatttctaaaaactgcttttctttatcttatctttagaaatgtttattaacatgacagacttcaaagcatcctgaataataggatgcatggaaaatgaccagcagggctaccgagtcatggcgatgtgtctctgacagcctctgacagcctgcacagacatttgggggtggtggtcacagctttcaagtcactttgtaatgtcacaccagaccgtccagatgccaggtcaaaggttaatattagcagaaatctggtgtgccatatgaacatggcaccctttattctctctgcctccatgggacagatcgaaaaggggccctttagaacccaaggaaaagtagagaagaaaaagaaattgccttgaggctgttcttgccattgcaggtggggagcaaaggagcccatgtggatttaggaacacctcacctttttagtgacagcatttgtcttcatcaagtgccagctgatgggattgctttgttagtaacactgccccaccctctctttcctcaccagaaccgtgtataaggcagtgccagagctgcacttcatatttctcatcgtgccatcctacatgagcctaggtaaggcccgcccaaccacctctggtccccggtagcaaacattgaaaattcactcccagaatggtgctttggggaatgagaaataagagtggtctccaggtcctcaatgtaccatgtgcatattttattagaacaattaagcacaatttagaatggaaactacattttgttctgacatcccaaatttatttcttgataaataaggacatgtttctttatctctgtgatttaggctcaactctcataactgtttttgaccaagtggggaacatcccgtgtctgacgtatgaggaagactttgcagtgcatatatgtcacaggcacagccactatcctcagctgcacgttcgcaaagccaggtacagttggagtcatgccttgtgtgacctaagcttcactgggacagtcatcttcccaagactctttaaactaccaatgctaagtgactatagcttagatcaaaattttttacaatactcataagcattacttcatttggatatctttatagttccccttaatgacattatttgcaggactatctgatgatactcatttggttctatgtggctataacattattcattgactccttaggggtttctgaaaacacacaatcctaggtcccacaccagtaagataactttcaaataaaacaagcttaaaaatgaacctgcctattcagttttctcggtaaaacccacctattttctgacattcagtgaatgaggatgctgttgaccccaaagaggggttttccaaattgaaggtctctaccatcaggtgccccaagtccagcagtcttagggagatggctgtggcagtgttttccaaagatggctgccacactactttccaccccgcaggctactctttgatgtgactttgccactcctctcttcaagccttgggcgctccgtcctctcttcctgaagctgggtgggttgtgactgctttgaccagtagaccgtggccaaagggatgctctgggacttgtgaggctgggaagcttctgcctggctctctcaggatgcttgctctggaggaagccagccatatgtaagaagtctggagaagccacatgttcgcaaggggaggggtggttgacagccccagctgggctcccgctgacagttagcttccactgcctgtggtgtgaatgagccattgtggacacccagcccaggagagccccatatatctacagcacagctgacatctgatcgcagccacatgacagaccccaagtgaggatgcccagctgagccctgccagagttctgactcacaaaaccatgagcaatgtagagtggctgtttggaaataagagtgcattatgaaatcatctcacagaggtggttgcttggcttatcagtgaagaataaattgtatcttttgggatcagccattgctgtgtttgaggaatgctgactttctttagaaaagtattttaaaagttttaaaaactttataaaagtaagagcctatgatttaccaggcatgtagcagtggtatggcatcgttgttaagagtttgtaatgctggcatcggatagatctggattctgatcttggctctcctgctcacgaggtgggttaacttacaaaaggaacgtgacatctgcgggggtgtaagttccctctgtcagtgggtgtaagcgtattgtctacagcacaagattgtgatgattgtgagctaatgaacatcaagcacttagcacacttcctgccacatgtaagggcccaataaatattaaatattattatgacaaaggggcttagagttaagtggtggggagagactcatcttcagttaactgtcatgttggtagctgagaagcgggatgcacagacagagatgaagacagcttcattacaactgctcctccgcccaaaaaaacccctctaaatgtccatccaccagttaatgttgtttacccttataaactgtggtacatccatacagtggatgctactcagcaattcagtggaatgaaccatttacatatagtagcatgaatcaatctcagaaggtttatgctgagtgaaggcagacttagaaaagcatatacagtactgctgattacacttttgtgatatacaaaatgggtgaaaagcatccacagagataggaatcagatagagatagaaaccaagatcatggagatcatgacacaggctggaattctagcagcgacaggtcacagagatccaggttgttgacagcaagagtcagactctgtaaaatgtttgaagaggtttattctgagccaaatacaagtgaccagggctttgacacagccccaggaggtcctgagaacatgtgcctgaagtggttgggctacagcttggttttatacattttagggagatataagacacaaatcaataaatgtaagatgtgcattggttcagtctggaaagacaggacaactcaaagcagagaagagccttccaggtcataggcggattcaaagattttctgattggcagttgattgaaagggtttatctaaagacctggaatcaatatgagggagtgtctgggttaagataggggttgtggagacagaggttcttattgtgcagatgaggcctccaggtagcaggcttcagagagaatagattgtaaatcttttttatcagacttaaaaatatgcctgactcttagttaattctctcttggatcaggaaaaatgcctggaaaggaaggggattcaccacagaatgtagaattttctccgaagagacagttttgcagggtcatttcaaagtatgtcaaagaaatatattttggggtaaaaaacttcagtttatttcagggcctgccctgctgtcatgtttgtatcttattcctacaaagagtctgttctgtcattcttaagatctctgttttcatgttaatcctggtcaaatgttcctaaattccaaagggaaagtataatgaggcatgaccgaccacccaatcccatcatgcgctgaactggtatttcaggtttatgttagaatacccttggctgagaggaggagtccattccattggtttgggggagcttagaattttatttttggttacgtggtagggaaaggatcaggtcaggtgcatagatacagagagacatgttagagagtagcgcttggctaccagttggatggaggagttgagggatgaggagtttatggtaattcagggttttcaagtttaggggaaatggtgctttcattaactgaaagtagaaataatagatttaaatggacaggagaaggtaggaaatagaaacagagggagaagccaggtttgagatacacatttgtgagttgtcagtttgtcagtaagtggggagatcatgaaatgaaggagattgtcttgctgagggggagattgcacagtgaaaaagcacaggaccagggcagaactttgaaagatgaaaatgagctatgaataatgaaaactagaagagagggagaggaatacagaagaaattaagactcataaagtggcaaaagatgcagggaaatgaaattatttaagtaaaagagaagccattagatttggcaatttaaaaaggcacagataggatgaataaaactgatacttccagccaaactgaccaagaaaaaagacaaattgccagtatcaggaatgaaagaggtggtatcacttacagatcctacaggcattgaaagattaatatggggacattacagataactcaatgtcgataaatctaacaatttagataaaaatgggccaactactttaggaacacaaattaccaaaactcatttaagaaaaaataggtaacttggatgcttccgtatctattaaagaaaaatcagatgaactttgggtgagaggaagggggccctcctgcccagacattggcctctccccaacccacagcctgatttgctctttttctcctctttttctcttgttctcatgactctgaactctgccttcctcaggacctagtcctcagttttctctcaagctcatccctttgactcctctgtgccaaccttgccactcagtaaccagtgccctacttctgaactcttggtttggggtgtggtcttgtcactccttgaagggcagagtttcacaggagaggccaaattgcagtgagcggaataaatgggaggtaaggaaatgaaagcaaaggagtagtcagtgctattttttttttcctttttgctggagaaagtcactgctcttcagagaagttttgtgttgaagggaagcagagagagggaggccagaaacctacctgcagatgctgaacattatgcaaacagtgtaatgtgatcccgtttttcctatccacgtggagcattttatttgcattctgagagcggggcagcatgtctcttaacgaagttcaccaagaagcagatgaacttcagatacatattatctacctaatttagtttgagagaagaaaattcctcatataaaatgatctttcattactttctttttattaatagctaaataatcctctctttataaaaccctttgataatgatacaaatactaatgcaagccaaaggcagtctgaagaaatggaattttgtgtatgaaatgacatttttaattggttctctcatgtctttcaaatttttattcctgatttataaagtgtctcttgttagtgtcaggggaggcaaatagaccctcctgtccttcaggaaattatattttttaaagaaatattaccttcagtttttaaattacaagaatctccacaaattaattacttaggatcttgtaagtagtgtaacaattgttacacttttatattcattttaaaatctctcattttttatgccatttactaattttttggggagatgggtttatttaataaaatgaattctagtttcaaatcataaaacttaaaagtaaaagttattctttcatttttctgtgtatgtaactatacacacacaagtatagtggcatacatgcactctctctacatatatacctatatatatctccatgatcatatgttctgttaattatatttttcacttaacatagcatctcatcatttatcatctttagagatcaatttctttcttttctgatggtgcctggtccatgatggcctaaccatcatgtagctctaatacaattcatttagctcttgcttatttatggaaatttaatttaagttgtttcctgtaaaaaatttaccactttttctataaaaaataatactgtagtaaacagcattgtacatatatcatccagcattcatatatagtagtgtacaacagataactaaatgtggaatttggtgtaggaaatacccagatgtttgcaaattctaagatttaaaaatagatgccaccaaattattcaacgtaaatatcatatccatttatattctgaccaaatagagttgtttccttacatcttcatcagtgctgagtattttcagttattaaaactgtttcctggccgggcacagtggttcacacctgtaatcccagcactttgggaggctgaggcaggcagatcacgaggtcaagagattgagaccatcttggccaacatggtgaaaccccgtctcttctaaaaatacaaaaattaactgggcgtggtggcatgcatctgtagtcccagctactcgggaggctgaggcaggagaatctcttgaacctgggaggcggaggttgcagtgatccgagattgtgccattgtactccagcctggcgacagagcaagactccatctcaaaaaaaaaaagaaaagaaaaaaggttccctgttagaccaaaatagtattttgttgctttaaattgcatttgtctaaatctgtgagagtttgagtgccattttacaggttccattttaaatgaataaaatacttgaatttaaagtaacttccagttaagctatcatcctaccagatgattaaacatgttcctacaaagtaggcaattctagacaattccaaaggattgggcaggggatagatatgagttacttacaactgacaaaggcaaatttctaaaagtattttcttaagttttagtcaggatacccgatttgtatcttgggaattatcattttctggaggtatgtagggcttaattaaggactttcaacttagttattcagcaagggattattgtaatagaaaacttgtatataaatccaacactgaaaatgacatgtatagaagcagcccattcaaaaattccctattcctttcactttttagtaaggtattgtctgttaatttactcgctaatagcctacttgtcactcaggatgcagggtgcaggagaaaagatgtgggatgtgctcagcccagtgccaggctcccagtaagcatttggtaacagatggttatggtttggtctccctttctgcctcctttcctacaccccttccttcttttcttccatttttctcttgaaaacttgagtgctatggactataaccttcagtggacaaggttcacaaaacttgaaataaacctggataccttaacctgaggtcttgcacatacagcccctgatgtgcccatagaaaatctgaaagaagcaaaacacaagaggaatgatagcaaagaggtgacagtgggtactttgcagtgaggaagggatgtttattagaagataagtggacagtagtgaattcgtgtggaaatggtgacagtatggcagtcagtgcctttgcctgcagaaggtagagagtgtggcacattttagaaagccctctatccacatgttcagattcgagttttgatacttgcaggcacagaatttcatgtatctggagattgcagttgtgtggactacctccctccttaacaacgctagaaaaatggagactttacagaacatcaaatgggcgtggctgtgtgcctcttaggttgcctcctttctcttatttccctcacatgtattttttgacatccgtttcaacgatagttacttgcactgatagttaatggtgaagaacacaattcgtaagacactgaaccagtgaagggtttggggatgtaattatccttcagccatttggctagtgacacattcaaaaccaatgaattaacactgtaatcccctgtcctgtttctttgatttacccatgtggaaaattatgctgtaatctgcccatctacttagacagtaattagtgaagttactgttctgtacttttcatactatctgaaataaagcatagctacttctggacacacctctaaaatctacagtgggcttaattaatcatccatggtggatttgagatgtgttcagatttagaaactactggcatgctctttttctgggggaaaacctgtctttttcaagtcctcctggggctgggaggagacttggccaaggaaaggattatgtgctttcaaacaatgttgtgaaataactggtttccttagtggagtattgcttctttgttgataacaatggttgattaaattggctcaaccttgttgctttttaaaatagatgaaaaatctctaatcatcagggaaatgcaaattaaaccacagtgagatactactaccttactcctgcaaggatggccataatttaaaagtcaaaaaacagcagatgttggcatggatgtggtgaaaaagaacacttttacgctgctggtgggaatgtaaactagtacaaccactatggaaaacagtgtggagattccttaaagaactaaaagtagagctaccactcaatccagcaatcccactactgggaatctacacaaaggaaaataagttattatatgaaaaagatacatgtatacacacgtttatagcagcacaatttacaattgcaaggatatggaaccaacctaagtgcccatcgaccaatgagtggttaaaggaaatgtgatattcatacaccgtggaatactactcagccataaaaatgaacaaaataatgtcttttgttgcaccttggatgaagctggaggccattattctaagtgaagtaactcaggaatggaaaaccaaataccgtatgttctcacttgtaagtgggagctaagctatgaggacacaaaggcatacagagtgacatagtggaccgtgggggctggggagggggaggttcggagggggtgaggaataaaatccaacctattgggtacagtgtacactgctcaggtgatgggtgcactaaaatctcagaattcactactaaggaactcatccatttgactaaaaaccacctgtattcccaaaactattgaaattaaaagaaataaaatagatgaaaaaaacattctttaagatttaagatgggtggtttgtaattacaaacttttaactcttaaggcaatcattttaatgaaacatttgatagtcccatgtcatgctttttagaaatccacttaaacttgacttctgagcaatttcatatgaataattatgaatatcctaaagcattccaaaagaagggatagggcaattacagatttcccccaacaatcttcatgaataagactggtaagtgaccaccaagtctatggtggagccaagtccagctggagccatactagcccaggatggacgtttagatcagatgtgctttgaaaagcacatgacaaatttgagcttaaaacccttcataatttttaaaatcatgacattttccaaggactagaagctaaatgactccaaaacccatttggaagttctacagtggaatactatatggagtttagaaatgatagatttgattttcttaaagaagaccactagaggtcacaagagatcttgaaaagaaaaagggtgcttggttttgcatacctgaagtgaaagaaaaatctagttgacgccgatcttaggttctcctaccccatgttgagatggtgttcatggtaaaaagttggcttaactagaacacactgcattctctatcactaccactaaattagattttctatgacttgttttcttaattcactggtttcttaaaatacacacacacacaggtttgaagaaatatatttatggtgtttgaagtgacaacattcagttgtacattttacaactgtacattttaaagtccagctttaaatacaaatcctctctggatatggagaatatcatcagacaggaatgaggaggctgtgccaggattctggatgcggaggtggcctgctgctgctgctgctgctgctgctgctgctgctgctgtcactccagtccttaagtgtgagttttccatctgtgcatttgcagtggtttctgtgctggcagggaagtgatgcacacctctcagactcgagggaagcaggcctgcaggttttcctctggggccgtaatcatgtagtgcagcagccaggctgtggaggtgatgaagcaatgtcaggatctgcgtgtcacccagagacccatcaggctgcgagggagagttctgcatgttctggatgtcgcggtgctcctagcaagctcagctaaccgactggtggaagtgctgagggagtttgtcctcacttctccccaccttccaggaagccagtgagagctaccggctcatttctagctgtggacttagaagacacccatttcccaagtagggtgtcctgaaagggggttgatttccttaaggtgtgtgttcaactccatttcacatggcacagttttcagagtctgatggaaatctgggtgtctgagagattgataagtgtttatgaggtggaccttttgtttcctccagggaagttaaaataaaatattgtataattgatgacgttaacaagcacattgctgccccctccaagacacattcagaatggaagatataaagtaactttgcttttcgctcagagaattgtactatttccgttgcactctgtgctgatctataaactccgcatcttcatcgccactggaacactgtgcggcctgtcagtgccagggcatgtgacgctgcggtgccaaattcacagtggctctccttgcatcctgactttgacaggcagcgctcattgcctcagaacagtcacgttgaaacatttgactgcatgagttgttttccatagctggggtgttttgtttctgtggggctggactttgtcatatgccatttgagactatgtgaggctgatgtcatactttatcattagcactcgggctgatgcaagatcataaattatcaattaccccaaggaatgcatttagcagaacaagttcctctttatccattttgggaaagggcttaagagagagcctcttcagaactccaagatttggatgtttttctatttttcccagaagaattcgtgttgaggtatgattatggataactttgttaacgggctgctgaggttcatgagcaggcctagggctctgggtctttcggaacctttattcctgatgtttatagctacagagtaatatttctgtgtccatcgtatatttaaaagcctatggtgcacagttgattgtgtgtgattgctgtcttcattcacttaaatgattaggttattgaattatttttccattatttaaaatgtctgttaataaatattgatgcaaccttttatttttggcaaaacgtttgaaaatggatttgttgactactctctcctagaattttttacaaattattcttagccaatatcatcaaggactcttttttacagagaaaagccaccacctcttattagcaatgcccttttggcaggttaagtggggaagtgagttgttcctggaatgttctaggctttttctgccaaggttctgagggctcacgtggagaacaaacacttgctaaggacttagtgtgccccagagagcaggctttagtgcgtcatctgtgtcttgcagctattcttgtccctacctgttttttgtacatgagaaaaccaagtcttagcattgaagtgactttgccagtttcttttttttttttctttcaaattttattattattatactttaagttttagggtacatgtgcacaatgtgcaggtttgttacatgtgtgtacatgtgccatactggtgtgctgcacccattaactcatcatttagtattaggtatatctcctaatgctatccctcccccctccccccaccccacaacagtccctggagtgtgatgttccccttcctgtgtccatgtgttctcattgttcaattcccacctatgagtgagaacatgcagtgtttggtttttttgtccttgagatagtttgctgagaatgatggtttccagcttcatccatgtccctacaaaggacatgaactcatcattttttatggactttgccggtttcttagtcagtagagtcagaaggctaagtagaggggctgtgatgccaccagcatgggaccataggttcagactgcccagacgctgccccttgggcataaaaattctgcccttcactgctgtcagtgtaaatgggacccttggcaaggtctcagcacaaggtaagggcccagttcacgttggctattgctgctgggttacatgctaaagaactgctacagaattccttctgtgtccctaaagagcattttccgtggttgggaagatgccacaccttggccgtaagaattagcaccagaactggacaatatatatccagtgatgatcccatcattgggttcctgggaagggaagttgggagagaagagtcaccggagggtgtagggtggagatgagctttggaggatgctggaattggggataggcaaggggatcagagcactggctagaaatagaggtgggaaggagggaagatggtgaagtctccttctagagacaataagtaaatcaacttgtatcattattggtgactagggtggaaagatgcaggcaaagaattttgtgcccatcccagaaacagtggggagcttgcaaaagtggagttttaaaaaaataatttcaatttttattttagatttagggggtacatgtgcaggtttgttacccgggtatattgcatgatgctgagatttggggtacaattgatcccatcacccaggtactgagcatagtactcaacagtttttcaacccataccctgctccttctctcccctccctagaagtccccagtgtctatcgttaccatctttatgtccctgagtgcccattgtttagctcctacttataagtgaaaacatgcagtatttgtttttttgttcctgcattaattcacttagggtaatgaccttcagctgcaaccatgttgctgcaaaggacatgatttcattatttcttatggctgcatgtaaaagttttaaagtaagatgaagaaagcagggttttaagaagattagtgatggtggatggaatgacagagtttctccttacagtagtcaatgggaagtgagtgcagtgattcaagcttctgtagtaagaaactctcttattccacccactgactgtagaaattcttcagttctttttggtttctcctgcctaagtaataatgataataacaataacattgcacataacccttttttaacgtttgctatttttgtgacagatgcacacacggtaacatagagaggtaaagtacccaaggtcacagctgggcagaagcaggatccagacccaggcagcctggctcccccgctcaggctgtgaccactatgctgtatcatttttttttttctaatctcttcaagagcaccataagacttaatgcatttatggtggcgcctcagtccactgggccacaggtgaccaccgataatgctcagtgatcacatgcagaaatagatggacaagtggtcaaggccctaccttttgtaaattattgcagggctgaaatagcttgaaaaatgactgcagcatcagtagtacagtcatacccattcaaaaaatggttgacatttgtttctggcttcctgttttagcctcatcactagaaattcctgctgatgcccttgcatcatggaataagactgtttggtggtgatgacatcagggccaggttgacagttttaaaaaacaaaggatctggttgcctggttaaggaccctttgctgtctctccttccagagagttttgacaagaggtgtattagtccattctcacactactataaggacatacctgagactagactatttatgaaggaaagaggtttaattgactcacagttctgcagcgctggggaggcatcaggaaacttacaatcatggtggaaggggaagcaaacacatctttcttcacaaggcagcaagaaagaacaatgagagccgagtgaaaggggaggccccttataaaaccatcatatctcctgagaaccttctcactatcatgagaatagcatgggggcagtcacccccatgattcaattacctcccaccagcttcctcccatgacatgtggggattatgggaactacaattcaagatgagatttgggtggggacacagccaaaccatatcaagaggttaacaagaagattcaacctgtggagtcatggtgatggtccctcccatcccgagttgtcatcttctgtgtgtgttttttcctccttgtaccgtggtcttgttggctggctccctccttccctctgaagttttatagaccagagacctggcttttcaactgtgtagttcttccatcaagatacttactgtttttaatgaaaaaccagcatcatttcaaccgttacacttgtgtcagcagaggcaaaggtttcatcctgggagcagggtgaagattttcatccagagtgcatgcggtcattcagtttaaagcatttagacttaggaagtgcagctgtggcaggatcaggggattcgttcctgcagggcgcaggaggaatggtggcagggctggcaggacgataacctctggcccctagccaaggactcccctctcaactcttttgcttccagctacaaatgttcaaaagaagagtcaaaataaaggaagattttgaagtgcattgtcagcttagcagagtgtgaaggcagggcttaagtcactagaccagagctcatatcacggctctgctgccaactatttctgtcatctcaggcaaagcatttcctcatccccatgggccttgctctcctccctctgcaaagtgaaaatggcagtgccaccctcctgggatcactgtgagaaacacagtagcagaaatcatctggataaagccctgagctttatatatatatatatatactgatcactcagtagatggagctgctattaacgtcaaagagaacatactagaagataaaatgggatgatgaagatggtagcatagtaaagctagggggaggaaatagacattagtagccaaagcagatatactagaaaaaaataacacaatgctgaaacatttttacagaaagagtatcagagaaaaaaaaaaaaaagcaaagtataagaacatcccacacaggtaaaaaagagcactaaacttacccaagaatgtgctaaaaagaagaaaggagtgttaaatcctgcagcaagatggaacacaggagctagcctccccaagctgcaataaatctggtttttgttcccacctgccaccgccccctgtgccagactagttgtcaaggtctctgtagagggtcctgagaatggaagcggagtggatgtccccaggagggtgagcagtgctccatcacttcaccagccttcccctccatggcaagtgcagaggcatctcaggaataaaggatgccatgggccagtgtttgaaaaatgcataaacaaggttaaatattctttactgtagtgcttctcagagtctttaatatgtaactatgaaacaggaagggacttatagtggttactgtttttaggcattggaattctttgggctgagaggatgctcgggacaatatcatagtggtgtttcttagaacatccttgggaagtgctgcccctagtctcttgtcctttggcccatgacaagtgcttccctgcatcccacacccacacatgccaactgtgttccctctgcctgcaatgttccacttctaggtttcaacatagcttcttccctttctgttcattcagctctcagctcagatgaccctcctcatagaggtcctccctgaccacttgaccctctcactctctatcccaaagcatgtatcattatttgaaatgtttagaattgtctaaattggttacatctttattgtctgtttctcctattagaaggaaagttcaggccaggcgtggcagctcacatttgtaatcccagcactctgggaggccgaggcaggcagatcatgaggtcaagagatagaaaccatcctggccaacatggtgaaaccctatctctactaaaaatacaaaaattagctgggcgtggtggtgcatgcctatagtcccacctactcgggaggctgaggcaggagaatcgcttgaacccgggaagcagaggttgcaatgagccgagatcacgccactgcattccagtctggcaacagagtgagactccctctcaaaaaaaaaaaaaaaaaaaaaaaagaaggaaagttgatatcatgagtgttgctctagccccggcacttagaacagggtctggcacacagttggtgccctgttgaaggaaaaaaatgagtgaacgaacactgaacttcagcctttctattaaacagggtggaagaccatgacgatctcatgccaatatttatgcgctatgacacaattctgaaggaaacttacggtgaatacttcctggccgaactaatagaggcccaagatgaagagaatcatgctgttgtgtgtgaggtcagtgactgattcatgtgggaacacacttagtgagaggaaggagggatgtgagtggtgttgctcttgcgttgctgggcacccctggagctgccattgtctccctggccaccccggccctcccactgcccttccaggtggtgcaccaggccagcttcctcccctgggttactggctttaggttgtcttttgcgaggtccttccagatgcccacgatgctgtagattcttgccttgtccctagagtgagagggaatggaaaagaccccccaggggtgcgtagggggatttctgaggatccccaaatctcagacttcagaagtcacaaaccagcgttctgctggcagatggattttgtttgagttggaaaggtattttttttaactttttgttttgacatagtttcacacttaaagaaagtttataactacccagattccccaaatgttaacatccaaccccatttgttttatcattctcttgttcaacctttctaattccctctctctctctctttttctctcttgctggctctctctctctctctcatgtatattctgaaccatttgagagtaagttgcatacataatgcccctttacctgtaagtatttcaatgtatatttcctaaaaacaaggacactctcttagataactgcaatacaatgatcaaagccaagtaattatgattcctgtaattattattattattattattttttgagatggagccttgctctgtcacccagactggagtgcactgtcatgatctcggctcactgcaacctccgcctctcgggttcaagcaattctcctgcctcagcctccctagtagctgggattacaggtgtgcgccaccacgcccagctaacttttgtatttttagtagagacggggtttcaccatgttggccaggctgacctgaggtgaactcctgacctcaggtgatccgcccgccttggcctcccaaagtgctgggattacaggcgtgagccaccgtgcccagctagttcctgcaattcttttatctaatctacagacttcattcagatttttctgacagtcccaggaatgtcctttatggcagaggtaattccaggccattcattgcattcaggtgctctgtttcttcagcctttttaaatctggaacaattctccgatccgtctttatcttccatgacaattacagttttgaatagtacaggtcagttattttgtagaatgtctccatttggatttgtacaatgttttctcatgatttgattcaagttatatatgattaaatatttttgaattagcagctattgtaaaaattatgaaagtctatgtaaaaattggaatttctagcttttctaaacaaatcagaaggcccagcctattgggcccaaaaggcagcccacaccctctaattcatgattcttcatctactcatttctcattatttgttaaaactgtaagagctgtttaaagaatattacttttcttgaaacttggaatgaaaagttctcttacttggatgacatgagcagtttgaggctttgttctacatcagtggttctcaaacttggcatatatgcagatcacctgggaggcttttaactatccataccatgccaatgacttggatccagaatatatacaaagaactctcacaacaatagaaaaataatccacataaaatgtgggcaaatgattcgaatagacacttttaaaaaaaatgaataaataaaagatacaactggccaataagcacatgaaaagacattcaacatcattagtcattaaggaaaggcaaatcaaaaccacactaagataccactttacctctgctaggagggttataataaaaaagcaggacaatagcagatgttggcaaggatgtggagaaattggaagcctcatccattgctggtaggaatataaaatgctgtggccattttggaaaaagtctggtattttctccaaaagttaaacatttgacccagcaattccatacacagaattgaaaacacatgtccacacagagatgtgtacgcaaatgttcatagcagcattattcataatagccaaaaagtggagacagcccaaatgtctatctactgatgaatagataaacaagatgtggtatatccacacaagggaatagtaccaggaaataaaagagaacgaagcactgatacatgctacagcgtgtatgaaccttgaaaacatgatgctaaagaaaagaagtcagtcataaagaccacgtattgtatgatggcatttagatgaaagcctagaatagacacttctgtagagacagaaggtagattagtgactggagggaaaggggaaggagaagtgactaatattgggcatagtcgttggttggtggggggatgaaaatgttctgggattagacagtggtgatgggtgtacaattttgtgaatatattaaaaaccattgaattgtgtatttcttttttttttttttttttgagacagagtcttgctctgttgcccaggctggagtgcagtgatgtgatcttggctgactgcaacctccacctcccgggttcaagtgattctcctgcctcagcctcccaagtagctgggattacatgcatgtgccaccacaccaggctaatttttgtatttttagtagagatggggttttgccatgttgaccaggctggtctcaaactcttggcctcaagtgatctgcctcccaaagtgttggaattacaggtgtgagccactgcaccaggcatgaattgtgtacttcttgaagggttgtttttatggtaggtgaattatatcaattatatccatttttaaaaatcctgttgcaggggtacactcaggccaattaagtcaatcttttgggggtgagacacaatccatatatttatttttaattttggacactcactatgttgcccaggcttttcttaaactgcagtcctcctgcctcagcctcccaaagtgctacggttacaggcatgagccaccatgcctgacctcaatctggatttttaaagatctccccagatgattccaaggtgcagtccaggtggtgaaacactcatctacatgagggtaaaacatacctggtgagaatgacatgactttatagagatgtgggtattagtttctgaaggtgacaattggcccctggaaattagattctgaagtactacattgaaaggatttttatttattttttaaatgtttattttattttcttatatttaggttttggcatggtttctcaaagacccgctttcacgtattcttgtttagccattagccccaggctaccaggctagccatagaagggagggttggaagcatttgggcccagcagtaccatttggaaagcttgtctttacacaactagacagaaactcctgagaagtgaaatgattcatacagaccccaataaggattttcatgaccaaactttacttatcaggtttaatcagggtctttgtttttggaaggcttttaattatttggttccaaggtactagttttactctgaatcacttgagtcagtgctttgtagagaagctgcagtgacctcttcccccacgttctttctctctcttgccgtatgtttcacactttcagtgtgtgtaaacatcagagcaaagctgtaggctgaaaactgcagttccaaccctgcaagaatcctttggtgtctcgaaagaggcagagggcatccagccccatctccttccagaggccgtgctgcctcaagcatcagaggctttgtgttctgtggaggggagaccacagacctcgatcttaaaatggaagggcagaaacaagactgtgagccgggatctgggaggggacgtctaatctgaagtgagccatgtctgatgtctgaagccttttggggttcaagatcaatgctgttgctaccctttttcctgcctccctagggggcttttaggcaatggtgtgctggagccagcttgctctggctctcaagggctgattgttaaatcctcaggaactctgcaaactgcttgttaaacacagctattattaaaaattaaattatagaaacctacagtgtaataaattatattaaaacaaagttaataaatacttgaaattcatcaccttccatttttttttactattctccatgttcttgagggtttttttttaaatgtctgggtctctatacagtagatataagaaataatggctagctactgcgcattccctcccaactacatgtttagtgagatcacactgttcacttgacattgaccatgatgacagcgcttacacctcagaaatcggcaaatgctacagatctgggcttttcccccgcaaatgctgattaggcatttacaggcacacgttactttaaggcaaccactgtcaaccagaggaaacagaaagaagtccatcaagtttgtctttctgaacagccatggcagttccaggccaggcatgcagcatgcctgagggcaaggctgtgccctgtgggaaacccttactactgaaagggtttttagttacaaggactttctttggcttgatagctagtttggaggagtttggggccatcacttcatacaagttccttgtcataactgtaccctggcttaccttgacatctggtgtttactccaagctgaggttttagggaagggtagttggaggccagcggcggctcctagtgacagatgggcagagcgtctgctttggcatcatccagggtgtgggcagcagtggtccgagtaggcaccactgacctgcaggcagggaaagcctgccaggtcagccatgcgcttggcatcaggaggagaggatcagagccagcagtggtcacaatgagggcaaaaccctcacagtggaatattgtcacccaaaagggatgggtggctgtagggctttttggatggaagcataaatgagaaaatacacacgtttctgtaaatggacctgtttgggaagacaaggccacagtacacatagttttctagcaatctaaaccttatgtgtcatgatgtagatatttacaggacaagcaagaacaacaaaaccttcagttttgttctccagtataagataattgaagacacttgtggtgaaaagtacttctgtcaccaggaagatagataacagccagcaatcaatgcctttctgttgtacaagttaaaaagtccattaaatccatttttttttcagtgcatacacaagaatacatttggatactcctgcaaattcatatttaagaatagtgtttctcaaatcggttatttgaaagaaactcaaaggaaaaagcagacacttccacaatatgtccttgctctgttgtagtctgtaattgtgaacttttgtaaattgttacaaccctggatgaatgatgggaatataacaggttgtagaattggagaacgttaaatctttgttcctaatggcaaaacatgtttttctcattttcatcagaatgtgtgatccatgccatttgaaatcaaattccaaacacaatgagccattagtgtaatagctcattactaacagcggtcttataaataatacattcttatcatacacatgcagctcgctgtgaagccagcaaaaggtatttcaggccatcgaagttttgttgcgccagcgcggctgtagattagaaggacatctccatgtgaaccaagatggatgccaattttccctgccgagagtcaggctggccgtctctttctgcacatatggtagatggattggttaatcagcgtctgctgagtcttgggcctgaaattacagagaagctagacaactgcggctatgcagcctttgttcacgagtgcaaacaagacaaacaatcacttgttatttgggaaaaaaattaaaatgtttattttggacttttattaaagtgtcaatggctttataaaacagctgtgtaaatccaggctttttcagcaagtatcattttagggggcctgtaaagaaaggaatatacatgaaaaaattaatttttaaaaattcccctcatatttcagtattgagaagaaaatagaggaggtctcacttttattttgcaaacacgtttgagaacaaatgatttttaactgggagacatattcgagaacaaatagtagtttaatacctatttttttttttttttttggtgtcatttaaaaaactgagtattattgtagcccgattctctgttttaggagattaaagcattttctctgactgggcatttatggaaagatgctgcgttcttgggaatagagaatgcctgtgattattgagttctgctactttctgaatgcaatggttatctaaaagtctgaacacttgagagataggacccagtaaatgcaggtttctaataagagctatcagagtctaatcagtcaaccagaatttgcttaaaatctactaataattattttatgtgaaatttaaaggactatgtattttctctctctttttaaattttaaatactttccttgcagaaaacaatgaaatacagaattacttaagggatatattaaggagtttcagtcacagccgtctctccatgtggaatatgatagaattaaagtctgttgttaatttctaatgttttggtaccaatcaggtacctggtacccaaccaaggttcagatcagctagttactcatcttctcgcctatgtattactcatcaaagactgaaaatcatggggacgactgcaagagcttcagaaccaggcatttcagggtgatgggaagttcaacatttgcagatcagacccacctggtgaaccagcctagcctgactcaagtttacttcactggaacattttccaccaaacttccttccctcatatctcctccctatcagactatccagttaataaataagtgacttcaagacaaattgaagagtttctacctgataaggagctagggaccgtgaactttctctgtactgggggctgatcagatgggcactggaacaatgacctgtattcctgagaagtgtgcatggcagagggaaagaaagtagacaggagcgccaggcttatggtggggtacaaacacaagacaccaaatggcagaggatatggagcaggcaggagcatggtctgagcagagggcaagtgttccaatggttgaagggtcaagaactctggcaatttccctgttacttatgcaccactaggtgtgtccccagtggtcacttattgggacattttttgagcatgttttatgtactgaaggaagacacttattcctcccttaaatctcaaggtgactgccaaaccaccagccgaccacattctgagggctctggaggtttcctgatgagaatcatttgacctctgataaagtaatgaagtgttttggactgggtgtggtggctcatgcctgtaatcccagcactttgggaggccgaggtgggtggatcacttgaggtcaggagttcaagaccagcctggccaacatggtgaaactccgtctctactaaaaatgcaaaaattagctgggtgtggtggcgggcgcctgcagtcccagctctgcgggaggctggggagaagaattgcttgaactgaggaggcggaggttgcggtgagccaagatacaccactgcactccagcctgggtgacagagcgagactttgtctcaaaaaaaaaaaaaaaaaaagaataatgaggtgttttggatatttcaggtggaaggcacagctgttgggttcatgagtgtgtgctcaagagtgaacatgcaactgctgcatgagtgctttgacttgggccctttccacggactctgtttcccacatcctgatgacgttctggaatcaccacaagacctaagtgtccgaagaagtcaaggtacagtggctatcacagggacacactgggaaattaaatctatgctttatacacattgcgctcttcgctaagtgatggaactagataggatgctttatatttccttccccagttccccttaaggagtagttcccatggttggtcacatccttgtgaaatacctacaagcacagatagtcacagtgcaggggtggagttagacatagtggacttggggccttagggctcccacattcaggatgctcacttcttgaatgttcattgctagagtacatgtaagttatgatgaaataattactggtgtttcaggtttcacacacacacacacacacacacacacaaccaaatacaacaagtgaatttttcaaatcaagaactcaggaaattttttatgcttttaagttttaatcccaactttcagtgcttctgtttttgtctttgacaaatcattatgtagtataggtctgttgcaagtagtcatttttaacttgcttaagttacttctagttatatgaaataataccatcaattttaaaatattgtctgtatcaagattttcaccacgttcaattaggtaacctcaaactttgatgttttaatttagtgaggtcttactgtatccatgggtatctttgcggttacatatttgggttcttacagaagacagatgcagacaggcaagttaccatgggtacatcaattcacttctccaaagctggatttcttcatttgtaaaatgggcataatagtaatacctcccacacggggggggggttgtgaagtttcactgagataagccatgtagagtgctttgcacagtcaacactcaataaatgttgatcatcaccgttagcaattattttttctttgtgtcggccttccaccaacttgaatcttcctagggtaaaatcagggtatttcaaattgctatgctttctcctgtctgaaagattacaccaagattgttcagaaatggggaaaggagcacttggctggtggcaaaggacttgccaatctagacaacagaaggcagtgacttggctaagcttatcccctgaatgcataaaccccgtgcacagtgtctagacctcatctgaacatacacacttatcacagagaacctgcaaagccacagatagaggagtttcccttttgtgctgatgataacaacaccctccccaaaagagatttggggtccttattgtttaatagtgaagccttgcttgccatgcttcccagagaagaactctaccataggagagttctgagggaacttatcagtgtgagacagtctggaaccataagttgtcattgttattttccaatgcttaaattcttctttgaaagcagcactaaatggcctttttttttttttgagatggaatttaactcttgtcacccaggctggagtgcaatggtgtgatcttggctcactgcaacctctgcctccagggttcaagtgattctcctgtctcagcctctggagtagctgggattacaggtgtgcgccaccacgcccagctaatttttgtatttttagtagacacagggtttcaccatgttggccaggctggtcttgaactcctgacctcaggtgatttacctgcctcagcctcccaaagtgctgggattacaggtgtgagccactgcacttggccctaaatagcctttttatggctgaatattctcacatgtaaaatggagataaaaatagtatctaacccaaagaattgaggggacaattaaatgttagaatctatgtgttgtgcttagctcagcgccaaacacaaagtaagtcctgaacatttaaaaatattttttcccctgtggctgttgtaatgaagaacaagttgaaaagatgtagtcccttccagtgtgtttctgagtggctctgatgctactgtttcctacatagaatgaatggaaaattccttagaaactttatggggcagtgaaattcaaaatttaaactgaaccctggacttaaaaacatacgtaagctagtatatctctagcaagagcccacagagatatgggcactaaaagaagtcctacttctgtttacctccttcaatatttttacctaaaataagtcaatctaggacagatggtaagtaaaagaaataggaaaacttatcttctgtgccttgtttatttttgaaagtcagctttatgttcattgacacaaagatgattccttatgaaattttcaccagggagctggcattgtagacttccacataacttccagggattgagtcacaaatcatcaacagctcattatatctaagaaaagagtcatcagcacattttgctgccatcttcctatcaacaacaacaaagaatgaggctccagagaaaattctaaatgtactgtgatctgttactttcctttcctgatgaaagtctcaagttaaaggaaatataatttctctaaaatatgaactaaaattcttgtttcaaatgagcacacatcactgtgtctcatatcttgtattttgtttagtgcttttttccatttcaaaggatttttatatatgtaatctcatgttatcctataacttggtgtaggagagctagggaaggtgaggttctctccattttttacttgctaaagctcatccaagcttttaaagctcatcagtggctgacccagaaggcagacccagcctctctctgctttcgtgcatgatgatagtcttggcaaggtaacgtcttatcttggatggttttgacagaaaactccaatgacgggtctgctacacaagatacatgatgagttttttcactttatttttattttttatttttattattgttatttttttgagatgaaggcccccctctgtcacccaggttggagtacagtggtgcaatctcagctcattgcaacctctgcctcccgggttcaggtgagtctcctgcctcagcctccccagtagctgagattacatgtgtgtgccaccacacccagctaattttttttgtatttttagtagagacagagttcatcatgttggccaggctggtcttgaactccgggcctcaggtgatccgcccacctcggcttcccaaagtgctgggattacaggagtaagccaccatgcccggccagttttttcactttaataagttatttaatgaatgatcacttcagtgggtgatcagtgacctgcccatatccctccgacttttattttgtatgtgtgtgctccaaacaactcctatctgctggaatcttcacctctgtgtctgcaggcttttttaaaactgtgaaaggccactctgacctatgcaggggtcaggctggaagtgtcaggaaattatcactcaaggaatagactctgtttccctatgtcacatcccagcttccctgctggtgctttctccattgactcccaaataaatggttgtaactgaatctttaacttaagatttgcctctgaggcaagtgagaccaagacactactagttaggtcttttcctaccagctgtgaaagcatttatttatacacagctgacttgggtgagagtataaataccccagctccctcactcctcaggtgggaggactcagatatgtgagtattggctggtttcccagagttcccccaagggattaagtttcagttgtccataatagtaatctgggtgataacacatgtgttgttgttttttaacttttaagttcaggggtacatgagaaggtttgttacataggtaaacttgtgtcatgtgggtttgttgtacagattatggcatcacccaggtattaagcctagtacccattagttacttttcctgatcctctccctcctcccaccctccaccctcaaaaggccccagtgtgtgttgttcccctttatgtgtccatggacaacacacattttattagttgcctttccttccctgtctctttcctcactctcctactggtacatcctggaaccacctccaaaataaactgcttattctcaagctcttctctcaagatctgatctttccctgccagctgtgaaaacttgcaatttcacaccaacctcaaccctttcaagcagaataatgtcaagactcagcattcttaaatgaatccagaggccctcctttttctagctcctaatacacatggtaattagcttactgtccttcatcatctcagccttatcaaaagtttccctggaggtctggctggtgttaacagaaaggagggcagagctggtgtggctgaccatggagaaagctgacttggctggtgtggtgcagagaagccagcttgtttatgtgcttattccatgactgcttgtcctgagcagaaagtgcttttcaggatctatttttggaggtttattaagtatgttctcaattccaacagtttaatgaagatctaaataaaatgctaggttctaccttaaaaaaaaagtttccctgaatctaaaatgtttaactgtgtacaatcaatttgtgttttacctgaataatttgtgtatgttttcatagctacccattttgcatgtataacctattacatacttgtaaactttggtttttatgtactaaacattgggagtaaactgggaccaatgggaataggttctaaggatgtaaattttgtccaagcataaggaaaaactagtagaagtgtattttttttatttaatggaggacctagtgtggaagtagcaagttcccagaatattggaagaattcataaagaaacagtcatacacacttacaaagggctttctgcttgtgtggaagattatactgaatgagatgtaagatccccttaaatgctaaaaaaaacttattgaatacatatcaagatgttccatatgcctggcactttatgaatattttccttcagtgacaataaaatggttcaaaacaatattttttccagttggccgcagcactggccctgcctggtgtttgcaaatcaagctgtgtcttttgttagctgcatcacccaataaatattttggaatcaagcttgagctggcaattttcttgataatgcataaggcaaaatagggcacaacctgcatttccacagctgtactggcattgccgcatttaatagttaaaataaaaaaataaaaacaagcaaaaaacaaaacttttgttcctcatgtaggccgttgagatctgggcagcatgaatctctgttttaaaagactcctgcaaggttccgatttgtaaatctcattatatacccagggcccaccttacaaagtctctgcagaacttgatgtgctccttggcagggagagatttcactttacataatagagttatgggcattcaaaagaataactagtgtagccccttgtcaccaagtcatccaggaaaactgttgctcactatacatataaaagacccttcaaaatagaatttttgtaatgtctccacgtaaaacatcgcaatattgcctttaactttttttttttaaattactcctgctgtcaggaaatgtctttatatgtcttatttcaattttatgtcttgttttattgaactcacatttgcttcttatctcagattccctcatctcttgggttaggaaacacctagacccactctccctgtgtcggagctaaaaaacaatggctacattaagtcttattgattgtgtattaaatcatcccaggtcttttcgcctctcttcctaaggttccattttatattcctggattcccttctattttactttattcttcttttaacatggattccaaacaggactggagcacgtatctacagggtgtgttaggatttctgctgccgtctttacattacagatctcggaaccttgtttttaacagtcagttcattctgtagttaaccagtgacccaccaggacttagtctgccagggctgccataacaaagtgccacagactgggtggcttaaaaaacagaaattgattttctcacatttgtgaggccagaagtcaagatgttggaggggtcagtttcttttgaggcctccctccttgacttgtagacggccatcttctccccatgtcttcacagggtcttccctctgtgcccatcagtgtttttggtttttctttttataaggacaccagtcacaatgcattagggctcacctgtaactttaactcagttacctctttaaagactgtctgcaaatacagtcccattctgaggtactaggggttaagccttcagtgtacgagttttgggggtgggaggaggcacactacagcccaggagaggctctatggtatcgtactgccttcctctggtccctaataggggggcggtatgtgttcagggtggggaatgtttggatgtctacatcctctcataagcccatgttcttcccctggctggatgtaagccgcacccacccaaccttctgtgcccgaggaaagtccctgtgtcccaccaatgggcttctcattgttcctggcatgggtttcagatccccctaggagaggagttctgttcttacaggcttctgtgccctggtcacctccacttcccaggaggctagggtgagttctggggcccattatagctctcactcagtggccacacagcaatattactcacttggtagcagttgccaccaaatttgccattttctcattgtgatctgggctttgagcatctcagttctccctcctccccttttctttccttctcctagatcctgtggtgtggttctttgatgcctgtactcaaggctctgatagtaatgcagacagtggcagcaaagtcggctttacttaatgttcatacatagccctaatatactaacttatacttgttaaaatttgaattatttatttatttatttttattgttttgagacggagtctcgctctgtcgcccaggctggagtgcagtggtgcaatctcggctcactgaaagctccgcctcccaggttcacaccattctcctgcctcagcctcccgagtagctgggactacaggcgcctgccaccatgcccggctaatttttttgagttttttttttttagtagagatggggtttcactgtgttagccaggatggtctcgatctcctgaccttgtgatccgcccacctcagcctcccaaagtgctgggattacaggcatgatgaatttcatttttttaagccactgaatgtctttagcatatgaaggcaacatcttcgaaagctttagctactcttgcctatatatatatatatatatatatatatatatatatatatatatatatataaaatttgattttctagaatctactttgttaattctaaagctttgcaagagatgttgataaaacaaataaatcataccagacctatacccaggcatctccaatgttgagagtttagactctttcagggctttcagggcagagcccctggactggtaggataccaggaagactgtaatccagacctgaagcccagaacttgttgtcagggacatgaccccaaagccatcttggtgagccttttggttatttcataaaacctgttgtcaattctccatcttaattccaaagctgatttctaagccttttctaatgtcttcaaaaacaaccatagcatcaaaggatggcaaccacttaagaatctattattttgcagacagcaacatgactgagatctgcattcctcctttcctcttcagccctgggagcgacctgtgatatcacagccttgttctccaacagtcagattcatttcacaatggtggaaatacaagcgcatttttgtatggggcctggaggtcttcagaagaaaagtggctttatttatattcgttatgatcattatgtgctgggattattttctcagtaggggatgtctcttttgcccatatttatgaagcaggggagaaggcatttaatgaagttcaagagtgtatttgactgtaaaacacatctcagtacattcacatgtaaataacccttttatttgttctctctggtgacctttttcctgttggggtagatcacagtttgttgttgttttccattttcagatggaaggctgaaagataataacgaaagattatgcaaaaaaaatccgtgtttaaaataatgttgatatgccacttgtgttgcaggataattatagtaatttggctattacgctatatggagtcagcagttagttgctagaaaacacggtgataggggtgattcaagggattttcatcccaactgggtgtttgatcctgctgacttttctcttgaaaatcaattgcttgcactgaatactttgaattcccccttgattaaattggccatcagtgggtcacacccattgcactgaggtcactgtgagttctgtttacaaagagtttttgatgattcttaaaatatcatggaccaaatttaatctgagccaagcggctaaggaagcaattactgaaaagcacagtttttgcacatggcaacaaacaaaggaaaatttattaattctgaagctcaacatgaagccagttatttgactactgggtcagaggccttctctccactgcattttgcttggactttcggtattttcagacctccatggacagataggctcactcagtagaagacctggtagaggcatcttggaagcatctttgacaacttttccatttctcctcaaggtagttaatagattcaggttttctatttcctttgaatcaattttggaaataagattattctagaaaagcttaatttagtatatgaagatgaaaaattagcatacagtagtggagatatatataggagtatatgtataatatatgtgtgtatatatgtatccaactctgtggaaaaatacttaaaaaaattttttttctttttttcagagacaaggtctcattttgttgcccaggctggggtacagtggtgcaagtatggctcactgcagccttgaactctttctgggctcaagtgatcctcctacttcagcttcctgagtagctggactataggtatgtgccaccataccttgctaatttttacatttttttggagacagggtttcgttttgttgccaggctggtcttgaattcctggctttaagcaatcttcctgccttggcctcccaaagtgctggaattgcagggatgagcaaccacacccagcctgtcttttttattgagtactgatttaagtctacatgaaatattctaaaataaagagaaaagcaaatcacaaaagtagttatataaaaatattattcataataaatgtgggaaaatattaaacttccctaaaactgaaatgcacattaaaacccaagatctttttctcccccattttgcctactaaattgtaaatatgcattgtaattaaaacacttagctctgggcaagaagcactgtaatgagcactcagattttctgatgctctgaaggttgactgatataacattctggagtacaatttagtcatggttatcacagaatgcattagatgttcatgttctttgacttcaactatagcaaatttgaggaaataatactaatactataaaaagatccatatgcaagaatttcactaagcttaatcataatactaaaaatgaacaaacaaaaaatatccaaataaacaaatgtaaaaaccccaagtctcccacaaggagatggctaaacttgtgaatatcccttagatagatatgcagaagcctttaagaagaaggttacaaatagtgaggggaaatggttcagatataatctcaggtgaaaaaaaaatcaatgcaaaatgaattgcagtatcagtaaagtcacctaataaaacacatgttatgaagagtacagggaggcaatgaactaaaatgacaaaagggctggagtcatagaagtggcaatagagcaacgcttttatttcctccctatattttttaaaatgtggaaactattaaatctacagaaaagttgcagatacgtttttttcttcctaatccatgtcaacgtaagttgccaacatgaagttgttggagcaccttggaatacttttgtatgtatttgctataaagagggacattctcctttgcaacctcaaacatccactgatatcaggaaattaacatgaatatgttactacaatttaatccacaatccaaagacaccagttacatttcttcatttgtcctgaggatgtcctttgtggcaaaagaatccagtccaggataacaaactgcagttacttgtcatattgtctttcaatgtggaacagttgctcagtctttccctgctttttatgacctagcccataattttgtagaacgtaatttatttttgtttgtttgatgtttattcatggtgagagtcatgtcatgcatgtggaactctgggctctcagtccatcctatctggtgtgatacattttcagtctgccctgttactgatgatgatgtgtgtcactttgatcacttgactaaagtgactcttttaggtaaaaattaaaattattttcacttatcccagtctgtgcagaagtctgtaataatgtctttcttcctgaactctgtattagctctaccctgattttcacttggaatcaactgatcctgttttactccttgcttggggtttcatctttgcaccacccagcatcccaccacaggtacttgaggctgttgagctctccttgggtaaatgatgctcttggttgttccatacgtcagtccttctatgcttgagctggtgtcagcctctggtaattgctgtgcgtggtccatttcaggcagatggctcctgacttactttgtagccagaatagacttcagcaaggcagactcccttccccctctaactagggtgctcacaaacgacatggacccagctcccaagtgctcggtctaaagctttacctacaatttattctctcctgtagctgtgattatatctctttcttcttaaagtcatctttgctttttactctgtcttgtcttttaattaggttttcctgtttggtcttttcaaagagctagctcttaatctatcaagtctatgggtttctttttgaatttattaatatctgctttcattttgtgacctctttctcctgatttctttgaatgtgttttgttcttcctattctaattgtctaattgcctgattcattcttttttttttttttgagacggagtctcgctcttgttgcccaggctggagtgcaatggcgcaatctcggctcactgcaacctccgcctcccaggttcaagtgattctcctgtctcagcctccctagtagctgggatcgcaggcatgcactaccatgcctggctaatttttggtatttttagtagagacggggtttcaccgtgttggccaggctggtctcgaactcctaacctcaggtgatccacttgcctaggcttccttgttttaaaataaaagcacttcttgggaagacaaagttttgctctaccaacttaggtccaagcgggtgggggcctgcaaattgaccaacagattaacaggagaaaaaagtattatatataaaataatatataatactatgtataaactggtttggtggttgttaagctcttcatttcccccatttgaaacttctcaaaaacattcacaaacaaggagcagggttgattgctatggagagaagactagggctacaagttccaaggaaagaaatctgcaaaaggagacagcaacatagattagaatgcggaaacaaaaataaaaatcaagattaatatctggagcaactatcaacctagtttctgagaccaaagggcatccagtcaaaaagacttttaaacattgggtttgaagcgtttctagacaggggagtgagcatggtattggcaaactgacagatttcccagtttgcagtttgaaggttgttggtgatggcgtagatagcaaatcactataaccacggtcatggctgtttcctggagcgcagcatagaagatgagtgttatagtgagcttcctgagtggcccacacagcagcagctccaagcacgaggcccatactcacacttgatctattgtgatgatgactattttgaagttcatgtcaagccatctagcttcagctcacagggcttcttaagaccttggagggaaaggggcaaaacaagacaacctagagtctcaaggttccgggcagtcagatttttcagtgatgccaagtcaggaggatgggagaaaatttggaaacattaattactggcaacatgtgtaagatagcaggattcagtttacaaaaaggtagaaatggctcagaggtaatgagcaggattagaatctgataactcacatgagcagattatagttttccattgaaatatagaatttataatcaccccaattttgatcaaagataataaaattaatattattttgtttgtaaaataaatctagtttcattaaatttggtttgattatttatatgaatacttcaaaaatggtaacagaccacattaaagtttgctttgctgaactgagattaggaatctcaaactggacttttaaaagcctgctgggactaggaagtcaggccaagaacttgctaccggatttcacctataatgcctatagatttggatggattccttttctcaaggtcccccaaatatcctaagattcctgggcctgccgggaagtagccttactaactcacctccaaggctgggaaccctgaatgcaggcaccagtatgctttttccaagagggctttgtaagcataggctccataaagtcaaccttatttccttaaagctatcattctcaaatgacattccaatctaatccttggtcataaccagttatgtcttgttacaaggaggacagattctcattgaaactatgcaaacaactatattgccatgaaaatggggacactcaataagagttttggaactctggagggatcaggcagggagaaaaataagatatttcatttctgtttacaaaagcataatgtacgaaattgttgtaagttatagatagctcacaaagaaaagagagacgggttccttaaatccaggataaaattttaaacaaagccataattttattcatcagttcatttagtccaatgtaattaattcttgttctgcttgatctaaggttagtagttttttatgaatcccccagcttctccactagagttttggaatatatgatataatctcaaagttatttatgcaataccttcagaagcctgcaccctagagtacttggcatattccttttccatgggtttccttttgttgaaaacaagtattatagcttattatagcttctagaaaaacttcagaataaaacaataactatccaggataagaagagacttaaatggtgtgattaatgatctgatgagagttcactataaaaatagcaaaattgatgaggaaatttggttgtttctgtggcatagaacttctaaaataaaaactggaattatgactataatattatgctattgttgtctaatatcaggcaaagcaataccagcacacatcatagcgtgggcattgacaaatttctaggaacttcatatacttcctgaaatatttatattcataacatttacataaaatatgtgtaaaaatataaccttgggaaagttatctcttcttacttgacaaagcttttcatgcatttcaacatatctaattttattttattttattttttcatttttccatcactccctatcctaattaatttttgatatctctttttttaataaggtaaaataacaaatcctttgagattttccaggggctttctggaaagtcaggaatttatagcagctgaacttgaacttccaggataaaagggtcatcattcttctcccacactgtaaactcctttgtgggggtgagggagtcaatggaagccgtattttcaggaggctctgcttaagtttaatgtttctttctgtggctgctgattgttcgaatgttttcagtttaaaataatcttcaaccattttggtgggctgttcatcacttcacatttaaagccatgcatcttccactcagtattgccttgtctttatcccataagctattaccaagtgatattgatattaacatccttattctcattgtagttattttatgaatatctgtggttgtgattttaatcttctcttttatctgaaattttttagggaagtggtttgattttcattgggtgtgattattgtgtgtgcttgtcctcttgtctttaatttctaaatttttgcattgtggttagaaaatatgacctgtgtaatttctacttttgttttaaattaagatcttttattacagcctcatataggatcagtttcatagatgtccatggactttcaaagagaatgtgcattctctgtttataaggctcaaacttatgtatagtgtggttaaatatagcttactatgatattcaaatcttccataacttcattattgttgacatggtctatcttattctgagaaagtaaaatttcccagttcactgtggtcttatcttctccacttatcactgcatttgtaaaacttttgctttatgtatttagatactgtgctctttggtacctgcagtttcatgacaatgaggttatacttgtggatatcttttatcaatacaaaataagtatcttcgctccatctaatatgtttagctttgaattacatttaatctgatataatatttccattcctaggcccacactgtaccacaataaattttatagtgaagtgttctaagcaatgtcctccaagtcttgggcatagataattttgacatgggacaatgaagaatggatcttagacaactttactcaagtctcctgccccatgttgttttgccttttacatttagatctaccacccacacgtaatcgattttcacatatggtgtgatatagaaatcacattttatttttaaaaatatgaatatccaattgactaagtaccatttattgaaaaggtcattctttccccctattgcagtaccacctgtgtcacagattaaatgtccatatatgtgtacatttgttttgggattctctgttctatttgtcaacaatacactgtcttaattaccatagacttatgataaatcttgatactggcagagtaagtctttccaccttgttttttaagattatcctttttattcttagttgtctaatttttccacataaacatgagagctcaaaaaaaaaaaaaaaaaaaagcctgggtgccatggctcatgcctgtaattccagcactctgggaggccaaggcaggcagattgctagagctgaggagttcgagaccaccctgggcaacatggtgaaatcctgtctctacaaaaagtgcaaaaaattagccaggcatggtgacatgtgcctgtggtcccagctactcaggaggctgaggtgggaggatcacctaaccctgggaggtggaggttgcagtgagccaagatcacaccactgcactccagcctgagcagcagagtgaggccctgtctctaaaattaaattaaattttaaaataatcattttggggatcttgaatgggattgcttcaaatttatagatcagtttgctagtggggaaactgacatttttataatatattaagcctcctaatctctgaatgtggtatagcccacaatttatttattgaaggataattaagtgtcttagtttcctcctataatgttttatagatttttatagagaggcttcgcatatctgttgttagatttattcctagatatttgatatttttacactattgtaaatatcttttaaaaatcatttttcaaattgttcatggctgttatgttgtagtggaatgggcttttgtatattgattgaccttatgtctggcaacctttctacacagacttactaattctaagatttatctgtatattattttgtatttctctatataatgtaaatttttgttctttactttccaaactttataatttaaatttgtttatctactggctaataccttaaatagaaatggcattaacaggcatccttttgttgatctcagaattaactgaaaagttttcagtatttcatcattaaggataactttgtgaatactcattatcaggtcaaggaagtgtctgtatttctgatttgctaagagttttattaggaatggtttgtttgttttaattgaattgaattttataaaatgtttttttctgtgtttcctgaaatgatcatatgattcttctctattctgttgaagagatgaattacattgattgacttttttatgtatttattttgttaatttcaatttagtcttgatatacaattctttatatgcagtgctggattttgtttgctaatgttttgtttaggatttttgcacctatattcatgagtgagattggcctgcaactttcacttcttgaaatgtccttccttgccagactttggaaatgaagtcatgctggtctcataaaacaagttgaagagtattctctcttctattcatttcaagtttattactgagtttattttaaaagttagtttattacttccaaagaatagaagagaaatacttttaaagtacatgtgataatatattcatataatttctaaagatcaaatcagtgtaattgggatattcatcaccttaaatatttgtctcttctttgtgctggaaacattgaaattattctcttctagctattttgaaatatataatagattattataaactataggcaccctattgagctatcaaacactaggtcttatttcttctattaaattatatatttctacccattacaaattttcctctcctccccaccccactccactgttcttcctggtctctggtaaccaccaatctactctccaccttcatagatccatttttttagctcccatatatgagtgagaatatgtgatatttgtctttctatgcttagcttatttcacttagcataatgggggcatccaattctatccatgttgttgcaaatgacaggattttactttttaatggctgaacaatattcgattgtgtatatataccacatttgctttatccattcatccattgatggagacttagcttgattccatattttggctattgcgaatagtgctgcaataaacatggaagtgcagatagctcttcagtgtactgatttgatttcttttgaatatatacctagcactgagattgctggatcatatggtagttgtagttttttagttttttgaggaaactccatatagttttccatagtgattgtactaatttacattcctacaaacatatgtatatgtttgggttccccttctctacattctcaccatcatctgatacttttttgataagcaccattttaactgggatgagatgttatctcattgtggttttgatttgcatctctgtgatgattagtgatgttgagcattttttcatgtacctgttgtccattcatatgtcttcttttgagaaatgtctattcagatcttttgtccatttttaatgagtttttttgctattgaattatttgagctccttatattctggttattaaacccttgtcagatgggtagttagcaaataatttctcccatcctgtggattgtcttttcactttgttgattgtctcctttgccgcgcagaaactttttaactcgacgtaatgccgcttttgtctatttttgctttggttgcctgtgcttttgaggtcttacacaaaaaatccttgtccagaccaatgtcctggagtgtttccccaatgttttcttctagtagtttcattgtgtcaggtcttagatttaagattttcatccatttttattttatttttgtgtatggtgagaggtagggatctagtttcattcttctacatggttgtaaactgtagtcaccctactgatctatcaaacactgggtcatacttcttctattaaactgtatgtttgtacccatcaatcaacttctctttctctcccccacccctctactcttcctgacctctagtaaccagcagtctattctctatcttcatgagatccacttttttagtttccacatgtgagtgagaacatttgatacttgttttttttcacatttgttatactcctgggctgaagtgatatataggtatgtaacactgtgcccagatggtgaataatatttttaatgtgttgttgaatttggcttgctagtattttgctgaggacttttgtatccagttttcccagcaccatttattgatgagactttcctttccccgctttgttattgatgccttcgtcaaaaataaattggctgtagccaggcacagtggctcacacctgtaattccagcacttttggaggccgaggtgggtggatcacttgagttcaggagttcgagaccagcctggtgaacatggttctactaaaaatacaaaattagccaggtatagtggcacacgcctgtagtaccagctacttgggaggctgaggcaggacaatcacttgaaaccagagggtggatattgcagtgagttgagatcgtgccactgcactccagcctgggcaacagagtgagactccatctcaaaaaataaattaataagttaaaaataaataaataaataaataaataggctataaatgcatggatttatgtctgagttctctattctgttccattggtctatgtgtctgctttttacaccagtaccatgctaatttggttactatctctttgtagtacattttaaagtcaggtagtgtgatgcctctagctttgttctttttgcttatgattgctttgggtattcagggtctttgtggttttgtataaattttagcattgttttttctgtttctatgaagaatgtcattagtattttgataagcctttctttgaatctataaattgctttgggtattactgtcgttttaacgatattcttctaatgcatgaccatggattatctttccatttttgtatgtatgtgtcctcttcaattttttttatcagtgtgttttagttttcctaatataggtctttcatttctttggtgaaattgattcctaggtattttatattttttatagctattgtaaatgggattgctttcttgatctctttttcagattgtttactgttggtgataaaatactactgatttttgtattttagttttgtatcctgcaactttactgaatttatttattagttctgacagatttttggtggggtctttaggtttttctaagtataagatcacgttgtctgtgaacaaaacaaatttgacatcttccttttcaatttggatgccctttctttctcttgcctaattcttctgtccagaattcctagtattatgttgaataaaagtgatgaaagtgtgcatccttgtcttgttctagatcttagaggaaagtcttgcaactttttttcatttagtatgatgttagctgtgagtttgtcatatatggtcttcattattttgaggtatgtttctttctttctttctttctttctttctttctttctttctttctttctttcttttctttctttctgtctctctctctgtctttcttcttcttttttttttttttaaacagggtttcacccttgttgcccagactggagtgcaatggcatggtctcggttcactaacacctccacctcccaggttcaagcagttctcctgcttcagcctcccaagtagctgggattacaggtgcctgccaccactcctggctaatttttgtatttttagtagagatggggtttcaccatgttggccaggttggtctcgaactcctgacctcaggtgatctgcccgccttggcttcccaaagtgctgggattacaggtgtgaaccactgtgcccagtgttttgaggtatgttccttctgtactcattttgttgaaggtttttatcataaagggatgctgacttttattgcatgctttttcagcatctcttgaaatgatcacatagtttttgttcttggttttgttaatgggatgtatcacatttattgatttgtgtacattgaaccatccttgcatccctgaaatgaatcccatttgatcttggggaataatttttttttttttgagacagaattttgcaatgtttcccaggttggtcttgaactcttgagctcaagtgatccccctggctcagtctcccagtagctgatactgtaggtatgtaacattgtgcccgactggtgaatgatatctttaatgtgttatggaatttggtttgctagtgttttgttgaaatttttgtgtctatgttcttcagtggtattggcctgtagttttctttttttgttctgttcttatctggttttgatattacagtaatgctgtcctcatacaatgagtttagaagtattccctcctcttcaatttttttgaagagttacagtaaaattagtattcgttctttaaatgtttggtagaattcatagtgaaaccatcaggtcctgggcttttccttgatcgtagactttttattatggcttcgattttgttattcattattggtttgttgaagttttctatttctttgttgttcaatcttggtaggttgtatagtcaaggaatttatcaattttctctaggttttccaatttgttggtgtgtaattgttcataatattctcgaatgatcctttgtatttttgtggtcttagttgttatatttccttgtatgtttctgattttatttgagtcttttctctctttttcttagtctagctaaaggtttgtctatttttgtacctttcaaaaaccaatttttcattttgtctatcttctatattttttggtctcaatttcatttatttctactctgatctttgttttggctatgaagaaatgatttttttttaaacttttaagttcaggggtacatgtgtaggtttgttacataggtaaactcatgtcatgggggtttgttggacagcttatttcatcacccaggtattaagccagtacccatgagttatttttcctgatcccttccctccttttaccctccaccatccagtaggccccactgtctgttgttcccctgtatgtgtccatgtgttctcatcatttagctcccacttatgagtgagaacatggagtatttggttttctgttcctatgtttgtttggtaaggataacggcatccagctccatgttcctgcaaaggctgcatagtattccatggtgtatatgtatcacattgtctttatccagtctaccattgatgggcatttaggttgagtttatgtctttgcttttatgaatagtgcttcagtgaatatactgtgcatgtgtctttatgatagaacaatttatattcctttggttaaatactcagtaatgagatttttgctcccatctttatttcatttcttccactaattttgtgttttgtttgctcttgcttttctagtttcttgaggtacatcgttaagttgtttatttgaagacttcctacttttctgatgtgggcttttattgctatgaactttcctgttagtactgcttttgctgtatctcatggattttggtatgttgtatttccattttcatttgtttcaagaaatttttaaatttccatctgaatttcttcattgactcattgaaaatgattgtttaatttctatgttttgtgtattttttgaggtttctctttttattgatttctagttttattccattgtggtcagaagaaatacttgatatgatttctacttttttgaatttgttgagacttcttttgtggcctaagattctggagaatctattctggagaatgtttcatgtgctgttgaaaacaatgtgtattctgcagcagctggttgaaatgttctgtaaatgtcagttaggtctgtttggtcttgtgtgtagtttaaatctgctgtgtctttgttgattttctgtctagataatctgtctactactgagagtggagtgttgaagcccttactactattacgttgcagtctatctctcccttcacatttattaatatttgctttgtatactcgaatactctagtgttgagttcatagatatttataattgttatatcctgttgatggattgactcctttatcagtatatagtgatcttctttgtcttttttagaagtctttgtagtcaatttcatctgatattaatatagctactactgctcttttttggttttcagttgcatggaatatatttttccacttccattttcagtttatgtgtgtcttaataggtgaaataggtttcttgtaggcagcatatagttgggtcttgcttctttatctattcatttgctctatgtcttttatttttactttttttttttttttttttttgagacagggtctccctctgtcacccaggctggagtgcggtggcaccatctcggctcagtgtagctcgacctttcaggctcaagcaatcctcccacctcaacctcctgagtagctgggactacaggcacatgccactgcaactggctaattttttttttatttttagtagagatggggttttgccacattgtccaggctggtcttgagctcctgaacacaagcaatttgcctgagtcagcctcccaaagtgctgggattataggtgtgagctgccgtgctcaacactctatgtcttttaattagagaattgacttcatttaaattcattgttattaatgataagtaaggattttatttttagtttttaaaatttttaaatatatttttggagacagggtcttgctctgtcactcaggctggagtgcagtggttcaatcttggcacaccacaacctctacctgccaggttcaagtgattctcgtgcctcggcctcccgagtaactggaattacaggcacatgcccctgtgcccagctaatttttgtattttagttgagatggtgtttcgccatgttggccatgctggtcttgaacttctggcctcaagtgatctgcctgcttcagccttccaaaatgctgggattataggtacaagccactgcacctagctgataagtacaggctttcaactgccattttgttgcttattttctggtggttttgtgactcctcttttcctttcttcctttcttactgttgtcctttatggctaagtggttttctctggtagcatgtttgaattcattgcttcttttttttttttaactttttaaaaatttttccgtaagttattcgggtacaggtggtatttggctacatgagtaagttctttagtggtgatttgtgagattttgttgcacccatcacccaggcagtatacattgtactctatttgtagtcttttatccctcatccccctcccagctttccccccaagtccccaaagtccattgtgtcattcttttttgttgttgttgttgttgttgttgagacagagtctcactctgtcacccaggctggagcgcagtggcacaatcttggctcactgcaacctctgcctccctggttcaagtgattctcctgcctcagcctctcccgagcagctgggactacaggggtgcaccaccacacccagctaatttttgtattttttagcagagatggggtttcaccatattggccaggctggtcttgaactgctgacctcgtgatcttcccgcctcagcctcccaaagtgctgggattataggcataagctatcatgcctggcttgtgtcattcttatgcctttgtgttctcatagcttagctcccacatatcagtgaaaacatatgatatctggtttccattcctgagttacttcacttagaataatagtctctaatctcatccaggtagctgcaaatgctgttaattcattcctctttatggctgagtagtattccatcatatatatcacagtttctttttccactcgttgattgatggcaatttgggttggttccatgattttgcaattgcgaattgtgctgctataaacatgtatgtccaagtgtcttttttgtataatgactattttcctctgggtagatccccagtagtgggattgctggatcaaatggtagttctacttttagttcttcaagaaatgtccacaccgttttccatagaggttgtactagtttacattcccaccagcagtgtagaagtgttccctgatcaccacatccacgccaacatctactgttttttttaatatatttttttattatggccattcttgcaggagtaaggtggtgttgcattgtggttttgatttgcatttccctgatcattagtgatgttgagcattttttcatgtttgttggccaattgtatatcttcttttgagaattatctattcatgtccttagctcactttttgatgggattgtttgttttttttcttactgatttgtttgagttcgttgtagattctggatattagtcctttgtcagatgtacagattgtaaagactttctccctctctgtaggttgtctgtttattctgctaaccgttccttttgccatgcaaaagctctttagtttaattaagtcccaactatttatctttgtttttattgcatttgtttttgggtttttggtgatgaaatccttgcctaagccaatgtctagaagggtttttccagtgttatcttctagaatttttatggtttcaggtcttagatttaagagttggtttttccaaggtgagagatgaggatccagtttcattctcctacatgtggccaggcaattatcccagcaccatttgttgataagggtgtcctttccccactttatgtttttgttttgtcaaagatcagttggctgtatttgggtttatttctgggttctctattctgttccattggtctatgtgccgatttttataccagtatcatgctgttttggtgactctcatgctgttttggtggtgtgatgcctccagacttgttctttttgcttagtcttgctttggctatgcgggctcttttttggttccatatgaattttagaattgtattttctaattctgtgaagaatgatggtggtattttgatggggattgcattgaatctgtagattgcttttggcagcatggtcattttcacaaatattgattctacccatccatgagcatgggatgtgtttccatttgtttgtttcatctgtgatttctttcagcagtgttttgtagtttccttgtagaggccttttgccttcttggttatgtatattcctaagttttttttttttttttttttttgcatgctattataaaaggggttgagttcttaatttgattctccacttagttgctgttggtgtataggagagctactgattttgtacattaatcttgtatccagaaggtttgctgaattcttttatcagttctaggagctttttggaagagtctttagggttttcgaggtaaacaatcatctcattggtaaacagtgacagtttgacttcctctttactgatttggatgccctttatttctttctcttgtctgattgctctggttaggacttccagtgctatgttgaagaggagtggtgagagtgggcatccttgtcttgttccaattctcagagggaatgctttcaacttttccccattcaatatcatgttggctgtgggtttgtcatagatagcttttattacattgaggtatgttccttgtatgctgattttgctgacagttttaatcataaagcgatgctggatttcttcaaatgctttttctgcatctattgagatgattgtttgatttttgtttttaattctgtttatgtggtgtatcacatttattgacttgcatatgataagccatccctgcatccctggtatgaaacccactggatcatggtggattatctttttcatatgttgttggatttagttagctagttttttgttaaggattttggcatctatgttcatcaaggatatcagtctgtagttttcttttttggttatgtcctttcctggttcatccatagaatgaattagggagggttccttctttctctatcttgtggaatagtgtcagaaagattggtaccaattcttctttgaacgtctggaagaattctgctgtgaatctgtctggtcctggacttttttttgttggtaatttttaaattaccatttcaacctcactgcttattattggtctatttagggtatctaattcttcctgatttaagctaggagggttttatctttccaggaatttatctatctcttctaggttttctagtttgtgtgtataaaggtgttcatagtagccttgaatgatcttttgtatttcattggtgtcagctgtaatatctcctgtttcatttcttaatgagattatttgaatattctctcttcttttcttggttaatcttgctaatggtctgtcaattttatttatcttttcaaagaaccatcttattgtttcatttatcttttgtattttttttgtttcaatttcatttagttctgctctgttcttggttatttcctttcttctgctgggtttgggtttggtttgttcttctttctctagttccttgagatgtgaccttagaatgtcagtttgtgctctgtcagtctttttgatgtaggtgtttaaggctatgaacttcctcttagcaccacctttgctgtatctcagaggttttgataggttgtatcattattgtctttcagttcaaagaatttttaaatttccgtcttgatttcatttttgatgcaatgctcattcaggagcagtttatttaatttccacatacttgcatggttttgaaggttccttttggaattgatttacagttttattccactgtggtctgagaggctgcttgatgtaatattaattttcttaaatttattgaagcttgttttatggcctatcatggtctatcttggagaaaggtccatgtgctattgaatagaatgtgcattctgtagttgttggatgaaatgttctgtatgtatctgttaagtccatttgttctaagatataggttaaatccattgcttctttgttgactttttgtcttgatgacctgtccagtgctgtcagtggagaactgaagtcccccactattattgtgttgctgtctatctcattgcttaggtctattagtaattagtaaatttgggacctccagtgttaagtgcatatatgtttaggattgtgatatcttcctgctggacaaggccttttaccattatataatgtccctctttgtctcttttaactgctgttgctttaaagtttgttttgtctgatataagagtagctacccctgcttgcttttggtgtccatttgcatgaaatgccttttcccacccctttactttaggtttatgtgggtccttatgtgtgagtctcctgaaggtagcaggtggttggtgagttcttatcaattctccagttctatatgttttaagcggaacatttaggccatttacatttaatgttagtgttgagatgtgaggtaccattacattcgtaatgttatttgttgtctgtgttccttgtttttgtttttgctttttaacatgtatttttgtataggtcctgtgtgatttatactttaaagaggttctgttttgatgtgtttccagtatttgttttaagatttagatctccttttagcagatcttatagtggaggcttagtagtggcgaattctctcagcattcgtttgtctgaaaaagactgtatctttccttcatatctgatgcttagtttctctggatacgaaatccttggctgataattgttttgtttgaggaggctgaagatagggccccaatcccttctagcttatagggtttctgctgagaaatctgctgttagtctgataggttttcctttataggctatctggtacttttgtctcacagctcttaagattctttccttcatcttaactctagataacctgatgacagtttgcctaggcaatgatctttttgtgttgaatttctcaggtgttctttgtgcttcttgtatttggatgtccaggtctctagcaaggctggggaagttttcctcgatttttcccccaaatatgttttccaaacttttagatttctcttcttcctcaggaatactgattattcttaggtttggtcgtttaacataatcccagacttcttggaggctttgttcatattttattattcttttttctttgtttttgttggattgggttaattcgaagatgttgtctttgaactctgaatttctttcttctgcttgttcaattatgttgctgagacttaccagagcattttgcatttctataagtgtgtccaatttttcctgaatgttttattgttttttctttatgttatctatttccttgaatatttctcccttcacttcttgtatcgttttttggatttccttgcattgggcttcgcctttctctggtgcctccctgataagcttaataactaacctcctgaaatctgtttcaggtaaatcagggatttcttcttggtttggatccattgctggtgaactagtgtgattttttggggttgttaaagagccttgttttgtcatattaccagagttggttttctggttccttcttatttgggtaggctctgtcagagggaaagtctagggctgaaggctgttgttcagattctcttgtcccacagggtgttcctttgatatagtactctcccccttttcctatggatgtggcttcctgtgagctgaactacagtgattgttctctctcttctgggtctagccacccagcaagtctacccagctctgggctggtacggggggttgtctggatagagtcctatgatgtgaaccatctgtgggtctctcagccgtggataccagtgcctgttccggtggaggtgacggttggtggtggggtcggggtgggggttgaaatggactctgtgagagtttttagctttggtggtttaatgctctatttttgtgttggttggcctcctgccaggtggtggatggggccctagaactccccaaattatatgctctttgtcttcagctaccagggtgggtagggaaggaccatcaggtagggggcatggctaggcatgtctgagctcagactgtccttgggtgggtcttgctgcagctgctgtgggagatgggggtgaggttcccaggtaagtggagttgtgtacctaggaggattatggctgcctctggtgagtcatgcaggttgtcagggaagttggggaaagctggcagtcacaggcctcacccagctcccatgcaaaccaaagggccagtctcattcccactgtgccccacccagtagtctgtttccatgtgatgggcgagctaggcttgagaacttgccccaggctgcccacctcccagctgagaaagaaaagggcttggttcttcccccttctgtggagactgcacactggattcatgccctctgcccgagttctggccaggaggcttctcaccaccagttcaaattgttacaaacttcagctgaagatttccttctccccgtggtgtttttccccactcctctggccgcccttctgatggatccctgtggtgccaggcaggaatggcctgcctgggaacccagcgagttcccagggcctttcccactgcttcctctacccctatatttcgctcagctctctaaattgactcagctccaggtaaggtcagaaatttctcccacaaacagacctccagtttctgcagtgggggtatgtatttgggagaggaggatctccctttcccactttcacagttggggcactcacagtatttgggctgtctcccgggttctgcaggaggcagtctgcttccttcagagggtctgcgggtcctttcaagattgctggtttgtttttgccattgatctggagctaaaattcacaatgcaagcctctgcacgctgctttatccatccgagttgaagctgcaatctagtcctgcctcccgtccgccatgatgatccaaactattgcttacttttctgctttttatttttagtgtatctatgataggtttttgcattatagttgccatgaggcctatgaaaaacaccttacagaaataacacattatttttaaaagatgacagcttaccttcgatcacaaaaaataaaatcaaagaaaaatctagaaaaaagctctatactttaactccattccccaagattttgacttttggttatctcaatttacatatttttatactatctatctcttaacaagttgttataactattattataattgttataactattattataatagttataactattattgtttttgacagatttttcttttggacttcatactagagttatgaatagattgcactccccaaggacagtattagaatattttgggtttgtccatgtacttaattttaccagtatgttttataccttcagatgtcttctttttgtacaaatcattggtttcattttctttcagattgaagaactccctttcacatttcttgtaagatgggtctgtttgtcgtgaattctctcaagttttgtttatttgggaaagccttttatctttccttcatatttaaaggacaagtttgctggatacagtattctccaaaggaagttttttaatttcagcaattttgaaaatgtcatctcactcccacctgccctgtatggtttctgtgaagaagtctgttgccagatgaattggagctctgtacttgcttcttttcccttgctgcttttaggatcctctctttattcttgacttttgatcagtttattatatgccttgggggagtcttatttgagtcacatctgtttgatgctctctcatcttcctgtacctggatatttatctctttctcaaattttggaaagttttttttttttttaataaactttctacccctattcttgctcaactccttgaacaccaataattcttagatttgtttttttcaggtaattttctgtatcttatagacagtctttgttggttttcattcttttctcttttttgtcctctgattatgtattttcaaatagcctgtctttgagctcactgattctttcctctgcttgatccattctgctcttgagggcctccagtgaatttttcagtttatttgctacattttcagtagcaaatgtatttgtcagttccaagatagccacttgattttttaaattgttatttcaattattttgttaaatttatctgataaatttatgaattgctcttttgtgttatcttaaagatcactgagtagccgggcgcgatggcttacacctgtaatcacaacactttgggaggccaaggcgggcagatcatgaggtcaggagtttgagaccagcctggccaacatggtgaaaccccgtctctactaaagatacaaaaaattagccgggtgtggtggtacgtgcctgtaatcccagctactcaggaggctgaggcaggagaaccacttgaacctgggaggcagaggttgcagtgagctgagatcatgccattgtacttcagcctgggtgacagggcgagactctgtctcagaaataaaaaaaaaagatcactgagtttccttaaaactgctattttgaattcttgatcatagagctcacatattgccgtcttattagggtcagtcactggctccttgctttatcaatttgagaggaccatagttccatgtttcctgatgtttcttgtggtgtgtgtttatgtcttgcattgaaggacagttcaattgaaggacagttgaagttatttgttccattctccctctggcttgttttttattgggatatttgcttatagattctgtgtaatttacctgctgactttcttttttttccccctgctaggtagctgcctcctttttggcactagatggcactttaagcccaggtttgcatcaattctagcaaacagtcagagtgccacccatcctgaatggaggaggtcccaaagggatatcccagtagtgtgggaaggctagctaggggttcatgcccaggggacctgtggaacaaatctcctacagtgtggtgctgctgaactgccatgctaatttggagtctcctttggttgagttacagagcagaatttccatggctgaggatgatagtcccacctccccactttgtttctggctgtgtttagggatatttctttcttcaagtatacctgatgccttccatgagttgaggcaggaaccgatctcctgccagggaacccaagatagtagggaagctggttgtccacctcaatatcagtttgctgtgtagaaactgtgagttgagggaaattttccatacacttgtactgggcagattgggggaaagtgtgtcatagatacagaagtctgattctcttaccatctactcagtttttacacttctctgtggctctaggaactgtctctttctcatatttgagttctgggatattgctggtaataacctgggtgctgtgtatttgtttttgtttttttgtggatggggagggggagtaaagccagcttgcttctacactgccattttggaacctgaagtttttgtgggaaggtttttaattgcagtttataatttaaattgttatatacctatttgttatatttggtagttcataatttttatatgaatatatacattttctttacattttcaaacgcattaggataaagttgaagccattttcatttttctcttattcaacttttaatgttcaaagtagtaatgttgcctttttcagttttcatgatattgagtatttgtgttcattttctcttcttaaacagtcttactggtggtttatcaattttattagtcttttcaaaaaatcaacttttggcttgtttgatccttctctataatttgttaccaagtttatttcttttctttcctttattagttccccttttgtattcctgggcttatttgatgtttttttaatatatatatattttaagtagactcttaactcattgatttttcagcttttcttccatactaatataagtatttaaactataaatatccttctattcttggtcttagctgcaacccacaagttttggtatgtaactaatgtatgtattatcaatatgtttgaaatttcattttatatattctttgacttacgagttatttaaaatattatttatttattaacatgggaatgttcttgtttttttatttttaattgtggtactctttcaacaaatttttaagtgttcaatgcaaaattgttaactataggtagatgttgtacagcagatctctagaactaacttatcttgtgtaaatgaaaggttatacctatttaatagcaactccccattttcccctcttctcaggctcctagcaactaccattctactctctgcttctattaatttcactattttagataccttataaaagtggaattgtgtattatttgttctgtgcctggcttatttcacataacatagtgtcttcaaatttcatccatattgttatatattgcagattttccttccttttaaaagctgaataataatagtctgttgtatatatatatatgccacattttctttatccatccaggatatcctcgttttttgttttgttttgttttttactaggctttagtttaattgcattgcagtcagagaacctactctgtgtgtttttaattcttccaactttgttaagcatatgttccatttttgtaaggattccttgagtccatggaaatagtgtgaatcccataatttttaggttcagtgttctgtataaatcagtcatatttgctaataatgtcatattttatccttattaatattatcacttttttgagcagttcatgagaggtgtgttaaaatctcctgctttgattatggatttattgactcctactcataggctgtctatcatttttttcattatagattttaagtctatgttatttaaggcataatttttaaattattctatcttccttgaaattttgatcagttatgaagtttccttctttagtgatgtttttgtcttgaagtctactttttctgattttaatatggccacatcagctttctttgatttttacttacatgccatatttttttcctgtccttctatttttaccctttctattttcttatattttagatgtgttgcccataaacagcattgagtttggtaggctttgtttttaatctagtgtcataattattgtcttttaattagagtatttagtccatttacatttaatgttcttatgggtttttatctaccatcttactttctacatgtcctctatattcctgtgtttcatttatggtactatttattggtgttttattctttcttactatcaccagtgatatgttaatttaattggcattttcaaagaatcagcctcaagattttgttgattctattacttcttgcaactgcgtcaataatccgttgccacaataatgctactaacaaacagctacaaaactacagtggcataccacaataagcatgtattgttcatgcatttggtgtcaactaggcagctctgctgatcttggctgagtctactcacatgtcttggagtgttttggctgacaggtgatctagtcaggctttggctctgttgcatgtccctctcatcctttaggaggctatcttgtacaggttctcatggagagggcagaggcacaagagagcaaatggaaacatgcaagacctcagaaggtttaggctttgaactaacacatgccacttgtccaagcaggtcacatgattaaacccagaatcagagtgagagggggccacatgaagcaaagggcctaaatacagggaatatgaagaatcagagtcatcattgcaacccatgttcacacacaaaaagaagaatgctgatgacttttgtcatggtcttctttttcctgacctaaggagacacaaacttcagcttaagattggtctcctgatttgtgatacaatgagaatggggaaatggtatctgttttcctggaggaggctaagaccttatcccaagtctcatctcaagatggtgatttgggaattgtcaacgtattaagctcaagtttattgtactggttggcctggagtctacaccacatcccaggtaggaggagtttcactgaaaattttgagaaaagccctttgtcctttcatgcaacccgcctagtatctttctttgtatcactgtggactttattatcaacctcttgtcattcattcagtcattaaacaaatactgagtgcatcccatatactagactttaggaacatagtctagtatgtagtgagtccagtaccagccaatgacaagataaacatgcaagacaaacaactttacaataacatcattgtcttgaaggataaaagagtgtggtgggaccagagcagaattacacctaagtcatcttgagagcatccacatagacttcatagcctccacatagacttcatagacctcaaagcttttgagtaaaacttcaaagcaaattggagctttctaggtgaataagcagaaagattttcctagcagtgatatcaaagagtgtagaataaggagatattcaagaccatggcttattgggggaaagtacaagttcagtgttgctggagcatcaggtgagggagtggcaggagacaaagcaggacaggagaactgaggccaggcaatcaagaccttgcatgccttgcaagagagtttggattctattctattacatcggtcatatgtgatgatgaaccattggaaatatttaattagaatgcattacatgctcagtttctagttcacaggaagactttacaaaggccactatggcgtccaggaaggagatgaggagggattgaaccagaacaataactatggattagatctgggaggtattttagataattaatggaacttgatattttattggatatggggaaaggagattgtggaaaaggggactatcaaggatgatttcagaaactgggtagatggtggaaccattttgtgaggtgagattaataagagtgaatggattatttgatgaagatgctgagatggtaacaatcatttctgatttggacaggtagagagtttgactttcctagtaagcatttgggtaaatacactgcattcagtcagccacaggtgcctattaaagtagacagaaaaatggcctcactaaagacacccttgtataatctctggaacctgtaaatgtcaccttttttttttttgaaaggtctttgtagttgtgattaaagatcttgagataaggagattatcctggattatctaaggtgccctaaatgctatcacaggcatcctgtgataagggagagacagagggagattataaagacagaaaaggaaaaggcaatgtgattatggaatcagattggaatgatgtaacgagccaaggaatgccaaagccaacagaaactggaagaaacaaggaacagattctcccctagagcctctggagtgagcataggcctgctgacaccttgatttcagcccagggatactgatttccaacttcttatctctagaattgtgagagaataaattcctgttgttttaagccactaagtgagtggtaattttttacagcagcaacaggaaactaacacaattatgaagaagacaaaaggaaatgaggccaaccatggcacaaaaacatgtcaagaaataaggacttactcactcttcagaaagaactccttgaaagaattgtctgtgctcaatgttaattttttgctttttgtttttttgtgtatccattgtatgtttttagatttgagggatgaggcttgcaaataatataacccattattttaaactgatgacaacttaacactgattgcataaacaaacaacaactaacaagcaaaaagaaaactaaaaaactacactttatctcctggcttttttgttgtttctatttatatcttactgtactatgtcttgaaacattatagttattatttttgatcttttcatctttctacttatgagtagtttacataccataattacagtgttataatagtctgtgcttttctgtgtatttactgttaccaatgagttttgtatcttcagatgatttcttattgcttattaatgtccttttctctcagattgaagaactccctttaacatttcttgtaggactggtctggtgttgatgaaataccttttgtttgtctaggaaagtctttattactctttcatgtttgaaggatatttttgccagatatactattctagggtaagagtttttcttcttcagcactttaaatatgttatgccactctttcctggcctgcaaggtatccactgaaaagtctgctgccagacgtattggagctgctttgtgtattatttgtttttttttctcttgctgcttttagggtccctttttttacccttgacctttgggagtttgattattaaatgcctcgaggtagtcttctttgggttaaatctacttggtgtttatacttcttagacttgaatattgatatctttctctaggtttgggacgttctctgttactatccccttgaataaacttgtatccctatctctttctccacctcttctttaagggcaataactcttagatttttccctttgaggctattttctagaccctgtaagcatgcttcattcttttttattcttttttcttttgtctcctctgactgttaactttaaaatagcctgttttcaagctcactaattctttcttttgcttagtcaattctgctattaagagactgatacatttttcattatgtcagttgcatttttcaactccagaatttctgcattatttttaaaattatttcaaattatttgttaagtttatctgataggattcgaattccttctccatgctatctagaatttctttgagttttcctcaaatcagctattttgaattctccatctgaaaggtcctacatctctgtctctctgggattggtccctggtgccttatttagttagtctggcgaagtcatgtttttctggttggatctgatgcatgtggatgtttgtcagtgtctgggcactgaagagttagatatttattgtagtctttgcaatctggacttgtttgtacttttccttcttgggaaggctttccaggtattcaaaggaacttggatgttgtgaactaagtttttggtcactgcatctatatctgcattaggtgggtacacagagcccagtaacattttggttcttgcagacttgtagaggtgccaccttggtggtcttggataagatccagaagaatactctggattaccaggcagagactcttattctcttcctttactttctgtcaaacaaatgaagtctctctctctgtgttgagccacctgaagctgggggaggggtgacacaaagcacccttgtggccaccaccactgtgactgcaaagggtcaaaccttaaggcagcacagccatgggtcttgcccaaggcccactgtaaccactacctacattctctcaaggccctagggctctgcaatcagcaggtgatgaagccatccaggcctatgtccttcccttaagggcaacaagttcccctggccctacagaggtccagagatgctgtctgggagccagagccaggagtaggaaaccttagaaatctatctggtgctctgttctactgcagctggcctgactgtgacagcactaggcaaagtactttccgctcttccctccgtttttcccatgcaaaggagtctctccccatgtccaccaccaccacaggcccacagggagtactaccagggtactactgatgttcactaaaggcccaagggctcttctgtcagcttgtggtgaatgctttcaggcctgggactcatccttcagggcagtgggctcttccactggcctatagtaggtccagagatgccattcaagagccaaagcctggaactggggaccctaagagcctgtttggtgctcttccccactgtggccaagctgacacctaagctcaagacaaagtcccctttactctttcctctgcttttctgaagcagaagtggtctcttctcgtagccactacagctgagaatgtgccggtcacacctgaagtcagcacagctcttagtctcacccaaggcccatggcgagtactacctggctactgctgctgattattcagggcccaggggctctttagtcaccacatgatgaatcctactaggactgggtccttcatgtcaaggcagcagcttcccttccagtccagggtgtgtctaggaatgtcatccaggagccagggcctggaatagggaccttgtgactctgccaggtgccctatccaactgtggctgagctgggatccaagttacaagacaaagtcctcttcactcccctctcctcttttcaagtggaaggaaggagtcggagtctcttttggagctgtgagatgcggtgcctgggattaggggaggggtaacgcaagcactcttttagcagatccagctggtgttttactagctcgcatgtcccctaagtccggtagctcagtcctcgtggcctagacagcctttcaagtttatttaggaccccagagcacttttgcctgtggtggcacggcttgccagaactcaggttccaaccagcaggatgggtgattcccatctggctagggctgatgcaaatgctccctcttggggtgccagctgagttctgcctggtgttgacagcactgcattccattgcaaagtcccacagtcactgcactttctctccccaagtgtacagattttccacgccacgtggctactgccaggggaatggggaaaggttagtgttggcaattcaagactgtctttcctgccctcttcagtgcctctttcagtgatatgaagttaaaaccagatagtgtgatcactcccctgatttttggttcttatgaaggtgctttgttgtgtacataattgttaaattttgtgttcctgtggggaggatgattggtggaagcttctatttgatcattttgcttcacttcctctagcactatttattgtacagtttgttctttccccctaacttgaaatgccatcttcatcatatatcaacatttcataactgtctgtgtctatttctggccttcattctgttctattcttgccccagtaactctctgttttaataactatgtctttataatgtcttaatattcagttgggaatttggctctctttttgttcatctttcttaaatttttgtttactgtttctccatatttgctcttttagaatcaatttatttcatcacacaaaaattaagatttttgatggatatttaaaataaatgtaaaaagcacaaaattatattattatttattcctgaagccctcaacatgtattattttgcactccgtatgtattattcctattagataaagagcggggtagatccagagtcttgtgggacctaaagtctgacccattcaagagccctttttaaggagagtaatgcaaaatgatgaatgtggcattagatgctgtgccttggcggagcctgtgctgggaagatgcctgaacctctaagctttattagcttcatggtaaacccgcttcagataagcagtctcacttagagagaaagtcctgacaaattgtgcctttactcccactagagtaaaccaatagttcatgacttctaaactacttagatggtataagccataaaataacaattaaatcgcgcagcttcagttgtatttttagtcatgtgttacacaataccactgcctcagctttccccaggatagcacctcttatttgaggatctcaggggacattatgaacattaagtaattaaacctcgcaagaccccagagacactggagagagagatccagcttcaccttgcccagttctgaaatgcagtcacctctagggatgaacgtggcagctgcttagtaataaactgcaacacctcacgacagtttagtcaagcaattagtctttgtagttggtaactgtctcatgaacattagaccattgacagttaagtcaccaggattattagtttactgaaaatctaatccagtctttaagactttttacttttttgtaatattttcctaattataaaagaagcatgcacagtgaatgtctacttttagttgcattttttgtagttcttcaaacttaaaataggaaagaaatatctttgtaatacattaaaataggtagttactgataatgaggtttttttaattcacaagttttctgctgatcaaaagtaatcaatgatagtaaaagttggaagagtggatacctttgagaggagtattgactggacggggagatgaggggaacctctgggtgctggaaattttttttttttttttttttttttagtgctgtcttgttgcattttttaaaaaattttttattttttattttattattattatactttaagttttagggtacatgtgcacaatgtgcaggtttgttacatatgtatacatatgccatgctggtgtgctgcacccattaactcgtcatttagcattaggtatatctcctaatgctatccctcccacctccccccaccccacaacagtccccagagtgtgatgttccccttcctgtgtccatgtgttctcattgttcatttcccacctatgagtgagaacatgcggtgtttggtttttttgtccttgcgatagtttactgagaatgatgatttccaatttcatccatgtccctacaaaggacatgaactcatccttttttatggcaatcattaaaaagtcaggaaacaacaggtgctggagaggatgtggagaaatatgaacacttttacactgttgatgggactataaactagttcaaccattgtggaagtcagtgtggcaattcctcagggatctagaactagaaataccatttgacccagccatcccattactgggtatatacccaaaggactataatcatgctgctataaagacacatgcacacgtatgcttattgcggcactattcacaatagcaaagacttggaaccaacccaaatgtccaacaatgatagactggattaagaaaatgtggcacatatacaccatggaatactatgcagccataaaaaaggaaatgttttatatgttctttttttttcctttttttttttttgtttttggagatggagtctcactctgtcatctaggctatagtgcagtggcacaatcttgactcactgcaacctccgcctcccaggttcaagtgattctcctgcctctcctgagtagctgggattacaggtgtgcaccaccatgcccggctatgttttttgtattttaagtagagacgaagtttcatcatgttggtcaggctggtcttgaactcctgacctcaggtgatccaactcccttggcctcccaaagtgctgggattacaggtgtgagctactgtgacaagccagttttatatatttttataggcgttggttgttcaggaacagacatatgtagaaattccctgagctgtacacttttcatatgtgtgttaatctcaacaacaaggtcaataagcctaaaaagcatcctgctcttgtcatgatgagagtgctagaaaccccagatagtcttatttggaaaattctgcagggtgcaggacatatcgggagctagagatatgacagtttttattttcctcaaagcatctttcttcagaagagggattctaagtgatttaccctctcttctcaggacattttctcttcatgccaaaagagctacctttcatgctagaatgtgactctctgtctcattgtgccttcaacattatgtacctcttcgactatgccatttacacctccctaggcatctcatttttatcttagaatttcattcatttacctacatctttgccagaagtaagtataatgcattagtgacccagatatttggggttgagaggcatctgcaggggccattgttgtaactggcactagaagaataccatgggagaggaggaagcagaggaccctggctgctctggctctgcagtgtctgatgtgatgcttgaaaacaagaaggcagagcagcatgcccacactcacggagacagcagcagtctctggagccttcagcaggcccagggtccctcctacatctgtggcagcgcttctgaggaggggcagccatgagcagggtgtcctagggctgctctgagctgagtcccaaaggctgagagcagatgtcatggctgagaactcccagcagagcggacaccactgggtgaggcacaaaggagaggacatcctccaatgatgtcttctcccaggtctccctctttaggcatggagagattacaaaagagaaaaaaggaggggaggaggagggtgaaagacctttgtagacaaaatgggaaatttttagtaaaggttaaatacatgaagcctaagctaccctgattattgactttccagaacttactaaaaaaccaatgctcagctccagttcttcttgaaaataatttctattacgaaatagaaaagtgagcattgtgaccgctggcagagcatgagttcacagtatttccacacaaagagaaagcagcccttgtgctaagccttggcattcaggtaacactgatgtaactcactgtggccttttccaccttctgcctggagatcatttcaaagcccaccatcgaggaagctgataacccattgtttgtaaacttcaaaaggggctgctatgaaaggaacccattgcccagggactggcagaggttgagggcctcctgtggcccaggcctgggccaggtccgttgcccatcttcccatctccacaactcccctgggcagcatcatgtgaatgagggcaaagagaggtggagggagggaggaactagcccagaatccctcctcagtgtcaaaattcgggggggctgcggagacctgctcttcccacctcaaggtactgctctctagaataaaattctttagatccattgtagtctaaaaccatgtgaccatgctgtctaatttcctgtgattctgcagatatttatcatctattttctgtcattattctatcccttctctcaaagatgctgagctcaggagtagcagccaaggttcccaaaaaatagtcgaggagttgcaggaacctgtctctccagataccatggaaaacatccaggtgagagagactatccctccatgcctagggtggggggatgggcctgggggctacctgtgacatcaggggcatctctggtgctggcgtcactacggagaagttctaatgcctgatgcagaaaaggcctcactagcagtaagcacaccgcgagctgggggaaacagaggcctctgtgtttgtaacagacaaatcaaagcctcactggtgtgctccaaaattcaggtcagaacagagtgtcagcctttctctaccttcctccctgacttcaggaggctgagacagataaaactgctcatttaaactcactgggaaatacaggctttctgaagagactgacacactatctgcatactccaatgggacagcattttccttactgccctgactggtccctgcagacatggaaacacttgccccatctcccagcaaagtcccctcccagcaaagaggggactcgggagatgtgagtcttttaaagaagattatgtggcatggattagattgatggaaatgaagctgatttaatggaattagttttttttaagtgcagcattctttttacactaaggtgcagtaacggagactggatttactctcctgcctaaaataaccaaagtgtggctaaaatatagaaaacactgttcatcactgtaacaaaggccagcgatgcctgggagatgggaaacaagccaagcgaatcctgtggctgccccagttgtttgccttgacagaccttctaggtcacaacgcagggcaggaagagccagaagacttcccgagtctttaagtccatgcagactagagtgactaaagtctgaaggacagagtactagaaaggacagagtgcacagagagagacatcattgatcagcagatcagtcaggcagtcagctgagtgctgatcacaccaggcatgtgaggaaaccccttaaggccaggctgagaaaagaacctctgaaaaggatgaggattaatagtgcccatgcctgtacaaagttaggaatagtgcctgttctcaccagccagactggaaaagcttatgatttgcaagagagtacacaaaagagtcttgtggagaataattagttctagagagggcaccgctccagtcctgcttaacaaatctttaaagcaagaactaaaagaatcaaagtaacttaactgagtcccagaacaaagtacaagactatctgtaggaatacagaattacttggcacccaccaagatgaaattcacaatgtgtggaatccaataaagaattaccagcactcacaaaactggtaatatattatgcataaggtggagataaatcaatcagttgaaacctacatacatatgaaaacatgttagaattaatggacaaaaacattagaacagttatcataactgtatgttccaaaggttaaggagagacataaaagatataaaaatgccccaaatcaaacttctagagattaaaaactacaatcaatcaagatgaaaaatacaccagaaggattaactccaggttaggcattgcagatgaaagattagtgaacttgaaacaaatataaatgagatgttttttcaagatacgtatcagtgagtttggggacaacttcagagacctaatatatgtgtaatagaagtccacatgaagagagagagacgctaggacagaaaaaaaaaacacattcgaagaaataatgactgaaaaatgataaatttgatgaaaacaatatactcacagatacaagaagctcagcaaacacaagaacataaagaaaactataccaaagccagtggaaaaccagtgataaagagaaaatcttaaaagcagccaggagtagatttgggggaagtcaagttaggaacagagaaacaaagatatgaataacaggggatttcttattggaaataatacaagcagaaagatagtaggatcacatctttaaagaaatagaagaaaataaactccaccctagaattttatacccagtaaatatctttcattcaaaataaaatatgaaataaagagtttgccctacacagaaaaggtggaaaggtgcatcaccagcagacccacattacgagaaatgttaaagaaagccctttaggcagaaggaaaatggtatcagatggaaatttggctctacacaaagagttgaagagcactggaaatggtaacaaagtgggtaaatatataagattttatccttaatatttatatctttttaaaagatagtgacttcacaaacaaaaatagcgccgggtttataacatatgtaaaaataaaatgtatgacaagaatagcacaaagagcttgagaggagacccagaggggaaaagtatactattttaaggttcttatatctaaagtgctataatatcacctaatgacagtctgtgatcagttaaagatgtaccactaatgttataaatcagattcaaagagttatatctaataagcctatagttgagattaaatatcatcataaaaatacaaaattagaccaaaagaagacaaaaagagaggaaaaagggagcaaagactagatgggacaaattacaagatgacagacttaaacctaagtatacaataattacattaaatgtaaacgttccaaatgtcccgattaaagatcatgtatataaggcagatatagagtggataaaatgcaaaattcagttatatgtagactataaaaatgcactttaaatataaagatacaataggctaaatttaaagaatggaaaaggatacaccatgccaacactaatcaaaagttagctggaatggctttactaatttcagacaaagtagattccagaacacagaatactataagagataacaaaggccaagagaatgtaacaatcttaaatacttatgcacccaataacagtgcttcaaaacatacgaagcaaaaagttgtagaactgcaaagataaatcaataaaaattatagttagagatttcaatatgctcctctcaataattgatagaataagtaggcagaaaatcagtaaggataaagaagattttaatgacagtgttgaccagccttgccccacctcctggcctgggtagctgaagtgcagcacagtggccctcagcatcccatcaaatgtgacacactgtgaacaatgtggatcttgtgggctgcagccctggtggctgagggaagtgctctctggatgctgcatatggaaccactgtgttctcagtgtgtagattcacagatagacatgagtgaataataatagaaaatggcatggaacagtgggcatcaatgtcaagatgatactgggtaacaccctacaactggatgaactaatgagtgaagaagagtatgagaaatatgtaaaatccattgaggagtgagaatgggacctctcaataaactagaatgaaacaacttaattcagcatagttgtcttaaattagtaatagatggaagacataaaatagcaacttttggtattaccagtggataaagaaactactcccaacactgctgctggaagaaaataccccttttctaaagatttcagacaaacacaatatgcatctttttcacaatactctatgatttttaggctaggctctagttataatatttagaattcatgaagttttctgtggtgagaactagctgtaaaaattatatatcttgaggataacattatgtcttcagctttatataatattgtaacttgcttatatccattcctggatttgagtcaaaatacttaatgatctttgcattgaaaataatttgggagtggagaaaacttttgttagttgtacaatgtcagatgaagaacaatactgtctttttaagtttcaatagttttggggctaaagtggtttttggttacctggataagttctttagtggtgatttctgagattttagtgcatccgtcacctgtgcagtgtacactgtacccaatatgcagtcttttatccctcacccctaccggccaagtccccaaagtccattatatcactcttacgcctttgcatcctcatagcttatctcccacttatgaatgagaacatatgatatttgcttttccatacctgagttacttcacttagaataatggcctccagctctatccaagttgctgcaaaagacattatttcattcctttctatggttgaatagtatttcatactgtatataccatattttctttatctacttattggttgatggacacttagtttggctacatatctttgcaattgcagattgtcctgctgtaaacatgcatgtgcatgtgtctttttcatataatgacttcttttcctttgggtagacacctagtagtgggattactggatcaaatggtagttctactttacctctttaaggaatctccaaactgttgtccatagtggttgtactaatttacattcccactggcagtgtaaaagtgttcccttttcaccacatccacaccaacatctattgtttttgatgttttaattgtggccattcttgcaggagtaaggtggtatttcattgtggttttaatttgcattttcttgatgattagtgatgttaaacattttttcatgtttgttggctgtttgtacatcttttgaaaaatatctattcatgccctttgaccactttatgatgggattatttgtttttttcttgctgatctgttcgaattccttgtagattctggatactagtcctttgttgggtacatagtttgcaaatattttctcccactctgtgggttgtctgtttactttgctgattatttcttttgctgtgcagaaactttttagtttagttaggtccaatttatttgttggttttttgtttttttttttgcatttgcttttggggtcttagtcatgaattctttgcctaagcaaatgtccagaagagatttttttaatgttatcttctagaatttttatggtttcaggtcttagatttaagtctttaatccatattatgttgatttttgcataaggtgagagatgagtatccagtttcattcttctacatgtgacttgccagttttctcagcactatttgttgaatatggtgtccttttcccactttatatttttctttgctttgtcaaagactagttggctgttaagtatttggctttatttctgggttctctgttctgttctgttggtctacatgcctatttttataccagtattatgctgctttggcaactataaccttgtagtatagtttgaagtcaggtaatgagatgcctccagatttgttctttttgcttagtcttgctttggctatgcaggctcttttatggctccgtatgaattttcagattgttttttctagttctgtgaagaatgacgatagtattttcatgggaattgcattgaatctgtagattgcttttggcagtatggtcattttcacaatgttgattctacccatccatgagcatgggatgtatttccatttgtttgtgtcatcagtgatttctttcagcagtgttttgtaattttccttgtagatctttcacctccttggttaagtatattcctagggtttttttgttttgttttttgtttttgtatttgtgggttttgtttgtgtctgttgtaaaagggattgagttctctatttgattctcagcttggtcattgttggtatattgtagtgctactgatttgtgtacattaattttgtaacctgagactttactgaatttgcttatcagatctaagagctttttggatgttttagtgttttggatgttttgtgttttctaggtatgtgatcatatcatcaggaaacagcaacaatttgactttctcttttccaatttggatgccctttatttctttctcttgtttgatttctctggctatgacttccagcactatgttgaatagaagtggtgaaagtgggcatccttgtcttattccagttctcagaaggaatgctttcaacttttcctcattcaatatgatgttgacaatactttcttaattttgcaatacactgaatttgctggtgctatttatatacagtgaagcaaaagcttggcagtagaataagaaacaatatagtaataaaacaacttcattactcatgaaaaaacatgcagacaaaaccactactgaccgatttggcgtaattgacatatataaaatacttcactcaacaacagcagaatatacattcttttcaagtatacatagaacatggacagtttaccaagatagaccatattatgggctataaaacaagactcaataaatttaggattcaagtcatctgagatatggtctctcatgacaaaagacttaacaagaaaataaaactgcagatcagtatttctcatgaacattgatgaggaaattctaataaaaacttagcaaactggaagatggcagataggaaacagggctgacatgcagctcccacttggatggacaaaacagcatgtggagattcacaccatgaacttttgcttcggaaaccatcacaggagcatgccaggaaaaccaaaagaaaccacagatcctttgtaagaagcagcagactgctgcaattgccacaagacaggcgaaaacctgtgaattcccaaagtgtgaggggggaaacttgcttctgaacacacatccccactggcgaatctgaaaatccagattacaggagaaagatttaaccttacctgccactgaaatggatttagtgtgaaatataaaagtagaagcagcagtaggaagaaccttctaggcactcccattctccagctcaagcccagggaagccatccctgactatatctcacagacatcctcggggaaggcagtccagattttggaaggggtcacagggtgaaagaaacttccaactgaactttgtaataattttgactggccacaaaccctcttgagcagaatcctggggatgaatgggaaccactgcagaaaggagtgcaggagtcacagccagcagtgtggggagatgaggaggggcatggcctgaaagccatacttgcttcttcagtggagaaacttatagcatggggctgggtctgagtcctacacacaggctgcctgtagataaacttgtcgctcttagcagagcatggcaagagcgagactggcctcaccaactccatgggagtggggtgaaacctattgttactggctttcccccacttccctggtgacagaggcagccatgattccctctggaacataaccccatgcgcccaccacccccctacactccaaagtggcttcagtaagccctgctcaaggagggtctgagctcagacctgcctattcctacccacacctgatagtatttctctacccaccccagtagccaatcacaaaagacgtaaaagcttgggatctttatggccctgcccatcacctgagaaacccaaattcttatcctggccaacacagggcaagcttatatcccccttctactattgcagctggtgctctctcgaaagtgccacctcctggcttgaggccaaccaactcaggacattacagcaactcatgacagaacaaccctgctccaagaaaggagaaaacaaaaaccaattccactgcctgaaacatcctggataaccagtggtcctgagtctgtccacatgacagcttcactgctagcataactagcatttgagaaagccagcacactaagcatatctacaaccaaggactctcacagagcctacttcactcccctgccacctccaccagagcaggtgctggtattcatggttgggagacctgaagatagattgtatcacaggactccttgcagacattccacagcaataacccagagcctggtagccccactgggttaccagacccagaagagaaataacaatcactgcaatttggctctcaggaagtcccatctgtaggggaagagggaaggcaccacatcaagggattactttgtgggacaaaagaatctgaacagcagcccttgagttccagatttttccactgacatagtctacccaaatgagaaggaaccagaaaagaaattctggtaatatgacaaaacaaggttctgtaacacccccaaaagaccacactagctccccagcaatggatccaaaccaagaagaaatctctgaattgccagataaagaattcagaaagttataaagctcctcaaggagataccagagaaaggtgaaaaccaacttaaagaaattttttaaaaaaatacaagatatttatgaaaaatactccagagaaatagatgtcataaagaaagaaatatagcttctggaaatgcaagacacacttagagaaatacaaaatgcacttgaaagtttcaacagtagactagaacaagtagaagaaagaacttcagagcttaaagacaaggctttcaaattaacccaattagacaaaaaaaaaagaattattaaaaaatgaacaaagcctccaagaaatttgggattatgttaaacggccaaacctaaggataactggtattcctgaggaagaagagaaatctaagtttggaaaacatatatgagggaataatcaaggaaaacttccctggcctcactagagatctagacatccaaatataagaagctcaaagggccaggttcagtggctcatacctgtaatcccagcactttgggaggccgaggtgagcggatcacgaggtcaggagattgagaccatcctgactaacacagtgaaaccccgtctctactaaaaatacaaaaacaaaattagccaagtgtggtggtgggcacctgtagtcccagttactcgggaggccgtggtgggagaatggcgtgaacccaggaggtggagcctgcagtgagctgagatggcgccactgcactcctgtctgggcgacagagcaagactccgtctcaaaaaaaaaaaaaaaaaaagaagctcaaagaacatctgggaaattcactggaaaaagatcatcacccaggcacatagtcatcaggttatctaaagtcaaagtcaagacaaaggaaagaaaattaagacctgtaaggcggaaacatcaggcgacctataaaggaaaacgtatcagatttacagcaggtttctcagcagaaacactacaagccagaagggattgggtcctatctttagctcctcaaacaaaataattgccagccaagaattttgtatccagcaaaactagcttcataaatgaaggagagagaaagtgtttttcagacaaacaaatgctaagagaatttgccactaccaagccagcactacaagaaatactaaaaaaagttctaaatcttgaaacaaaacttcaaaatacatgaaaatagaacctccataagcataaatctcacagggcctataaaacaataacacaatgaaaaaaaaaacaccaaagtattcaggcaacaactagcatgttgaataaaacagtacctcatatctcagtactaacattgaatgtaaatggtgtaaatgttccacttaaaagacacagaatggcagaatggataaacattcaccaatcaagtatctgctgtcttgaagagactcacctaatgcataaggattcctataaacttgcagtcaatgggtggaaaaagttatttcatgcaaatggaaaccaaaaatgaggaagagtaactatttttatgtcagagaaaacatactttaaagcaacaacagttaaaaaaagtgggacattataaaatgatttttaaaaaatcagtcctacaggaaaataccccaatcctaaatatatatgcacctaacatggtagctcccaaatttataaaacaattattactagacataagaaatgagatagatggcaacacaataatagtgggggacttcaatactccattgacagcctgagacaggacatcatgacagaaagtcaacaaaaaaaatgcacttaaactataccctagaactaatggacttaacagatatttatagaacattcaatacccaacaactgcagaatatacattcttttcatcagcacatggaacattctccaagatatgccatatgatgggccacaaaacaagtctcaataaacttaagaaaattgaaattatatcaagtaccctctcagaccacagtagaataaaattggaaattaactccaaaaggaaccctcaaaactatacaaatacatggaaattaaataatctgaacttgaatgatctttgggtcaacagtgaaatcaagatggaaataaaaaattatttgaactgactgataatagtgacacaatttatcaaaacctctgggacacagcaaaagtggtgctaagaggaaagttcatggcattaaatgcctacatcgaaaagtctgaaagagcacagatagacagtctaaggtcacacctcaaggaactagagaaacaagaacaaatcaaacccaaacccaacagaagaaaagaaataaaaagatcagaacaggactaaatgaaacggtaacaaaaaaattcaaaagataaacgaaacaaaaagctggttctttgaaaagataaacaaaattgatagaccattaccaagattaaccaagaaaagaagagagaagatccaaatagcctcaattagaaatgaaatttctaattgatattacaaccaataccacagcaacattcaagactgctgtgaacacctttaggtgcacaaactagaaaatcttgaggagatagataaattcctggaaatatacaaccctcctagattaatcaggaagaaatagaaactctgaacagaccaataacaggtagtgagattgaaacaataattttaaaattgccaacaaaaaaagtccaggaccagatgaattcacagctgaattctatcaggcattcaaagaagaattggtaccaatcttactgatactgttccagaagataaagaaagaggtaatcctccttaaatcattttatgaagccagtatcacactaaaaccaaaaccgggaaaggacataaccaaaaaagaaaactatagactaataatcctgatgaacatagttgcaaaaatcctcaacaaaatgctagctaaccatatccaacatcatatcaaaaagataatacaccatgatcaagtgggtttcataccagggatgcagggtttaacatatacaagttaataaatgtgatatgtgacataaacagatttaaaaacaaaaatcatattatcatctcaaaagacacagagaaagcatttgataaaatccagcattcctgtaggattaaaaccctcagcaaaattggcataaaaaggacatacctcaagtaataaaagccatctatgagacacccacagctaacattatactgaacaaggaaaagttgaaatcattccccctgagaactggaacaagacgaggatgcacattttcaccacttttattcaacatagtacttaatgtcctagccagagcaattagacaaaagaaagcaacaaaagccatccaaattgataaagaagaggccaactgtcgctattcactgataatgtgattgtatacctagaaaaccctaaggactcatccaaaaagctcctagatctgatatattcagtaaagtctcaggttacaaaatcaatgtatacaaatcagtagcactgctatacaccaacagtgaccaagctgagaatcatatacagaactcaatcccttttacaacagctgccaaacaaaacaaaacagcaacaacaacaacacacaaacaaaaaaatcccaaaacaacaacaacaaaccttaaaaaaacaaacaaaaaacctaggaatatacttaaccaagaaggtgaaagacctctacaaggaaaactacaaaatactgctgaaagacatcactgatgacacaaacaaatggaaacacatcccatgctcatggatgggtagaatcaatattgtgaaaatgactatactgccaaaagcaatctacagattcaatgcacttcccataaaaataccatcatcattcttcacagaactagaaaaaacaatccaaaaattcatatggagccataaaagagcctgcatagccaaagcaagactaagcaaaaagaagaaatctggaggcatcacattacgtgacttcaagctgtactataaggctatagttaccaaaaaagcatggtactggtataaaataggcatgtagaccaacagaacagaatagagaacccagaaataaagccaaatacttaagagccaactaatcttcaacaaagcaaacaaaaacataaagtaggaaaaggacaccgtattcaacaaatagtgctgggaaaactggcgagccacatgtagaagaatgaagctggatcctcatctctcaccttatacaaagatcaactcaagatggatcaaagacttaaatctaagaggtaaagccgtaaaaattctagaagataacattggaaaaaactcttctagacattggcttaggcaaagaccaagaacccaaaagcaaatgcaacaaaaacaaagataaatagatgggacctaattaaactaaaaagcttctgcacagcagaagaaataaccagcagagtaaacagacagcccacagagtgggaggaaatatttgcaaactgtgtatctgacaaagaactagtatccagaatctacaaagaactcaaatgaatcagcaagaaagaaacaaataatcccatcaaaaagtgggcaaaggacatgaatagagaatcctcaaaagaagatttacaaacagccaacaaacatacgaaaaaatgctcaacaccactaattatcagggaaatgaaaatcaaaaccacaatggaatgtcaccttactcctacaagaatggctataatttaaaaataaaaaaacaacagatcttggcttggatgtggtgaaaagggaagagtttttcaatgctggtgggaatgtaaactagtacaagcactatcgaaaacagcatggagattccttaaagaattaaaagtagaactaccatttgatccagcagtcccactactgggtgtctaccgagtggaaaagaagtcattatatgaaaaatacacttgcacaagcatgtttataacagcacaatttgcaattgcaaaaatatggaaccagactaaatgccatcaacatagagtcttttatctgcacattgggtacagtatacactgcttggatgatgggtgcactaaaatctcagaaatcactaaggaacttttccatgcaaccaaacaccaactgttctcccaaaaatattgaaataaaaaaatttaaaaattagcaaactgagtcaatatacaaaaaggataatcatgactgagtagggtttattctaggaatgcaagtttggtttaacataagaaaatcggtgtaattcaccattttaacaaactaaaaaaaaaccatatgtttatctcataaatatataaaagacatttgaaaatctaacattaattcctcataaagactcttagcactttttcaatttgacaaaggttatttttgaaaaacttacagcaaacgtcacacataatggtgaaggactaattgtttcacccttaaagtcaggaacaagttaagaatgccttttctcaccacttctaatcaaaactgtactgaagatttgaaccagtgcaaaaagataggaaaagaaatgaaaggcatccagattaaaaaggaataattaagactatctttcactcacagacaacatgactacctatgaaaaaaaaatctgatggaatctacaaaacagctactataactaatatataaaaaattaatatgcaaaatttagttgtatctctgtataatagcaatgaacaatcagattgaaataccatctacaacagtacaaatatgttaaatacttatagattaaatctgacgaaagatattcaagacttctatggtgaaaactacaaaacatttctgagagaaattaaagaagacctaaatacatggagagatattctatgttcgtgggatattgaatctttaaatcagttctttgcaaatttggtaaaatcccaatcacattttcagcaggaatttttatagaagtttaattaattgattccaaaatttatatgaaaatggagataacctaaaacagccagagaaactttgaaaaataacaaagctgtaggataacactaactgatttcaagattaattattgtaagattcttttttttctctctctctattgcccaggctggagtgcagtggcatgatctcagctcagtgcaacctccgcctcccaggttcaagtgatactcatgcctcagccttccaagtagctggtacaggtgtgaaccaccacacctagatttttttgtatgtatttttagtagagatgggggtttgctatgttggccaggctggtcttgaactttcagcctcaagtgatccgcccaccttggcctcccaaagtactggaattacatgtgtgagccattatgcctggcctaattattataagattattgtaatgaagatagtgtaatataggtgctaaggtcaacagtaggttaatggaatagaattaaacaactcagaaataggctcaacatatagacaactgatttttgacaaaggcacatggcaatgtagtggagaaagaatagtcttttctctctgaaacaattttatatccatatacaaacttttaaaaaactcaatccatacctcacaccatatacaaaaattagctgcaaatgaatcatagacttgaatgtagaattcaaaccaatataacctctagagaaaacataacataggagaaaatgtttgtgaccttgggttaggtaagatttcttagaaacaacattaaaagcacaatacataaaagaagaaattgaccaattagatgtcatcaaaatttaaaaccttttctttttgaaaagtactttaagagaatgaaaagacaagctacagactgggagaaaatatttgcaaattacatatctgacagaggacttgtttctacaacatattttttaaaactctcaaaacacaataatacaaagtaaaaaagctaattaaaaataggcaaaagatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccaccatggcacatgtatacatatgtaactaatctgcacaatgtgcacatgtaccctaaaacttaaagtatattaaaaaaaatagattaaaacaaatatcaaatgaaaaaaaaaatgtggccaaatactgttattgtggagaagcctgaatctggcattaaattacaccaagtggacctttgaaaaaaaaaaaaaaaaaaagatttgaactttccaaaataagacatcacatgaaatgacactcaatctcattagtcattagagaaatgcaaattaaaaccacaatcaaatacaactacacgtctattagaatgaccaaaactagaaagattaagcattccaagtgttggtgaggatgtgtaagtgcatccacaccaggatactattcagcaacaaagaggactaaaccactgatgcgtgcaacagcatggatgaatttcaaagtaaacatgctgagtgaaagaagccagatcaaaaaagaataaatactatttgatttcagtaatataaaattacagaaagtacaaactataatgacaaaaatcatatcagtatttgcctgtggttggcagagtagaaagggtgggagtgagaggcacatgggaacatggaagcttggggggcgatgtgtcatgttcattatcttgatcacagtgatatttttatgggtgtacacataaatcaaagcttttcaaaaaggatacttcaaatatatgtagcttattgtatgtcaattctattaggttggcacaaattacttttggtgcacaaataattgcagtttttgccattactttaatgcaattacttttgatataattacttttgcaccatcataatacctcaatacagtagttttttaaagaaaaaacttagtgcacctttcaagttaaacagaagaataggaataatggagtaataactaacatctccagagaatcaggaggcacctgcactatgcaaagcatctgtttctctatctgtctgtctttattttatcctcataacagccttatgaaatagatgctcttctcatccccttttcacagaggaggaaactgaggttacataattttcccaatgccacaaggccagtaagctgtagagccagggtctgaaccctggcagtttgctccagagcttggactctaaaccactgtaggtgtcgattaattttcatgttttgctgtcatcatttccagggaaatattgccagagaagctgcatccgaggaagctttaacagcagtccaaagtggaaatgttagtgaaccggaggtagggtttgacgagggcctttgcgtgccttctagccaccccatgggtttcacacctttctacctcagaggatttgtgccctttcctcctcccaatctccctgcctgtctccaccagttcacacctaccacctcctttaggacttgctgcaccaagcctcacctccttacctcttcccctgctgtgattaatcttttcttctgtatcctctgcatggcctggactgtaagttgcattttctacataaattatttgcaaaaattttagtaaatacagcttatctctccttcccattgcccaaaaagaaaacattttggagaggcaaaacatttgtaagagttttctctgtatcatatgcacatacatacacttctgtccgtgtctaggtgtgttattaatatatgtcatttacattcatctcaggattttggaagtcctccctcctgttacaaattcaggccaaggggcatagcatcttccaccagtgcagtggctatccctggggacttcaccatcctttgttggtttcccttcaccccacccatgcctttgcaggtggtccgttgaccactccattggagtgtcccttctgttccctgccagaagcctggtggttcaggaagagattggcagggtcctgtgaaccctgctcaggatctcagacttttcctaagaagcagaggagggtgttgtaggcttttgagtgggaggttggtacaataaagcattttcattccctgatgatgagcatagtcctggaatttcagtagtttcccaagagcctcttggtgatggatggactgactcagcaacagaagcctagagaacccttgagaagggaatggaacatggggcttggtcatatccatagaggcactgggacagattcactgaacactaagcccagacactgaagttctgccagaggaccaggttctccaacctgtctcctctccagattctgaccagtgaaggagtctacccagaagtcagctagggattgaagtacccctttctcatggctaacactgaaccagagaacaaagcttggaccgagaacacaaatgggcttcccatttctccttactgaattaagtgcccccatgtggttgtaggcaggcctcacctgtggggcagggtctccccactcccagctaattgcatggaggggaggagaaaacacacaacctgggagcaggatgtgctgtcagaaagagaaagcacgatgtaggcacagggtccagtttttgaatctcacattagcatatgctgttggagccccacccatatcctctagcacgtattcttcctgagcactctgtgaagacaaggactgcaagtgcctggtctttcttccatgccatgtttgcagcagggcaggctgtttggggaagcagccatcagccagtgactgaagggattggagaatcaatttgccagctccttcacctcttaggtgggaccactctgcactgtgttctctaggctttcggagatccaggtggggttgattcaccatagtcacccacatcttgaaacaccccatgctggcagcctccccttcctcacctcgcatgccactcctcttacagaatttcctggctttgctccccaagtaaactactgactctcagacacttaattcagggtgtgtttctggggcaacccacactaggagactcactgaccagttggtcactccctgtgccctagggaggaaagtcagggtgtagaagaggacagcagttttctctctaatattcctaagagggtagccgttccgttatgaacccaagcaaggatgtggttggagggacaggatgcctgcccccaccactgcatcaaacatggttggaaccccagaagacacctgagtcaacaaggtggattgatctcctatttttatctcctctccctaccggagaaaaacactgaaatgacagtaaagggataaaaagggcacaaatccacaaaggtgagatggagaggagatattggaagataagcactttaaaaatattgagaataaaaaaatcaatggaagagtttacattggcttagcacagctgaggaaggtgaaactcaggcatctttatgggaggagagactggtgaaaagtgtgtgaattctgcacaaggctgaagactggaggtttgcagaaggtggggtgaggaattgggctgaaaagctgggcagtctgatgtggagtgactggaacactggatccctgcagactccagttaggttgtcagccacaccccaagtgagaggataaaatgactattctctagagaaattgaacagaggctgctgctaattcagatttagcctgtgctgcatgggcgttgtaacggtgaggaatagagaacagacaagtaagtggaattctccacttcgaacagaggaatccacagcccctcctccagccacgccctctcaatgccaggagccaggccttgtattaagtttctattgctgctgttacacattaccccaaacttggtggcttataacaacacaaatttattattgtgcagttctggaggttagcattccaaaatgggtttgagtgtgctgagcttcaggtgtagacaggggcgtgttccttctggagactctaggggagaatctgttcccttgcctttgccagcttctagaagccacttgcattccatgccctgtgtccccttcctccatcttcagagctggcagcgcagcatcttcctccctctgactcagacctgctgcctccctcttagcagatccctatgattcctctgggcccacccggatcatctaggagcatctcctcatcatagaacccttcatgtgatgacatctgcgaaatccctgtgccctgaaagataacatatttacaggttgcagggactagtacctgtaacatctttggggaccacagtcctcaatacagaatattggagaacttaagtcccaaaaaactgacaggcccaaggaaaatgccttcagatgatgtcactgaaggtggccacccagtaataatgccagatctctgcctgatcaccccatgaagtgccccagttagccagtgtctgtggagttttgcctctcaagcatgttgcttttaggaagctaaaaatgtgctctaacgatatgagggcctaaatgatgaacaaaaaagacaaagaaaagacctggaacttacaaaataggagctgcaatacaggcaggacggcagagctgcaagtccagattagaggggagaaaaaaggaagctcatatattatctcaaacgcctgatcatttggaaaataatagtgaccaacacttggcaaatctgataaaggaagtgaaaaacttagcaaaccaagtgaataaaaactaagcacacagatgaaaacattgtcatattacactactttgctcagcaacaacagaacttacacattcatattagtgtaaatacttacggatttaaccctgaattgtgatgtaattttcctgggggataagatgtggggaagagggtagtatgagagggattaatctagccactgcatcaatattgaataggaaattctaaaaactaatgaatttagaaacagcaccataagcatattgttcagaaatatagaggtaaatatatacccaaataaatgaaaacgttgaaagttctgttcaatgggggtagagacttggaaggacagagaactactgattttcttaataaatgtttggtgctaatattattttaaatttttccatatgcatgtattactttgatttaaaagaactccatgagggatctcaaagggaatcatcttctgagttatgacacctttttaggtgcacctaaaccaagacagaacagcctcagccctgactttccaggtggctgtggtccactggaccttcctgggctccacctccccacgatagttactcccaggaccacctgagcagtcccaagattcaaaaattcttgtatcacaatgaaaacagctttggggacagagggattttgcttctggagttattataatatgtatataatactatcacgctctaatctctaccctgggatgcagttaaaatatggaccctatgtcaaaggccaactgaaactatttgtcttgtgtgagaccttcatgtgagaactagttttttttttctttattattattattttttaaattttattttacgttctgggatatgtgtgcagaacgtgcaggtttgttacctaggtatacatgtgccatggtggtttgcggcacctatcaacccgtcatctaggttttaagccctgcctgcattaggtgtttgtcttaatgctctccctccctttccccccgacccccctgacaggccccagtgtgtgttgttcccctccctgtgtccatgtgttctcattggagaactagtttttaaaaacattttatgaattttgagtatctcattaagaacctctccttaaaaccaggcctggcccaggatgagttgtttcgggtgacagtcacacctgtcctcagaacggtgtcatgtagagataatgcagccaccagcccactaaattacagggcattgacaggattctcattggctcctcctgtctccttgctctaggacatagaaaaactcagtgacatctccactggatatgcacagtatcaccatgtcagcagtaggagcttggcatcgctcgtactgcctgaagagcccgtccacttccgccccatctacaggggagcctcagctgctttttgtattcagctgttttgtattgatgagaaatatgaagcaaggcaagtactgaccttctggctggctgtcacagtgagaatcttttctggcattggtggcccaacattttaactttacagagccagtaatttccaaacctggcccacatcctaatctcctggggaattttttaaaacacaaattcctaagccccatccagagattctagtccatcaaattttaacaaggcctacagaagtgggctagaaatctggcctacctatgtaacaattgggaatctggaaaattatcacttacataaccacatgctgctcccattctgtaaagtttgcatctcttggataatttgaatttgggttactggttgtctagagtctttggttgcaagtaacaggaaatccaaccaaactggctttgaaaaaaaaattgaataattgcctcacataactaaggataactctggtggtgagactgttttaaatatggcttgatctaggatttatttagattaccaaatcaaggaccaagtttctctctctacctcttcaccctgtgtgttagtctgttttcatgctggtgataaagacatactcaagactgggtgatttataaagaaaaagaggtttaatgaactcacagttccacgtggctggggaggcctcacgatcataggggaagatgaaagccatgtcttacatggcggcaggcaaagagacaatgagagccaagtgaaaggggtttccccttataaaaccatgagatttcatgagacttattcaataccacaagaacagtatgggggaaccacccccatgattcagttatctcccacagggtccctcccacaacacgtgggaattatgggagctacaattcaagatgagatttgggtggggacacagccaaaccatatcaccctacttccctgctgttggaccccttctcagaggagtgccccatcctgggcctaagaccactgacattctcaggtctcaggtctgcatcagaatccagtgagaaggacttgccgggatgggcccagctttttccagccaaagtctcatgaggcctgacaggactgtgtgttcattcctgagccaacggctgtgacaagcccatgccacaaggagatggagaagatgggctccatcccttagctcatgctccatgccaaatctgcagctggagtctcagctacatggaatatctgagcaggggataagttgacacccaacagcaatccagggctacagcaaagaggaggcatgcatggtgctgggctttgtctaaagccccggcgcccaccagacctcacagccacccaccctgcccctccagaacacccacatgttcagtgcttgctgttctcctgtggtctggacactggacgctgccctcagtgcctggattccacatctccttagcacccacccctcatctgttcacagaaccatctcgaagaggaaataattggcccattttgatggagtggaaggctctagggtgtcttttagatgagcaagaatagctggacagttcctcttcagaggatctgtttaaacatgttcccagtctcccagcatcccctgttgtactttaacttttttcatctcgagtttttagcttctatggagatctgggacattgaaaagaaattctttttattctaattatgttgtagacatataaaaccttgtaaagcctttctatatttgttgctttatatttcttttatctgtacatttaaatatgattgtgcttagagtatactttttgaattttgaaacaggaatttgatgacccagtgtggtttgcctatgaatgtacatctacagctagtcagaaaatcttcaacagataaaagggaaacagatcagaagcaacctataatatttcccacctctcctcttaactcttccaaaacagaagggaaggatcggaggcacagaatgaccaattttgtgttggcttttcaaatgcacagagattgttaattgatgtgaaagtgccttcagttctgcagaatactttattactgacatacgaagcttgcgacttatgcaccccattagtgttcacctagacacacattctgactagtggttggctaatcgctgcccgaggggagggagctgtaaatctctgtaaacgtccactgatgttgcatttgcttgcagggcactgacagtgcttactgtcttgtttacaggtcgctggattttatgaattttgttttcagtcttttttctgtaagtacatgctgaattttgagaactgattttgtaagcttagagaacttatagaaaagtaaaatgccataaatttattatgctgtgaatgttgaggtttgtgttcggagaataaggtcaaatggcatgtcatgagctcataaaaatacaaaatattgtcattttcaagaatttttaagtcatgctattttagcagttctctttaaatgcaaaatttctgttacacatagctttaccagtgttttatcagaatcaaatcattcatagtaatacatgaaaatgttggaaattaaagtgaatgacactgttattttatagattatgttggctccaagtattctgaaaccatcatattgcttttctgagggtagcaaagtagggacttgttgattttgaggttggcatttctttccctactagttcctcaggcctgacttcatgcctggctggtagagggggctcaacccacattgatgaatgggcctgcaggctaatatccaagtacaaataagattctccatgccagggtgtcccgggcttctgcctacattcttgtctcattattttctagggatgaagatctaaccaaactcttacacttctttattgaaggaaagaaaatgaggaaggaagttttgagggacaaaatgcatttttataaagacaggcctgttaattaagtaaagtcaacaactgtacttctccagttgactgatttcaagaaaagtatctattgctttacttttcctggatactgtttctaatgaggcaaaaacaagtatagtttaattattttgtcttacaactatgtgatgttaggttttatttcctcatttgttattataatgaagctttataataaggcaatatgttctccatcataatttttaaaaattacttattaaggcactttccaaacaatgtagattaccctgaacataggatttacaaagtcggtttccctcaaaaactcctcaaataaatttcactaattttaattattttctactttaacgtccatgtaaacgtaaatatttaacattataaaagtaatgctggctttaaaaaggtaaaagagctgtttacatttcaattctatttgacttcggaacatggacgacaggaaaaaaaataaccttggttgcttcatccttaatccttcaaatccaagatgaagcaactcattatagttagtctctccctcccagaggaagcccacccagacttggcacccagtccttattttcaacttgagtatttcagcaacttgactctcaggttccccaaaaggagtcctactaatttgctaaaaagaaggaaggtaaggtcagacaatggttcactcctttgagttgcacaaatgtccccagggttttggattagcacaagtaatgccttcacagggttcaagaggaggcgagatcccaaagggacaaattagcttcgggaagagcaggctgcttctgcagggacctggcagaggatcaggcagctgcgtgaagctcagatagcctagagcagcactgtccagacatggagtgtgagccacattggtaattctgaatgttccaagagccacaaggaaaaaaaagaaaaaggaacagatgaagtttatatgataatatcttttatttaacttaatatgcccaatcctttttttaaagagatagggtctcactttgttgcatgcaatgtcacaatcatagctcactgctgcctcaaactccttggcccaagggatcttcctgcctcagcctcccaaatagctgggacatgccaccatgcccagctaattaaaaaaaaaattgtagaaatggggtcttgtcatcttgcccaggctgggctcgaactcctgggctcaagtgatcctcccatctcggcctcccaaagtactgggattacagaagtgagaactgtgcctgggcaaatttaatcatttcaacatataatcaatatgaaaacttattaatgagctatttacaatctttttctcgtactgagtctttgaaatctaatatatatttcacatttatagtacatcacaatacaagtactaaattttcatcagaaatagttcatctgtatttgtatgttataaaatttacagttggatacgtagattcacataatccaagcacacataaaacttttccagtaatggaattaagtatccatttttttaatttaaatgaatttaaatgaaataaaatttaaaatttagttcctccgccaatactagccacatttcattgtctactgtactgacagggcaggcctagaatagaatgaatggcagccctcaggacatgcaagacctcttatgtctgctaactaaacccactgcctgggtttaatcatgctcatggatctgttcacccaactgggatcacgtcatgataaaatacgtacacattggtttatggataatcacagaattttagagccaaaaaatgcctgaagtatcatcctcccatctcgcaagaggaagggaccactggtgtaaggtcacttagtaagcaaggggcctttgctaggacaccatgctacctcattgacttggtgacacaagtgaacttacctgtatgaattgtcttggtttaaaaactacttccacagaagagttatgctgaatgactgccattgtttataagattcatttattcaggtttcagtgagaaacaaagataccttttccctgctcttgtagttgcttatttcctgaattttatgtgattattttccaaattataggaaaggtaatttgaatatcctctccttaatcaacacattttgcttctatttttcttggtgttttttagaggaatttgttttttgattaattttttttattctttctctgtgtcctggtttttgatgatgttaggataagaacttctgtgtaatttctctgccccatctcacccccgagttcttcctcatccagaacttcgtgaaaatggtccctttcaacacctgcaccctcgagcaggacctctacgtcttccaccgggctggattgctcaagtgagtagacacatgtttggccacacaacaatccatgaaattacagaagagaagggaacaaggaactccctgctattataatttaataatttattttaaatatcatcttttattagaagaggtcttgagtaagtgattttaactaatacatttagagaaagaatggcacttgagaagagatttgtcctgtcagatattaaaacataatatagctccacaataatcaagacaatgccatgttgacagattctgtaggcagaacaatgtaacacaagaaacagatccagtatagtaggaactcagattgtgcagatctttgtatgtgagtgtgtgtatataatacattcacgacaaagtgtgtgtcacaacagtgggaaaaggaaggattcttctgtaaatcatgagacaaaatggaggtagaaactttttttatactctatcataaaatagattctcaggtgattaaagagttaaatgtaagtattgaaaacataaaaattagaaaatatatttacagtgctaagttctgtgccaagttctgggaacacaatggtgaacaacatgtagacatggtccctgccttttcaaggcttatggacacacagagtgtaaaactgcaactgtgatgggagtaaccagtcctgggcatgtggtactgagcatggaacattgggagagttggcccagccagaggaagctttcttgagaaagtaatacggagtgctggatgaggaaagtgagtgaagattgacctttatcctgtctcagaatgggaaagttctttttaaaacatgaaagaaaaagattaaggtgtcttatactataccaagttttttgaaccacctgattttattaaaatgtaactgaccaacagaaggatgttttaaacaaatatggcagacaaaaggtggatgtatttaatatataaagagctttaatgaatcaataaaaaaaatcacttaatacctaaatagaaaaattaataaaaggcatgaccagactgtttctacaggaaaaaacaaaaaacaaaaatcagtgtatatttaataccttctatcttatttttacaaaatgttctgaggctcatcaaactgcacccttgaaatgagtgcatttcattgtatgtaaattagacctcaataaagttgatgcacaatcttctgatgaaaagtttggtggaggagtgtcagagagctcactctataattgctgtgttaaccttttgagtgaaactttgagaaacatcctagatgttcacttcataattagggactggttaaatgaattttagcaaatgaatttagtacattatgatgacgacttgaagaaataaaaccagatttctatatcctatgtggaaagatagctaggatggtgagaaaagcagtcaaacaataatagtacaagtactaatagtaaggataattaacatttattgagggtttatagtgtgccaggcgctttcttaataatcactttccatgtgtcaacactcacagtgacctaattagttaggtatcattattatcctcatttcacaggtaagaaaactgagacacagagaggttgagtaactagtccacagtccacacagcagaaagtggcagaactgaaatcggaacccaggctgttagcttacagagccaactcatgaccaccccacatattgtttctcgacatggtgtggtcagtgtaatcccatttgattgttgtgaagtgttcacaggtagcagtcagcactaatactaaactgttgtatcagagtgacccctaaacacaactgccttgagccagttctgtctctgtcctgcagtagtccagacaagagcacgtggtctaaggagaataccagctttttctccatgaagttgtccaggaaccgaagttccttctcttattgcccctccattccatagagcaagggttacctaacatatccagagagaagcatgaggtgtgtgaatttggatggaaaggaaagctacatctttattccactaacctgtaagtgaagtttaatgtgtccttccattgtgactggagctagcaggtctcatagtgttagcagaaaccatgacttcatagccagtagaaatgacagatattttcgttcatgtttttgttgttgccgatgtctcaaaaatatcacataatatttaccctactttgaaatttcagtaattttattcttgaccataatttattatgtaatgcattaacaaagaggcacaggcattactgtaacacatttttaaaaacattttgctaactgtgtttcaatataatttataatcctttgtgttttatttaatgaatgtagaaacatttgtctgggaaggagttcatagcatcaccagagtgtcaaagggctctgtggcatgcaagagtttcagacccacggccagagtggacttttcttccttgtgctcagagctagctcggagcaccgtagccacattgcagcccacagggaagggtggaatgagaaatggaagaggggaagcactttcctcttaggggacatgaatcacctctgttcatattatgtgatcaggaacttggttgcatggccctacttagctgcaagggagcctggaagatatgttgctggtaggttgggcatgtgtccagtaaaaaactcagttgattccttaattaaaaagaagaggaaaaaggatactatgggaacattatatctagtttttatcttgtgtatgtatagaagttctaaaaagttacacaggatttcagtaaccttatatgcctctgggaaacaggactgggaattgtaggtgaagatggtgactgactttgcattatgtctatctgttatgtttgatttttttgttttaattaataaacttttttttttttgagacggcatctcactctgttgcccaggctggaatgcaatggcacaatcatggctcgctggagcctcaacctcccaagctcaggtgatcctcccatctcagcctcccaagtagctgggactacaggcatatgccacaacacctggctaatttttgtatttttttgtacagacagggtttcatcatgttgcccaggcttatcttgaactctcctgggctcaagcagttcacccaccttggcctcccagtgttgcaattacaggtgtgaggcaccacacctggccaataaactttttttccaaaaagtagttttaggtttacagcaaaattgagcagaaagtgcagagagttctcacaagccccttctccaccaccatacacagactctcgcatcatgaacatccagcactagattggaacatttgttgtaatcagtgaaccaccactgacatatcattatcacccaatgtccatagttcacattagggttcgctgttggtgttgtacatcctatggctttggacaaacgtataatgacatgtatccactgttatgatagcacacagaatagttttactctgctgaacatcctctgtgctctgtctgttcgtccctcgtttcccacaacactgtcaaccactgatctttttactgtcgccataattttacatttacagaatgtcacaaagttggaatcctgttagtagccttttcaaatttgcttttttttcacggattagtatgtttttccatgtcttttcatgactggctagctcatttctttgtagccctggataatattctgttctctggatgtaccacagtgtgtctacccatttacctacttgaaaaacctcttgtttgctttcaagtttgagcagttatgaataaagctgctataaacattcatgtgtaggtttttatgtgggtgaaagttttcagctcatttagataactaccaaagagtgcaattgctggatcctatgaccagaatatgtttagttttacaagaaactgtcaaactatctgacagagtggctgagccattttgcattcccaccagcagtgaatgagagttcccgctgctacacacccttgccagcatttggtgtcatcagtgttttggattttggccattctaatcagtatgttagtgttacctcactgttttaatgacatgtggtgttgagcatgtcttcatatgcttatttgccaactgtatatcttctttggtgaggtgtctgtttaggtcttttgcctatttttaaatgggttatttctgttgaatttttaaaaatcagtgggtgtgcagtacttttgtgatagaaaaatgtagttaattttttctacactgagattttaaatagtattatgattcaagtagaatttttaaaaatgtactttatactccgcattcctaaatgcattggtgactttttttcttggagttttcactctgaataaatacaattgaataaagacactggagatggagagcaatgagatgatacggatctaggaaggagacatcgatctgactgtagtagcggccttgttcttagtagctttaattacataatttacattcatattcttttctttcacactcttttactgtgtccatgcactacttttcttaataataaaatctaaatcttttaaatgatgagtctttccacacttgtctgggaattagtttggttgcagtggggccctggcttttcttcgtaacctttttcagtgccagcttcattttcttgaatcacttgcatttaaaattggagcacatgatgtatacctgggttcttttctgaaatattaaagactcagaagctgaactagtttttgtgtctttaacaagtcatgtgttgtcgcagttgccacctgagccctcatcaggaaccctccttcacagcctcctccagtttgtcgccagcgcacccgccagcccacaccagtttccctgcctgtgcacctctgtagcttctctgagtgccatggttgtgtccatcgcctttttccattcaagaagccatgcacggtcccataggggaagacatccctcgaaacccacatgcttatcaccattaggggtgcacatgcagtgggcagttgttttcaacagaaagcatagatctcctctttaattctttaaaccttattataagcataaaaagctttttagtgaaaccacacatttaatgttaaaaatggtagctttacctgtcaatattgctcagttcctgtagggaggacaatattgttcttccctttgctcttttaaagtccgcactcctgcaccctcttcaggcagctgatcgtggctgcaggagtggaggagagaaaggagggtggccaacctgaagaggcttctacacagatgagaagggagagcaacccccacccttacaccccagcaatgtttgtattaaaaaaaaatgagtgtgctaacaaatgaatttgatggaatttcatgtcacacaaaatgcagttcggaaatgtgagagtgggagtgaccttaaagaagactccatcaccttgctgggttcctggcatcagttagcccgaggtggcagtgcctgcacagggccttccctttctgtccccgcgtccccatggcattctctttaagtgccgagatgtttccagtcagtcccctgcacctgcaagtcagccaggggtgcaagaggagtccaggtgcaacagccagggtcctttgtaagtcagggcactatccagtgatgctcagtgacattgcaccctttgtatctgtgaggactcacacctggcttttagaaagtgaggctttacaagagcttgtttgtcccttaaagaaggccatcagggtgggctggatgtacggccaccatggaccgtggaatattcctccttcttgctccttagcacctggcttcccttctcaagtttacctcattttactcaaggacagttctttcttcatatgctcttcagttccactgcaagtgtggtccagggatcggcagcagcagcatctgctgagactttgctaaaatacagaatccaaggccctgccccaggttttctgaatctgtgttgctaacaagtgcaccagttgactttcatgcacgttaaaagtttaagaagcactgtaggggcttctggttttttttttgtttttgttttgttttgttttgttttgttttgttttgttttgttttgttttgttttgagacagagtctcactctgtcacccaggctggagtgcagtggtgcagtcttggctcactgcaagctctgactcccaggtttcacgccattctcctgcctcagcctcccgagtagctgggactacaggtgcccaccatgacacctgactaaattttttttttttatttttagtagagacagggtttcaccgtgttagccaggatggtctcaatctcctgacctcatgatccactcacctcggcctcccaaaatgctgggattacaggcgtgagccactgcgcctggctggggcttctgcttttttaatgggtacgtcatctggtagaaaataattgtgatttattacaaaagaaactatcatcagagtgagcagacaacctacagaatgcgagaaaatttttgcaatctatccatctgacaaaggtctgatatccagaatctatgaggaacttaaacaaatttgcaagaaaaaaacaaccccattaaaaagtgggcaaaggaccatgaacagacacttctcaaaagaagacattcatgcagccaacaaacatgaaaaaaagctcaaaatcactgatcattagtgaaatgcaaatcaaaaaccacaaagaaatagcatctcatgccaatcagaatggcgattattaaaaagtcaagcaacaacagatgctggcgagactatggagaaataggaacaattttacactgttggtgggtgtgtaaattagtccaaccattgtggaagacagtgtgctgattcctcaaaaacctagaaccagagataccatttgacccagcaattccatttctgggtatatacccaaaggaatataaatcattctattttacatgcacgcatatgttcattgcgcaccgttcatacttgcaaagacatggaattaacccaaatgcccatcactgatagactggataaagaaaatgtgataccatagaatactatgataccatggaatactatgtagccatagaaagaaataagatcatgtcctttgcagggacatggatggagctggaagccattatcctcagcaaactaacacaggaacagaaaaccaaacaccgcacgttctcacttataagtgggagctgaatgatgagaacacatgaacacatgcgggggccgggagcggggaacaacacacattggggcctgtcagtgggggtccgaggggagagagagcatcaggataagtagctaatgcatgctgggcttaatacctaggtgatgggttgacaggtgcaacaaaccaccgtggcacactatgtaacgtatatttgtcctgcacatgtatcccagaacttaaaatagaattaaattaattttttaaaaagaactgtgattatctgtcttccaaatacagattttctataaaacatataagccatacctacttcactttttattattttattttattttatatttatttctttttctagacaattttagaagtttaaaggccacacctactttaaaccttttatgatctagtaattttttggtactgctgagttattcatttcttctgtatataaatataaccttttggttagatttgtacgaatatgtggactataacagttttacatattttttttctatttataccaagtaatgctttaatttctcttgcttgtttctagttcctggccctttcttttttcatacacactttccacctgtggttttctaaaaccattttttgcatttcaaaatttaggttaacgatgagaatgctttcatttggaaaggaaagaaaaaccaactcagaatggcttccactgtaggacatgtactggctcacataagcaggaggtctggagataggcagggctttagggtttgtatctccagggtcttggtttctttcctttcttccaccctccctccatcctgaaattgacgtcgatcacattgacaaaatggccactgggttccggggtgcaggaggagagtgctggctgatgtcttgttttccttcccagagaccccagcaaagccccctcattcatccagtaaaatccacagcactgactgcatacatgtgccagctttatcccaggtgctggggaaacagaaatgatgcaaacagatagaaattcttgccctcacggggggcctgcattctagatggtggagaaagatgtaaaggaaagagatcaaatgcacagtatataggcactaagggcgaacgtgaagagtatagcaggtgtggagaggggataggaactgctgagtgggagaggggctgccatttattgcctagggtgacaggaagggtggccatgagtaaagacctgaaggaggtgaggaggagccacttgggcatggtgagggcacaggtcctccacacctactctttaaaaatgtatcatgttcttctattttttgcttcacttctctttacatttgggatgaattgtttctgctcttaagtttggttactttaaatttcatgaccttgtgttctggtcctccacctaatttcattcttcttcccttgggaaattatatttgtgtctgtcatctgccctctggctgtgctggtgagcactgggacaaattattcattctgtcattagtgatggctacctcttctgtcaacacattccacacccaggttccctctccttttgtttagtgactacaggcctttgagatgagaacatttcctaatgtttatgttaacttgcactttaattgtggataaattaaatgcttcctttatgatacattttcttcatatattaacctctaagacacttccaaacttaatatgggatgagtgtgtgctatagatgattcttctatttccgctgcttgctcattcttgacctacccactggcttttctgtcctcttgtttattcattagcagagaacatattcaggtgaactggttgcccactccatcttgccaccctttcacatgatgcttttctgaaatttgacattttaaatgtggggaaacgtttcagatgtatttggctaaccaatatttattgtgctaggaattattttttataaataaatatttactgctgagttagatcatacagccattaacttggctcagtaaataaaatgcatttagctagttgtcctttaatcgattctcccccccaccatttctgttttctttgcttttctgtgagtggctcacacagaaaattaccattgttcctatttcaggcccgtgttattgtggagagtgttttaacatcgtcagtccttggccccttctgcttttaatcagcctccttgaacagaacccgatagaaacttcatttttaattttgtgggttttattttctttctttatttatttttgatttaaactgaaatactaatggctatcaaattgtttcatgattctattacaaagatcacttctttggaatccagaaagactcagatcactttttcttctccctgttatttcatttttatttactggtattaaaaaatttccctattttctgcaagacataaagggcatccagataggaagagaggaagtcaaactattcctgtttgcagatgacatgatcccatgtcttgaaaatctcatagtctctgccccgaagctccttaagctgagaaacaacttcagcaaagtctcaggatacaaaatcaatgtgcaaaaatcactaatattcctatacaccaaccacagtcaagcctagagtcaaatcaagagtgcaatcccattcacaattgccacaaaaaataaataatatacctaggaatacacctaaccagtgagagatgaaagatctctacaaggagaactacaaaacactgctcaaagaaatcagagatgacccagacaaatgaaaaacattccatggtcatggatagaaagaatcaatatcattaaaatgaccatactgcccaaagcaatttatagattcaatactattcctgttaaactactattgacattcttcacagaactagaaaaaactgttttgatattcatatggacccgagaaagagccagaatagccaaggcaatcctaagcaaaaagaacaaagctggaggcatcaccctacctgacttcaaactatactgcagtgctacagtaaccaaaacagcatggtactggtacaaaaacagacacatagaccaatggaagagaatagagaacccagaaataagcctgtacacctacaactatctaatcttcagcagacctgataaagcagtggaaaaaggattccctattcaataaatcgtgctgggataactgggtagccatgtgcagaagactgaaactggacaccttacttacaccatatacaaaaattaactcaaggattaaagacttaaatgtaaaacacaaaactataaaaaccctggaagacaacctaggcagtaccattctggacataggaatgggcaaaggtgtcatgatgaagatgccaaaagcaattacaacaaaagaaaaaattgacacatggtatctaattaaagagcttctgcacagcaaaggaaactgtccacagagtgaacagacaacctatagaatggaagaaaagttttgcaaactatgcatctgacaaaggtctaatatccagcatctatagggaacttaaacaaatttacaagggaaaaacaaccccattaaaaactgggcacctgtagtcccagctactgaggaggctgaggcaggagaatggcgtgaacccgcaaggtggagcttgcagtgagccgagatcacgccactgcactccagcctgggcaacagagtgagactctgtctcaaaaagaaaaaaaaaaaactgggcacagaacgtgaatagacacttttcaaaagaagacatacatgcagccaacaatcataagaaaaaaagctctacctcactgatcattagagaaatgcagatcaaaaccaccaagagataccatctcacaccagtcagaatggctattacaaaaaagtcaataacagatggagaggttgcagaaaagcaggaatgcttatactctatttgtgggagtgtaaattagttcaaccattgtggaagacagtgtgacgactcctcaaagacgtaaaagcagaaataacattccacccagcaaccccactactgagtatatatccaaaggaatataaatcattctaaggacacatacacacacatgttcattgcagcactattcacaatagcaaagacatggaatcaatctaaatgcccgtcagtgttaaagtggataaagaaaatgtggtacagatacaccatggaatactatgcagccataaaaaagaatgagatcttgtcctttgcaggaacatggatggagctggaggccattatccttagcatactaatgcaggaacagaaaaccaaataccacacattctcacttataggtgggagctaaattatgagaacacatggacacatagaggggaaaaacagacactggggcaaatcagagggtggagggtgggaggagggagaggatcaggaaacataattaatggatactaggctcaatacctgggtgataaataatctctacaacaaaccccaatgacacaagtttgtctatataaccaaccttcacgcgtacccctgaatttaaagtaaaagttatatatatacacatatatatgcatatatatgtatatatatgtatatatacatatgtgtatatatataacttttatgtgtatatatataacttttatatgtatgtgtatgtatacacacacacacacacacacacacataaccttgtgtctaaaacaattcatccactcaatttgggattgaaaatcccaatctttttccttccactttcatatatgatattctactttattgtgtgtgtgacctgattaaatactagaaaccctgatccttgaggtcaaagtcagccaaaaacaggaagaagcaaacctcttgtgaagcaggtgacccagactgcaagactctgaggactcaagaaggggccactttgggtggggcttcatcacttcttcaccgagaggtgtcatttcctgaggactaatagattcgggcattcaagtacatcagagagagaaagcataagagagaggtgacctggagaggtaaagccttgggaagccctccggagaccttgctttttctgtggatggaagaagccatgtggatgggtaatgaaaaacatagctaatctccctcactgattcaaggtagctttagaactatgcttgcacccttgggaaaagaacactaaacccttctggttactgagtacacattcacttctgggaagatcaggcaaggtgatatgtggaacaggtagagggaggtgggaatgttctccttcctggctataggccatgggactgaaagatgggagccaccataatggctaaaatgaaagaagcaacttcctattgaaaacttgcagagagatgaaagtagggccacgtttaggtgcatccaatgagccaccatcttctgaagtcctgccaggcctaagtcggtacataatcattgaagcggactttgttttattggatatttatttagcagatttaaagttcattccacagaaggtcttggtatcattttataaaccctcaatgaatactctaaatctctatgatttatctgagaatagggtaagaaataaagatagctgcttgataatttgacaacagtattctgttggtacggatgacataatatatatttttagatccatgtcattttaattaaggattttaattagtgttttttgttgagaataaaatagtatgcatccttacaactttgtcttaaagtcattgtatttttcaaggggctttctctagcaaaaacacagatgaaggtctccataacaattggtccgcttctaacctcatgtgccttatttaaaattttaaagaattgcagaattatttctcaaaatatggtctggagtcaatagcagttcagcttcacgagagcagaaattgtggactgtctggttccctgatgtatccccagcacccaaaacacgggcacacagcagatgtttaataaatatttgtgatggagtgaatgaatgattcttaatccattttaatcattgattttaaggaaatatgtcttaattgagagtttatttcttacatttattcatttttcactttttcctgccaattgctatgtagaagcaattaaaagcaatttcctttgtaaaggaaatacccttgtagcaacaagtatgtgtcccatttttgtttgtttgtttgtttgctatgagaatgctttattaggcaaaaccacatactgtgaaaatgctttaaaatgcaacaggaggagatgtgaagacacaaagaacaagtgcatagtgacacatggctatcagaacacactaagtaaagaatccacacctcttccaccctttatccagaaaaggaaggagctagatcacctcctcctcaggttccccacatctcattctagttaaagcgaaaacaaacaggctgctgttctcagcacccagtgtggaaggaatagtatatatagagccaccttgcctcagagtctgccaaaaaaaggtcacatgtggaataagacttaccttctgatttttttttcttttcttttctttttttttttttttagatagagtctcactgttttgcccaggctggagtgcagtggcacgacttcgactcactgcaacctctgcctcctgggttctgggttcaagtgattctagtgccttggccaaccaagtagctgggattacaggcatgagccaccatgcacggctaatttttgtatttttagtagagatggagtttcaccatgtcagctgggctggtcttgaactcctggtctcaagtgatcctcctgccttggcctcccaaagtgctgggattacaggtgtgagccacctcacccagccagcctacattctgctttttgagctgagtaaaaaccttttgggaaatagttctcagaggcaaatacagacatagagagcagccccattcagtaggaatacgctgtgagccacatgtgtaattttagatttttgaatagccacattaatttaaaaatcaaaaagtaggtgaaattaattgtaacatttatttcttatttaacccattatatccaaaatattattgtttcagcgtgtaatcaatatttaaaaagcacgaatgagatactttatgttacttttttgtaccaagtccacaattcagtggatattttattcttacagcacatctcaattctgagtaccacatttcaagtgtacaggctcttgtactggacagtgtcattttagaggagggcacaaacatacagccatagcccgttcctccccctgaaattctaggaacaaaggaaagctctgaaatattcctctttggtgaatatgaatagcagagatgaatgcaaaatggttgtgacccctgatcaacagtagatttccatggacagactggtgaaacgatgtttgcagttttgtgctactttgcaggaagataaccccatgtcctactgaacatttattgggcaccactgtaggctacaaaaagccctggtcttttagagtggaccatgatatggtctgagcttcaagccttgctgggggaagatgtccacttattctcactttccagtccagtatccaacaacactctttataactcagttgtagtatttattatatgtaaaaaaacatgtaataagcatggggaagctctctggctatctccatgcaagcttcatgattagttcacttgacagctgtttattgagcatctaccatgtgccaggcattgctctagccatgaggtggcagcagtgagcaaatagaccaacactgccatctttgtcaaattttattctagtgggaggagacaaacagtgaaaaacaaaataaagagaaagtaggaagtgctgtggagaaaaatagaacagggaatgaggatggaaggtcagggtccaaattttaaatagggggtcagggtcagggagggcgtcactgagagggtgaagtttcagcaaagactcaatgttgaggtgatggaacaggctcatagatttgctggaggagaattacaggtaggaacttctgatgaggtaacttctgatgaggtaggaacttcctcaggtaggaacttctgatgaggtaagaacttctgatgaggcaggaacttctgatgaggtaggaacttcctcaggtagggaattctgataaggtagcaccttctgatgagataggaacttctgatgacataagaacttctgatgaagtaggaccttctgatgaggtaggaacttcctcaagtgggaacctctgatgagggactatgtctggcatgtttgaggaacagcatagtggcctgtgcagcagagcagggaaaccaagaagccaactatttggagatgagtcagagcaagcagcaatcccagagggagggcacggggaaggaggctgtggtcatggagagttggagagggggctctcagccactgtagaactttggcttttactgggagtgcaagcttatgctcgtaaatgtagcaaaattatggtaattattagactccctgctgaatcatgtttgtttaatgaagctcgtatattgtaatcttatgtatcttactttatgcatttaaaaatattctgagaggggccatacacataaaagaggttaagaacacctctattactgggaatttgagtataagagtcttgtgatctgacttaacatttgataagcattgctctggcaaattggtggaggatggcttgtcaggaacaatggcagaaatgtggagagacactagtatgctgttccagcaacccaggagagaggtggtggaggctggactagcactggaggtcttgagaagtcgttccattcttagatgcattttgaaagcagagccagcccaaagttaggctgaaagagaggtgtgcaagaaaacagatgaggccaaaggtctgggcctgaaccactggaaggatggagttgccattacctaagacaggaaagacagctgggtggagggctttggaatggaaacagtgagacgactcttagatggccatgtctttttcatttgggggatgtagtgtactttagcttaagtttatccatatcttccacagtatcttaaatgtgttgtctgacaccagtttctgagagaggcatattaaactctaccaatatgatggtgaatttcaaactcttctcataaccctgtccatttttacttcagtatcctggagctttattgttagacacctatacatatggtattgttatatcttcctagtgaacttttattatcaaataaagacctttttctcatgatttttgccttaagatctggtttagctgatatttatatagctatgccagcttatttttttgctattagttgccattcccttttcctttcaattattttggcattacatatatttttgtaacagctttattgagatgtaattcacatgccatacaatttgtccacttcaagtgtacaattcaatggtttgtagtagagttacagcattgtgcagttaccacgtctatctggttctaaaacatttgcatcacccagaggacaccctgtacctgtcaagctgtcactcccattctcttctcccctcagcccccaacaatcactaacccactttctatcattgtaaatttgcctattctggacatttcatataaatggaattacacaacacgtggccttttgtatatggtttctctcacttcgcacaatgtttttaaagttcatgcatgttggagtatgcatcagtactttattttcttttatggctgaatagtgttctgttgtatgtatcaatcatactctgtttatccattcatcaattgatgggcatttgggttgttttttcttgggctattgtgaataatgctgctatgaaaattcatgtacaggttttgtgtggacatatgtttttaattcgcttgagtatttttctagtgcttttgtggtcttgtttgttacatttacatctgtaatccactgaactagattttggtgtaaggtggtcatataacaaccaagttcttatctttcacttaaaattgctcataaacattaagatggtattaattgttcatctttttattagttaattatagatacagatattgttctttgcaaatatgatactttgttcataatatggaagcatgtattaaaatttaagcacagatgttccctacagttaaaagttaaatagattaggatattttattgtatcagcacgaggaggaatggcattgtcccattgagtaataataccctagtaactgcagagaattcactgcaaggctagctacataatatacaggacccattacaaaatgaaaatgtgaggctctggcctggtgtggggcagtcagtctctccttcccatgggctccaacccatggcaaacaggcatccaactaagggcttgcaacctctgcaccaggatgcactgaacacctgggtgggggatgggtaggaggtccacactgagttgctagccgaacacgccatggcactgcctgcccaaggtggggacagccacccccttggtctgaccagagactccatgtgtcatgtagctgactcatgagcctctctatacccttgtccaggaaccccactgggtgttggctgaacacgggcttcccccaaccaaagcaaccaatgtcgctcctggcagaaggaggaggcagctgtcatgaggcaggaatggggaggctgtctagggcccagggtgccaggggcagggagcaggtaggagaaaaccatcatggagagactgtggggatcacacgtgagcagaggctccaaggcccctgacgtgctccattgtgtcacttaacttcacttaaaagcatgaagtcaaagataaaattattaagaatttttgaacggtggcctcagagcaataaactctgagtgtgaggctctaaaaagcacacagcactgtgctgctccctgggtcccacactcatgaagccagccctggtgcaatgtgacttctttgtaacataatttaaaaattggaaggattttgactctgtttatgaaataaatcatagtgctattttaaattaaatgtatttaaagtatctctgtgttgtctttggttaatggcattatcagtgatatttaccttattcttcacacttttttgtgtttcaggttttctataatgaaatgagttacttttataattactcaaaccccagtgttatataaacatactttactggatattattttatataagtgtgatatattacaattctgtctccatttggggggaatacatatttagtactttaacttaaaaatatattcctctccttacccaggtccattaatataagatttgccactctcttggatactcctggtgtggaaaatcttgtcagcaccctcatgttgaataaaagcatattggaggacttagaccgttacaacaaggctcgcaaagaccctgtaagtacctgttgtgaccagacctcaggatatgggaccattatgatgacccatgtagattcagccctgaaacttccttggatctgagttggaaaatcatatggcagggggcagtggaggtagagttagaagatgggagcaagaagagaaaactgtggagactggggcttgaggaagtgagaccattctcagtggggatcccccagagggatcagatacccaaaatccttctcaggaagatagaaaatttggacttgatccaaacaatcatatcaaaatgagatggatcctagtctttgggataggtagatacagtatgaccatggttagggaagggtagcttaggaatccatgggtatctggtgcccacctcagcagcactgggtaccagattgagggtagtgggaccctgtttgagcctatgagatgatgagtctgaccagacccttttgttgagctggctgcatcccccaggattacatgggctgggaaagatcctgcatgataaatgttgggttctctttctagtgtagtaatgcatgtatgtgctatggcaaaagtcaggcttgtggcagtctgtaaattaatactgctgtcttagggccatgacagttaatctgactacacatggaaagatgaaagaatattgtgcatagtcacttttttgatacattttattttgaaaaaaaatttattgaggtataaccaataaacagtgtgatggatttcacaatttgcatacaccatgtaaccagcacatgttttaagaaacagacttaaccacagcctgctggaagtcccctgatgcctctactcaggcctttccctaagttaataccaccttgcttctaagatcagagattggctatgcctgtttttgaactctacataaatggaatcacaccgtttgttttctgatatcaagtttcttttgctcagcaatgtttgtaagagtcatccatattatagcatgaggtatttcatggcatgaatataccaccatttatttcttcattctactgttgaggtctttcagggagttccagttatttgctcttttggaaaaaaaccttttagttaatttttaagtcatcaggagggagacgccaaacacctaaacataatgtcatatacacaaatgtttactatttataaaggcatcagagtaaattgaaataaaacttcccttcagcacatggtttgctttggtttgtcttgcactcttttagttcttcattttttgctccttccctcctggccctctaagtggtatgaggtcaagtcctggttctcaaagtatggtctaaggaaccttgggggtctctgaaacatgaattttctgggagtctgcaaggtaaaaactgttttattccttttccactgtgttgagatctgtacttacgacgcataagtacatatgtacttatgatctgtacttatgtacttatggcattgggtgaaaccaatgccacctcagagtaggtcacggaagtgtcagcaaacgtcctagtggtcctggtgttcttcaccgtcatcccagtaactgcagaaagagcaaaccacagtggaatatccctgcacacctatcagaatgactaaaacaaaatagcgatgccactagccgctaaatgctggcaaggatgtggggaaactggatctctagtgttgctggtgggaaagtagaatggtgtggccactctggaaaatattttggctgtttatttttttatttttatttatttatttgtttattttgagacagagtctcactcttgttgcccaggctggagtgcgatggcgcgaccttggctcactgcaacctccgcctcccgggttcaagggattctcctgcctcagcctcctgagtagctgggattacacgtgcctgcctgtaatttttgaatttttagtagagatggggtttcaccatattggccaggctggtctcgaactcctggcctcaggtgatctgcctgcctcagcctctcaaagtgctgggattacaggcgtgagccaccgtgcccagcattgactgtttatttaaaaactaaaactgcaactatcttatggcctaacatttgcacttgtgggcatttgatccagagaaatgaagagtttacactaatgttcatagcagctattgtcagcaaagatatccttcaacagatgaatggttaaacacactgtggcacatcatgtcatggaatactactcagcagtgaaaggaatgaactcttgatacatgccttggcttggataaatctccagagtattatactgagtggggaaaaaagccaacccctacaggttgtatcctctagcgttccatttgtatgatactttgaagtgacaagattttagaaatggagaacaggttatctgatgccagaggttaaggatgcggggagggtggggacagagggggcaactcaagggatgttgtggtattagaactgttcaatattctgactatagtggtggatacataaacctatagaggtgatgaaatcatgtgaaacttcatacaccacacacacacacacccccacaattgtatcaatgttggtttcctgcttgtagtattagactatggttttgcaaaatgttattattaagggatactgaacaaagtgtacaagaaatttctgttttatttcttacactgcatgtaaatctacaagtatgtcaattaaagagaaagaaaaggaaaagccagtttcactaaggaatatccttgatgaagcagtaaaattattaagtttattaagtctcaaccctgaggccaggtatggtggctcacgcgtgcaatcctagcactctgggagcccaaggcaggtggattccttgaggccaggagttcaagaccatcctgggcaacatggtgtaacctcatctctactaaaaatacaaaaattagctgagcatgatggggcacgcctgtagtcccagttgcttgggaggctgaggcgcaagaattccttgaacccaggaggctgcagtgagccgagatcatgccattgcactccagcctgggcaacaagagcaaaactccatctcaaaaaaaataataataataacaataataataataatatctcatagggttggtgtgaggatccggtggacatagggaaggcgtttaacttactacctggccaaaagtaggtgttgatagatgtttgttctgttgttatgtgaacgtggttaagacccactgttgcctgcttacaaaaacattcatagccatatttttaagggtcttaaaatatatgcttatcttttcaggatggaacactgctgcaggcatttgtagctgaagttgcagaacaaatagttggtattgcagtgatcagaaatgaaatggtaaattgtgaagtggatataaatttctttgattgtgccttgctatatcatgaattagcccacagtgccccttttggagttgtacttttacttatttaatgtgaatgcctcctttttctgatggatatcatcatcatctgcctctatcccacttgaaggacttgcaattctccatttttttgcagttcagaatatttaatatattacaaagaccacatgaaaacattctcaccctaaaaactcagatagctttccaccacctatacatatattaatatattccatatattaatatgttctaagtattactactgtagtgatgcatttataccttccagcattcttctttgcactttattacatatatcgtgtgtgtgtgtgtgtcaaatggaaatgccattttattttttcccagtgcacagccagctatttcaaagcatttattactgaataatccattcgttcccttttgattttaaaatgctgcttttacatttattaagtttctatatgcctatgtctatttttaaactctgttctgttccgtggatttatctgttgatacctattgcattatcatgtgcttttatatctaataggggagtgttctctcatttggtgtcttctaaattttcttgttttttgttcttggttatttcctctcccaaaccttgtaatatttattattaatataattgtacctacgtggattctatagaacaatttagggagaattgacattaaaatatagagacttccctattaggatcatggatcatggctttctatgttgttgttgttgttgaactttttgggttcttcaaaaacgtcttgtggcttctttcatgtggttttctttgcatcgtattttgtgccatatgagtttttgtttgtcctgtgggtccactctccacctttctccaccctgttctgtctcagggagcctgactgatgggcacagcattatgggtacctttgccttttggctgcccgttgggtttggtggatggagagccctgacagaaggaggaggggtcagtgatgtcaggtgcctcagcaggctgattgccactgagttccctgacatttcaaggcagcctcttcatgatactcttttggattcctgtaaccagccctcctcccgcgccaccctcttagagtgggagtagcttgtagttgctgctgcacagtccctacttatctccttacacctgccccatccttgtaaatattacctttgttaaaccgccctccaattatcctaatctgatcatactgtttcctgatgagaccctgacctgacacagttctagacgttgatcacttatttctacgtgttttgtgatttctcttggtattctgagtatacactttttctcatattttctaaatgtttgtcttgtgtatggaaaagctactagtgtttgtattttgatcttgtattcaatcacctttatgaaatatctttgagcttggagagtttttcagctgattctcttttctgccacagccatcacctccaccctattctactggtcagaccagttagagggcacgctcagacacaaggggtggaggcagacttctctcgatgggggtgtggcagagtcactttgcagaagagcatgagggatgtgggatgacaggtactgtcctggtggtcatcttaggattctttggataagagaacctgctacaccttccttttcactatttatacctttagtctttttccagttttagtgtatggatagaacaacattgagtagtagtgttaataatagctggctttctggtgttcctgattttaatggaatgattctacactttccttcatttagtgtaatcgtggctgtaggtttctgatagatatcccttatcaagtaagggaaattttcttctctttctatcttattaaaagtttttattatgaatgagtgttgaattttatcaaatgtgtttttgacatcgagatgttcacatggctttatttctttaatatattacacacttttctctttcttagatttattgcactttttgatccaatatttcttggagttagttaatcttttagagatggtgttgggtagtaaggtccctgagtctacacaaatatgataagttttcattggtcctcatacttgtatactcatttggctgtgtgtagaattctattcaaattattataataattattattattattttggaaatggagtcttgctctatcccctaggctggagttcagtgatgtgatcttggctcactgcagcctctgcctcccgggttcaagcgattctcctgcctcagcctcctgagtagctggaattacaggtgtgcaccaccacgcacggctaatttttgtatttttagtagagatggggtttcaccatgttggccagtctggtcttgaactcctgacttcagatgatctgcccccctcaacctcccaaagtgctgggattacaggcatcagccccctgcgccagcctcattctaattatttctcatcagaatgttgtcttccagtatccaatgtcattgataaaatataatctgataccaacctgattcttgatcctttatgaataaatgtgtgtttctttgctctccttcttgagaattaaattttctttttgtatctggaattctgaaattttgccaagaaatatcatgtctcttttggcagtttgtcttctatgatttcattaattatttcttctcctccattttctccattcttcttttcttaaattcttttttagatggatattagatcttttgaattgattcttcagtgtctctaaacatatatatgttacattttactcatcattttagatttcctcaattttgtcttccaaatctctaattcttcagttgtgtttattctattacccaagtattctattggaatctttatttcagagttcacctatttaacttccgagtctctttcttgttctcttattgttcctttttggtatcagcttgtttattacatgtaagatcctttttgatctctctgagtatactctgtagaatttttttaaaaattctctgctatttccttaataatttgtcttctctgcagtaagttgtatgtttctctatgctggtctttttttatttgtcagttttcctcaaaagtctgtccatgtcatgagtgaaagattaaatgatcaatttgggtggctggcatgggtatccttgacagttgtgcttgtatgtttctccatggcatctcccctgtcactggtaatgccaccgcccctctttttgattgggagggatggcagtatctggcttccccttgtgtgcttgaatggagtaccagccggcaggcagggactccaggtgacccaaggtaagaaggtttcacctagtggtagggtttccttccagtgtaaaactgccttacttttttgtcctccattatgctctcattacaccaaaaataatttttgttgttgttattttaagggatttgggatgggaagaaaattagatgcacatggcccatctgctgttttgagctaataacctctgttggctctttgctttttgtttttcagtgatttctcagccctatacttatcactcattttattttataatgagagatgcctccttggtaattaaagaaaagtcttatagtataaaggccattacagggtcaatgcagattgaaaggttgccagaactgccctagggttccgccactggcccggttaccctgagctctgtttcctctgtgctttgtgacagaagctggaaaggcaggggacctcgaggagcttggccacagatgccacagttttcatggatttgctggtgccagccttgctgatcacagaacacatcaggggccttgcattctccaatttctgttcttgaaagtaggcttttaaaacaattttactgtggaaaacaaggagaaatataagttggtgttttgcaacctgcatatatgatttgatttttcctgcattttgggtgcgtttactgctgctgtcatcagagagtcacactcaccttggagtgctcccctccccccacgctcctgacagcatacactgctgggaggtgacacaggacaggctggcccagggcacagttagcatggagacctgggatcccagtgcagtgtggggacagaggggggaccagaactgggcctgtggaaacgagcagtgtgcctgatatttcctttacatgggaagacactcatcagtcctttaaattaccttcctctgtaaaaatattacacatcaagggggatagaaggtttaagaagtgcacagggataaggcccaattacgcagttttatagcaggccagccagccatacatgtaatcaaaatgtatgatatggggccaggcatggtggctcacacctgtaattccatcatttgggaggccgagacaggcagatcacttgaggccaggagttcaagacctgcctggccaacatggtgaaaccctatctctactagaattacaaaaaaattagccaggcgtgatggtgggcgcctgaaatcccagctacttgggaggctgaggtgggaggatctcttgaacccaggaggtgaaggttgcagtgagcgaagatcgcgccagtgtattccagcctgggtgacagagtgatactgtctcaaactaaacaaaacaaaacaaagtgtgtaacttgggggtgacacatttccacactaacaggtgaatagtaatgcatcagagaacaccagtggctctgtttgcccgactcctgaatttcccacaggctccgtctcttgtgctgactggcttgtgctcacatcgcctggcagtgtcacggagctgctgtcctgccgcttggccaatggcacagactcggggctctctgagttgatagcagccatgggtatggaaggagcacattacaagctgtgctgccatcccccaaagacaatccatcagaacaactagcactcaggaaacgtaatttctaatttaaagaatttaccatggagatgaggtggcaaatatggaagagaaaaatacgtttcttactatcatacctaaagtaatttttaaaagatatttatcacaaaatgcatgccgtttgtttaaaatgcttgtagaaaccatcccttctgtctcttctgtaggacattgagtacatacggtcccattacaacattgaagatttcatctacttcagtcaccaccagcgcgaagaacacgggcacatgcatcactttgccctcaaccccattttccggcactacaccaagttctttctgaaggagatcctgcgtttaggctttaaatcctgtctctactaccgtgtttacccaaaatccagagaaggcaaggtaagagaatggtgcaattcactttcccagcaggtcaacgttcacagtgttgttggtgttgtacgccgcattctattcattcctctcatgatgggttttgatgataacatgggtctgaatttccaatggccatatttagtttggcctttttcataaactacagtgacattctgtaggcttcgaatttctgacacaatcacaactaatataattggtagtacaatatgttggcttttctatattgacaaaatagagactgaaaactgtgcagaaatgctctaagagcatgaagatctaataatttcttatgatacgtgagtacaatgccaacatgatcctattctgttccttcaagccaagaacatttcagtgatgaatccatagaataaattaattctattttagaagactggcatgctatcccagcattccaaataagcactatacacacccctactaggtgatggagagaaagtgcggagatgcctgatgccgatgtaaccccatgtaacacttgccacatttgcatggagtaatactgtggtaatagacgcgaatctgatgtgtatacatggtgtgtatgtgcatgcacagatagcaagtcctccatcttacttgcatacctcccatcccactttagtgttcctcatagcactcaccaccaactgaagttatctattttaccatgaacgcagccatgcttttatctgtcttgttcaaagctgtatccccattgcctagaagagtcacaaacacacacacacacagagacaccccacacactctcatgcattcatgcacatataccacactctcacacacactcatgagttcacacatatactcacccccctcccccacacgcacacactcacacactcatataaggtgtctggttgttccacaggaaaaggcctattcaagatagattcccaagggttttttttcctgaaaattggtctctcagtcactgacaacattggtcctcaacttgatgtagacttgggggtgaagggattcaaccactagaacaggtagaagttgtcccgtaagattccactcatgaactcaaactttcccatgttctgcctagagtctttgacattgtctcatcagcacaagggagctaagggatcttaaaatgccttattattaatatgtctatttattaaacaatctaaagtgtgttagtacatatacacataacaataattttgccagtgtattttatttaacgaaaaccttttggagaagtccagaaaaccttttggagaagtccagagggaatggggaagaaagaagaaaaacagaaaaggttttgagtgagatgtagactctgctctagttttttttagtttttgttttttcctgtcaaaatgcagcaccatggcaatgaaatggcccagctttgaactcactgagatgggaaggtaacagttctgctggaaaatcctggtcctgcacagttttcttttactttgcacttggccaaatgccagttttgtgaccttcaggatgtgatattaaattcttgtttttattcatgaagttgcctggatgttctgggttagagaaagtccatttgcatccataataaaaataataccttgggcatttcattaaatgtttatacatttacctcaatagtatgaaattaggaatatgttccacactgttgtatgtagcctctaaaaacatgcttggaaacagatttcttctcagtctgcccttccagttgatttcacatattcatttaaaacaagtgtatgaagcagttccaaataatttgggtaagaattcccaaattctgctataaatctccagttgactacagtaaagttgagctttttggctcacattatggggatggttttctctgtatccctctggtcagggcatgtattaagagctcttccaggcataaaaacagggtgctggctagggttctgtttttcagtttgcgaagtcacggtctgaagtccagtggtgaaggattttagaaaaccattttagaagctcttagaagggccggggctatttttagaactgcaaaaaagtcataggtaaaccatctatttattaaaatgcatctacagttgtttttctgtctttgctttccagtctaaattcaataaatgtatcattaaaagttttgattttacagtctaactcttcagatttaaatggttacgatgtccttagttcatttcaccaaaacccctaagatttcataaatgtgacagaaataaagatcaccatgtttggttttctctgctaagtttttaaaactggataaaatcaatatttaaagcattcccctaagacatgatttatcatagttcatttcaataagtataaatccaactcataatttagtattagtctagatgtaaataatatgatctacttctcccacacccacccccacttcctagttttatctttttgttctaaaacagtttttgttgttgttgttgttgttgttgttgttgaacaaaggtctggttgaagtcactgtgagtgacttacaaacaggaggattttcacatccctgctaagttaccccttggatgacatttttatctatgtgtcttcttaaagcagcttgtgccaaacatgcaaaggttaacaggatgcagataacacagcttaatggggtcagatcaagctgatgcatgatcactatggagaagaatatcctcccggggaaaatacttgtactgaaaaatcccataaaccaaaccacttgtttatctgtcattcccacagagatagtaatgtaattactctcgtaattatcttcattagtgtcaggcattatctacaattcattcctctgctcgaagagtatgtttgtttatttgctgatttttttttttcctctctgacttggccgagttaagagttttgtatttgtaaagctgtacgcagacatctgtgctgagcctctctgacattctctcccctaaaatatagattgctgtctttcagttccagaacccctacgcccactccctgacatctgcccttcattacttggttcccgtgcgaccacgacgacagattgtctatcctctggaaaagcttggcataaacgctccatcaaaggcggtctccaaggatccggtgggtagcagggcggcaggcagggcggcgcggtgccagctcccgcgggcctggcagatggggtggcagtgctgtcttcacaggagcaggctgcttcttaattacagggaacctggtgctcatacccttacaggcggagccccgcgaaggctcccctgcagccctttccctcaagtcgttatttcccgggaagcctaaagcagtagccacaggaccctgcagggtcatgccatgaggatacctctcaggctgctgtgtcccaggacaaaaggcctagagtcatcctccagcatattttcattttctttccctgtcctcaaaagcagattccccctttcaatgatgttttgctttcaatgcattaagtggtcattcgctgttaggacaaagctgacagagaaaacagagctggctgcattcgagatgtttgggccccgggtcctaagctggtttgtttaactccctcctccatttgaatcaagatgattaacagaagcatatgagctgccctggggcagcaggagtttctgaccttaaaatgaatggccaggggccacttttattgggagaacaggaaaaaggactgaaatcaaacctagatattctttataaatggaaatgtacctgtatacatacacacagttttttcaataacttaattggaaaacataattttctcatgttgactgatatgggcttgtagtgtttgtatactctttcacttaagtaagtaaaaaaaaaaaaaatccctcagtgggctaacatttgtcctttgtgagacaggaaaaaaggaaagtgtaagtttaaactctccaaacacttacccaaggagctgcccctcagagctggagacgatgctgaaataaacacctcgcaatacgctcggcgctgcaggaaggacatcacccgacccagagcctgtcttacttgtgcgtgcactgagggatggggcgtacctccatcagaccaactcagaggcagctttgcgggtgcactgagggatggggagggcacctccatcagaccaactcagaggcagctttgtgtcttacattcatctttatatttgtaaaataacaaaaaatttatatcattgtaaatttatatgtgagtagagactgttcatataaagcaggacttctcaatctatctgtcctttttttaattaatgtgcaattagtcatggactgatagttttgtaaaaagtgaattcctgggaaaacaagattagaaagcaaagacagacaaaattcttttattattagatttaacagacatagcattactctgctggtttgctataaaagcttctgaatgcttctctcggtctctcttactcatatcttcatagacttgtaatagtttgcacatgggcacctgttccagaacacagattgagtggcactggaatgcccacgcactcagcacccagctgcaatgatttgcaactccttagctaattttggatgatctgtgcccccaccacttcccctttctcctatatcattttgaagcaaactccagattcatatcattttatctgaaggtcacaggcatattcttaagtagcagggtccacagcactggagatgagacgtgcctagcccacctggaagacatttgggatgggccaccatgtggtctgtttgcatgtgaagatcctgggaacagactgctttggaaagagagccaacacccagaagtttggtgcaaagacagtgtcttggggtcagagacagtggctacatgctgtctccaccactgaaacacagtttccacagaggcaaactgatctctggagaaggcgctgggcatagaagtacatggatgtgccaggcgtacaaccttgcagcttccgtatcagatcagggtcaggatgagagatgctgaccttctgcagtcagtgctgacacttatacttcagtggcagcccacggctcctgcaccttcagccagccctctggcagcgtgggtggcctggctggagctggagggaggagtccagagctgctgcgtggatatcaggaagcatcgtttttatgaatatgaagcagttccacacctgccccctccctcccaccctactgtgagaattttcagttaggtgactttgaggtgagttggagctctaggtggggagaaagccagagagaacattttatttcatttaaaattatcttattactgcttcccaggttgctatgatccgaaaccattgcttacattgagtaaccttttccatgtttatctcagtatgctgtgcccctcacccctgagccctggtgtatttcagcacaaagccaagatgtattgttgaaacccagggtccaggaagacagccacttagcaaatgggtgggaggattctaacacagatgcctgctacctgctgctcgtgctattgtgcttatttcacaggtgaattctgactgtttaagaagcacttttattgctactcattgtactcaagcttcagaaaattgtaatggagatttagatttagtaaacaagattcagtgaaaaattttagacatattaaaagtttaatcacaggattatttatcgagaccataatccccatggaatgggcctcggtattaaaaagttaaaatgctaaattatattattaaaattatttttctctttttaacattttagacagttttaatgttttagagtgattatctgacacaagttgagccaagtagaatatttttaggaggaatctcagtatagccctcaagacattgttttcttagtagagcaatagcattgcagtagcaaactgtgcaaggctgagcaactgtcattaccaaatgaatgaattttccctttaggtttcacatctcccaccgcccccccgccacaacccctcccagtgcatcaagctttatatgagaccctcagctccctcaccatgtccatatcatttctcttgctggccactcgtctttcataccttttatcctatttaaagcatcttagagtgaccatccagtccctacctttcacctaggaagccaatcttcaagggaacagatcactccaggcatgagtaatgggatagaaagcatttcatctcggtaggttgccaatttgaatctggcacaaggaagcagtgattgaaattcatcactgcatggcagggaaatatgccctcgctcccaccccaaggccttcctaattcctgcctggtttggacgatcagtgtcccggccacaacaccttccccgtcgtttctattaattgacagcctaccccgcagcaggtcataaaaaagagcctagaaaacataaatgattttcatcacacatttcagaatcaggcctcaaagattcatagtaatgtctccacagtcaaccagtgtgaatgcatgggtaagagagagggctttttcctgaccaagaccgtaattgacatcatagacctgaaagattcttttctgagcttgaatgagccatcttggcctgtgcttttacattaggagagttactctcatggaagtttttattagatgactcgtcagggcctgcctgcataagaattattattttttacaaaattattttatttctttaatttttagtttttgttggtacacagtaggtatcgatgtttatagggtacatgagatattttgatacaggcatgcaatgagtaataatcacatcatgtaaaatggggtatccatccatcccctcaagtatttatcctgaatgagtattatgatcaggaaaacactcaaaattgggctgaattaatttagtggttatattgattaaagacagccgaacaagctgccttacacttattttgagggtgggtctacatacaaacctgttttctttcctttctgccttttatagggattcagatatgactgtgtcaccatccatgcctgcatggagcttccagtctagtttcagtattaaatgggggtagatgagggcttgtactggcctcctaggtgacacgagcccaaactcaggagaaatagccacactgggctcagacctgtttctgcagaattcctggagagggaatgtgtttgagaaaaaggcactgcttcctttccaggaatgggagtttacacaactgttatttgtcatattacactccagaaaacctgctttgaacttaaagagcccctcccattgcctcaatgtcaatagttgctccccatcatccacttcagtcacttcagctcttcatcttggtttattgtgttcatagaattgtagcgtgaactcacctctctctcagttattttcagaactaaatcaacccttcatccttcctgagcaatcatactttcagagtgatcttgtttttttctggttgcttattaatgatggtctgattaaatctcaactaatgaattctttggaggcctccatttggattctgtgcattcatttctccacattttttctttgtccttctacaaagaaaaatgacggcttatggagcccctccccctcagagctaagtgatggccctgctttttcctggtatgtgatctctcaggaagatgtcactcactggcattcagttaccctttgaattgccccttttcatctggctgttcttcccagtccagctataattaccatctgatggactgttactggatactgtttcacttgtgcatctgctgccctaggaaattgcattattctcccagcacctgctagattttccccagctttattgtttcccagccccttccttaaacttggtaactttcaccgccagtggttagacttcccttggttatatttgtggtcggggtatgtggtgtgtttttagctctttggccatcaccttggtagaggtttctaaaaaggcagacctgtattttttcagcatcatatatgctctaatcattattaatgtgacgatgggaggcatattttcttgaaatgaaattaacccactttaaatcatcgccatgagtccagtttgctgcttcaagccacttcccagccagttcctatgtgtttacactatctatgagaagtgcatttccttctacttatagtgaactcttttctctcagattcttgggatcatttacataagttcctttatgggctttcttctttctacaatacaagttctgtggccatttctttccaattctctgaacattgtctagtttaatataatatgttatatattatataagtgtctattatatgaatagtatataaatattcaccagaaggacttataaaccagtgtttattctcattactgtcctaatttttcgctcttagaaaggttacaaggtaataaaaacaactactgttgcattactgttacttcctgagctcttgcttaaagaattcccatggagtttctcatctagtcctctcatcagcacatgtaaacagttactgcaattaccatcctcagtgtacctaaagcaaacaggcttgccaggagagcaggtaaataacttgtccaaaggcaaattaattgacagagtttcaaacccaggcagttggttgccaaaactcctgtctttaactactacagatatactttcctacctaaaggctgaagtactaatatgactcatgataggaaaaccaaactacagaaaaggaatatggcttgatacagatcttgttgaacctcacaagtccttggcaccaggtacttaacaaaaaggtgacccacagacgattgcatttctcccagtgcagtttgaattttcctcttggctgaatcatccactcttgggtttgatctggtaccagcctgaccctgtctgacctgggctaggaaggaacagacatgggtccaggttggtgtgctggcaggttttggacacctgctgattcaggctgtctgcagttagctctctgctgtatgggtttgttgttgcaaacctttgtaatttttgttgttacaaaaaacctttgttgttacaaaattatggtggcagctgctgggaaaggaagaaaaaaattatgatcccatatggaggctacattatacatttcccaagattcagttccatgttggatgtggtttcagaacccaagtaagtgcccatcagatgagtaactacaggtttattttttggggtgggggttgggtggagggaagagacaggatgtgaattactggcatgatcaacaagctgtggaaattgttgagtaactgggcagtggtcaggtggcaagatgaggctgtaaggatatgatagagaagaaactgggaagagtaacttcttaacatcttagtgttgtcaggaatcgatgctacatcttatcctcattttctaggacagatatttataggacagtctctctcttcccacagccatgtctttaacagcttcacattgagatataaatcatacatatacaccatacaattcacccacttaaaccatacaattcaaaggtttttagtatattctcagagttgaacaaccatcaccactatctaattttagaacattttcatcacctgcaaaaggaacctgtacccattggcagtcacttcctctctttcccagccctctgctctcagccctagacaaccagtagtctacttaatctctctatgaacttacctactctggacatttcatacaagttgcaacatatactatgcggtattttgtaattggcttcttagcatgtttcatccacgttgtagcgtgtgtatctgtactttatctcttttttattgttgactatcctattgtgtggataatactatattttattttttcatgcatgagttgatgacatttgagttatttccactatttggctatgatggaaatgttgctatgaaaatttgcacacaggtttttgggtatatatatataccatatatatatatatgttttcatttggggggcggtgtctatacctacaagtgggactgctgggtcacatggtaactctatgtttaatattttgaggaactgccaaactattttccaaagtgactgcattattttgcattctttcattcttagatcagattcggcattctggctaataattgatgaagtgctggtcaaatcaaggccattgaagggcaatgtctcaactgttctttcagtttcagaagtagagtttccaccactccaagagagcttcatacacacatttgagactacactggtaatactgtttcagttcttttgaaagcagagatttttctaaaataaaacctctgttagctttcctgcttcaccctctctaactcagcagcctcttgtggtcctgtgtggacatctaagagagctcaggtagcaaacaagatgcccatccaaatgcaggaggaaaatgggggactttctgtttttttaaagccaccagcaggttctttgtttgacccacctttagtaatattattgctgttaaaaagagctgccactgcttccaacagaaaagaaaaaattctaaggatttcctggatgctgatcgggttcttgccacaacccagtagggggaaaaaaaatgcattctcctccctgcagagccagggtaatgaatgccacagaggtccagaagtgcctccggacgcatcagctgcctgctgcagagctctggaagcctgcagcctagcaaggctccgggtggagctgagctcccaggcagaaactggccgtggcagctaagtggcttcttcagaatctgcctttagggaagaaaggaatggcagctccaacgtgaggctttgctttgtgtattttaaagtagctggggatataaaatgacaaagaggacaattagagctgcagatactgactagagaagtgacatcttttccccttgattaaaaataaatatgttattacaaaagcaatctatgtttttggtagaaattttaggaaaaaacaatagagaaaatcagtaaaaccttcactcctcctatcttttgattacctttgttaatattctggggtttcaacttctggattattttctgtgaaaaagactgcatatatgctattagatatggggttatagtgtttgaaacatgcctcttcacttaatatgttatgactgtatttacttgttactaagtattgtaaagtgtgattttcgtggccacacagttttctgttaagctgcaagccccgctgctcagtgagtcctttcctcctgcccggccctgcattacatcctgtcccggatgatctcctttcattctcacagatgtttcagagtcatcgtctccattttgcagtggggaaaactgaggttagtagaggtttggtaatgcaaatgagcgttaagccagtaggacttgtgtgaagtcataaagccacttgagttctgtatctcatcgtcctgtaaatatgttctatgtggctgagttttctcctgcacccagatggaaagtgagcaagttctgggaccttctggtcaattctaggtcattaaagctgtatgggtcacttccaatcacaatatatgatcttaattccataaaatgtccaatttcattttatgtaataatcaaaattcaattttcctccaagggttagactcccctgacccgctgctgaagcctgcagcacataggaagcctgtggctggagaaggcaggatggggagggcctcttgtctcttcctaactctcgtgccccttccacttagcatctatatagcttttcagtatttagtgttttctctttctttagcctattagtgtcttcttattattgagttgaatttctagtctttctgaaattggggtcagggcagggaggaacagttggaggaggaggcaactccatgatgcaggagatgccatcctctagctttgacactgagtctcatttgcccctggaggtgccccataggaaggacctgcgagaagagctcttgcctctgtgggtcagcaggttctgcccgtgcaggccacctgcccttcagctcacccagcacatccatccactgtgtctaggggactcacatgaagctcttggagggctcccaaaccctttctgtgacttaaagcaaaggacaaggcaccccctccatctgtcctctttggggtgggggggcatgggactcacagcacgtcaacagttctcctggaagaaatcttcaaaaaagccccttctgcatgtactcatctaaccctttcatgtcttcattataagttaggagttaaaaggcatttaatcggtgcttgccactgactttggcatttttataagggggctcctttggaatgtagcatctattttcttcatgccgaggccacacagctgctaagtcacggtttggggactaaacagtgtgatgtcagagcccacgattcaccattgctgtgtgtaggccagttccctcatgttggttaagtttttatcccaatttttatcacgatgaacagtgctaccatatctgcccttattatttttcagcacatttgttttgatttcctttgaacaaattcctggaaatggtattgctcagtcaaaggtaaagttactatctctttaatcaaaaagcataaagttttagaatttgaaaatgaaaacttgtgattcctgaattgaaaaagatgatttctcttggcaatatgttgctttatctaagcaacatacagagtacagagatatacaacaaaccctcttttttatgtcagatacagatttttaagacaagtaaccaggtgtgcaaaaggatacatcttttattttcctatttttttctaattgagctgagtctctgctttgagcctttattccacctgatgggagtaaaagtaacctccatcaattctgggtaaatttaatcatttaatgtttacattgagtccatttgggagatttcttctttcatgtttttaggcaggtaggaaagacatccaagttctcaggagctcatggacatggaatgtcatggcatcgtggcaggcggggaggaggctgggaggggaggtacctgctgcttgggtagtgcctgtcctcacaggaatcctgagttcagaacatcagcttttgtcctcaggcaaagtcaccccttgtcctggcatccaggcccccgcagccctcactgcttgctgcagaagaatcccatcctcacagccttgaggccagtctgagtgtggccttgtgttccctggagctacgtgctctcttcctctccgctttccttgctttgggctttcagaagctcattgctgcctcatttccttcctcatccaggaagttccctcagccatctccactggactcttcccaggacaaggtggcagtagagtctcccttgtgaggcagtctccttcctgtattctccaaaatctttgtagggatcctgcccccttccttccactttcctggccttagccagaggaaggagagggctgcgctgcactgatttctccttcttcccctctggctttcctcctcctggtcctcagacagtgggctcgctgtccccatgtgttcttctgcatctgtcattggaagcatcaactttgacttttgatgcataacagtcaggcttttcagactcaaaaaaccttcttgcaacccgttatctgcctggaaacaaaacagcacagaattgacgcatttgttctctggggctgggtctgcccaaaggcctggtgtcccctggctgttgcctgcagcatcaggaggggtcatgagtcagcagggattggcagaaatgaaacacatctgctagtacaaaaacaacaccccactaggatgacagcagcgacagacacatgaaacacagaccacgaatgcccctctggggctggccgactccctctggctcatggaagaattataaaaatgtgattccattcattatgaagtgattggaggtcagtagatgcatatagaataaagtacagtgtcataagcctaactttcaggcctttttattaaaactttcacttgttacatcccgttaataaattctagttttacaaatgggatatgggccaggcacagtggctcatacctgtcatcccacactttgggaggctgaaataggaggatcacttgaagccaggagtttgagaccagcctagtaacacagtgagacccctacctctacaaaaaataaactatttaaaaaatgggttttgccttcctggaagatgtgaaagatcaggaaaaacaaccgagaacctagagaggttttacattcaaattaaactgagatggattaaaagccttccacagtttagtaattttcctaaagcaatttgagtttggttatctttatttgcacactcatcaaatccagagggaaaatggcatttgagttcatcagaggcagaggattaaatgggccttggaaagtgcagtacctggttagccgggggcgcggtcctcccaaagggctgccccacgtggccttggtcgagtgggcagggactgcctttcacctctgtgttccattagagaagcagcttgaagcccacagtcctcagttctcaatctgctctcattctccagggttgagccactttaagtatcaaaacttttagtctgaatgttgcctcaagaccattaagcttagtcaagatgactgatgtcatgatctccatagtaaccaacttaataagcaagaagaaaatacaaaagatgacttaaaaacaggggaaaaaaacagaataaataaggtatgaaaatagcatgggagccataaagattttttttactgccactttgagatatcaaacatgactcagctacagtgcaggcaggcatgagccatttggtccgtcgaaacccatggcaataaacataaattacagactgtgccacattcctacttcttgtgctgttcaattgtgtcccaggttttgtttgttttattttttcatataattcagtgcattgaaattatcaccatggtagtcactgtaattgtggtttttatggtagtttatgtatttaaccaaaaagagctgtgcttccagggaacaggtctcaggcagcactttccagtcaccttagcagagctcctctctcatgcaaaccacccctcccaccgcccttcacggatctgtggggacagcacttttcatgaaactggagttgacggttgatttaaaaaatggatttgagtattatctgtcacaaatcacagttgagcaggtcccaaagatgggctgacaatgtcccatagaattatatatcacaagtcttttgatttgtttgcagacaacatcgatccccacacactgggtctttggtcaccgtgtgttggtaggaccgaggctggcaggcccctttcagaccatgtgacttctaacagctcagtacttccaccaccccattcaagagcggaaggcggccatagttcacagagcccaaattccaaaacgatctccaggcccctgaggactcagatgcttctcatgactctctctctctgtccctctctccctccagccatctctctcacacacacaccaggcatacgtaaatacatacacacagagtacacacaatcctcatccaagtttggccccggggaagtgcttaaacttccaattccaagcacgtctacatgtcgtcacttcctggtgcggtgggagacaacagcctgattctggagttctgtgacccacccctgcctcaccaagagccaggtgtgcaccagaagccaggtgggtttgtctctccctgagcctgtttctctacccccaccaaaccatgtttctaggtgtcctgctttttgtccatgagcccgataaacaccatggcttttgtacctgcttttcaactgagagaggaacccctgctatcctccacccccacctgccactgagaagtccccttgttggtcactccctgctcctgcctggataggcttttctgttgaaaccgcaagcacagggcctgttctgcttcgctggttaggaggcttggtggtggagagttaattgatgtcattcattcagtcagtattgttgtgtactgatcatgtggtgggcccagctctgtgctctgtggggacagccataaataggcacatccctgccacatagcacttgtgttctagttggagcagcagacagtacacaaacagaccaggaggcaccgtgtccggtggcagcaagtgccatcaggaggagagcccgggaggggagggtgggaacagggcaggtacaactcctctgatcaggatcatttaagcagagccctgactccatagaacacagaggtggcatgtgggccacaaggaagcagctaatgccacttcttccctcagaccctccagaaggctctgctgcctgtgagcccctcctctgaaagacacgcctccacacacactcagcccgtgcagctttggtgcttttgacttagtttcataattattttgaaagaatttcatgcaagaagcccatcagatgcaattaaaacatgtcaaatatgttctcaaggcaaaccctcccatttttaaccttgtccagcttgtgaaagtataaccagtgctacatgtgattgtaactccccttgaaaccaccgttgctatttctcaaaacgggaggggaaaagcaagccagtgggctcagaacatgaatttagaatttcaggaatccaaattttggaaaaggtgaaatattttacctccatggcagttggcctcccaggaattcccagggaggacactgtatctgtttaagaaaaaaaaaaaaatgacaaagtaacccattttgaaggctctactcaacagatgtgtagagtatagaaatctatgtattattaaataattctttttaatatgctcaagaataagcaatttgtaagcctgtttacgttctcaccatctgggtgcattctgtcacccatctgtttcatgtaattatgtaattatcaatataaggaaagaataggtgatataattaacaagaaaaactgatccacactgaagagtaaaaatgacatgcatctgttgaatagctttttgtttctctccccttcgttgttaactgttttttcacacccttcaggagagctgttttcgccatggtgtgcaatctctctctctctctctctccaccccctccccgccccctcatatgaaggcagagtgtttcatcaggtattatggaagcgacacaactttgaaagaaatgagcaaaggcttcttggagttattcattgattctttacctctgtgagggccctgatagtcacttccagaagatgtaaggtagcagctagaaccctaggaaatatttgaattaattagtgacagatggaaggacagggcagtgtggggccctctcaggatactggacagagaagctgtttgagaaaaattcccatactcggtgcttttgttttgatatccaggctcaggcaatctgtgttgttccataacagtaccaccatcccagtggattgtgttcgtttccacataatcccacttaagttagtcgctggagtagctcctttgtgtaacagagctttgtgtatgtgggcacacagatggaattcaggcaacttcctcaccctgcaaacagaaatggcaggagaatggtcaccccctcctcagtctgaccaggccaggctccaaaattctccctccatgacttggaacgagcaatacgtatgtattcagggaggggcatcgcagtgatctcttagtttctgtgaccccccaccccaagcccttctgttgagtcctaaattcagttctccaaagatgaacactgtccacagggattctccccaacaatggaggaagccatccctgaagatgcatggtcttgacaaaaccttgaatttcaaccccaagtcacacaaagaagactcacagccccctggaccgctgtaaacagcagtcactattagagatgaaggcctaaaatctcaacacttctttccactgatggaaaatttgggagcagggctcccctcctggcctcctcagtattctgcagacatcctgccctctgtcccaacagggatcttgcctgcagagcgctgcacctgcttcctgtttagggcgcagggcaggcagaaggagagtggagagagagaagcatccacagggagcagactcataaaactacaggggctttctaagcaatagctctcaccaaggaattaaaccccactcagacactgacagagaaatctcttattcagtcacttcttaacttttttttcttcaaacagtgccactcacttactctagggctcactctgtttcctcttgcttggtgatcattttgcatgttgagattgtgttgttttggagacgcgtgctcatcttggcatctcgtgacagagcctcttgatggcacagtctccgtccaggcttggcttctggttcacctcccacacgggaagcctcatgtcaaagcagccactggcttctctgccttcattgttccatgtccagcaagcaaataaataattagttcccacgcaggtttctctttgtttctttgagtcaaaaattattctttgataagtcctccataaagccttcctctaatcctccacgaaaccttcctctaatctatctgtattttgaattgttattgctaaggattttgttcttaaaacaacggatacccatagaacaagcatattggagaaatcactggcatgccatggggagagtatttggaaggaataagtagtagggacaaacatggctgggatactcaggggattttgttggttttgactttatgtttccttaaatccaaagttaaaatagtttaattgcaatcatcactgactaatccattaaggattttaaagaaaataataccacgtgactcctaaagacccttttgtttgccatttctagttttgaaaggttttaaccatgatttctttttcaagaaacatttcaattgtattttttagtatttaaccaaagaacatagagtgattcttcctcaagaggaaattattatagaagacctatttatatatatatatatcatattcaactaaaaataaaaataaaaaaacttcatattctgtactgaaccacattaaaaatcattaaggcttagactatatggttttcatttaaccctcaaaagtggcattaatttttcaagtggtaactgttgcttaagatgctattgtgcctgtttgataaatgtttaatgatttggtagtacatgcatggcttaaaatccattatttattgcacctttgcttgcctggcaaaggtgacgattttatagccccagcagtcatgcaaacacatttataccaaaccgatgactgataataaatttccttactgtaaatgtcagtgggtttcatgtgttgctgccattacatcttgtttggaagctgaatgctacacagttatgggaggcgccagatggtgtcattaacacgaacactgggactgtttaccgctgacgtgcgtgtgagaaattaaaagtacgtgacctatctttacactgacgtgtgatgtcagtggtgaacgggtgttaattacagtgcaatatgcttgcctagtcccttccatcccactcagaggggttttagggaattttttgaaaatagtttgtgtttgaatatacacagagtgagcaaaagggagaatttcccgaggactcctgtttggttttgtatttggagtctcagacaccctgcaagtcacagctgtcatcacataggtgtcactctcatgagcagcaacccacatccctgccaggacttctgggcatggggaagccttttgtgctgattaattacagcagtattgttattgctgtttgcttggttgggggttttatttttattttcgtaactacttcagatattttgaatactgttttggaaaagtttccattgagagcatggaattaacatttttttaaactgctgtcaaaatcatcaggaattgattcaaagaatgagaagaaaaacagtggaaattttctataccaattttttttttttcatgggatgggatcttcatttcctaagaattagcggtaaagacttagatctttattttccctgatctgatgtgaagtatctgagtgactgaaattagccttgtgtgttttattaaaatgtttctctaacttgtgttcagcagtggccactcccatttattgtatttcagcttccttcctgttgacgtttctgcttagctctcttttcatttctatttaaaaagaaggtggatttgttttattcctccctccaagtccttcacttgaaccaagaggctattccattgaatctgaccaaattcctttgaactttgtagccttagcatactctgtaggaattttcagaaaggcttattctttcaaaacaatcattgtgcattgcttttacaaaagcccagcgagccttttggtgtacagaattttcaagtcatgtgaaagagaatacaaaccattgtttgcattgagatgaaagagatatgcttaatttcttcagactaagtcagagatacaattggatgtcaacagaaatagtgagcctagctgaaagactaaaattgtgcatggaggcacacattagaaatttaaaatagagtcgcgcatgttagcttgctcacaggacacatgtgtgttgaaaatatccaggagtgaaaataaatatgaaataaatatccaggagtgaaaatggtggcaagatagcaagattgaaaagttgtatctgtggaacagcactcacttggaccaaacttctcagaaaaatgagttttctgccactgctatcgttgttctagcaaatgaaccagaggcctaagccagcagagcaaatagccacttaagttactgggcctgagcaaacagcatattccctgggggaacagaagttctcatcttattctgtgtgcagagatttaccaaataatgttgcctgaagggaggtcgtggtgtggacacaattggccatcagctttccctcccagccttttgtcccaactccttctcctccctttgtgtctccctctgtgtctgcttcttgtattgcctctgcatgaccatgcagccttctcctttcaaaggttgctctcagaacataatctgcaaatccattcatgtagactgacctatgggtcagtgggtgtgtcatccttccaaatccttgccctggcttttccctctcatccagaaacttgttccctcttgttcacctggaaatatcccattgattctgctaaatttagctccactgtcactttctccaagctgccttatgtgacttttcctgctgtcctagaacagttaaacttcagctgattccatggcttcccagctgatatggtttggctgtgtccccacccaaatctcaacttgaattatgtctcccagaattcccacatcttgtgggagggacccagggagaggtaattgaatcatggggactggtctttcctgtgctattctcgtggtaatgaataagtctcacgagatctcatgagcttatcaggggtttctacttttgcttcttcctcattttgtcttgccaccaccatgtaagaagtgcctttcaccctccaccatgattgtgagaccttccccagccacgtggaactgtaagtccaattaaacctctttcttttataagttacccagtctcgggtatgtctttatcagcagcatgaaaacagattaatacaccagctgagtccagaaaaacttcctaggtgagcacagcctaaactactgacctacagaaccatgagccaaatgaatacgtactcttttaacccactgtattttggcttggtttgttacacaacagtagcttcctgatacactaccattgtcacatgtactgcattttatttgtttacttgtctgtcccccaacctaatgagaattccttaaagacaagaaccatgcctcattcacacctcagcatttagaccaattgttggcatctggtagatccttgatatgtatctgtcaaattgaaattgttgaattaagctctgctaaagttttggtggtagaatttcagacatcaggatactgaataggttatctcaatgccctcagaattgcttcacacattcagttgccttccccactaacaagttagactgtccttgttgctagtgttaaagatagtgggccccagatggagtcacttgtgctaaagttccactttaccaatctgaaactaggttatttgcttgaaatatctgaccttctgagaaaccaggagagaggtgatattcaaatcccattaagccaacaagattttgcttacatctctctaaggaaagtaatatcgaaatgaccaatccactacttgttcattgttcctgtattccttcacttttttactgccgataaaacttacccactctgtctagctcatcagagctcctttctgttttgtaggttggatgctgcccagttcatgaattgctaataaaagtcaatcagatctgtgaaactcaatttgttgaaattttgttctttgactctagaatattgattttatcccaaaattttttttccagagttgcttttctagttggagaaatgactctttggcatagtaactctttgctgtatagtttaagttgtttctataggaataagggcagattccagcctacttccaggatagtaagtacaaaatattttaaagtctatggctaaatagcaactgttaatgcatctctgatatatcatatgtcccaccatttatgatatggattggaaagagaaaaatgacctgaaattctctttcctttaagcaaatagtacttagatgatgccccatacattctccaaaaaccttccccttactgtttttaggatgggaaaacaaccaacaatataaatttttttcatttcacaaaaatctgagaataaatttaccacagattagttcatatatttctttgatttcttaactcattattaagacattcataatcaaaatgtgtattataaacttatatatgctatgatattgtgataaaataaatatacatttggtctctgtccccagctcctggtcagagctcctgaaacacttgtaccttcctaaatgataaaagcaacagaaacatcttttgttaccatattttgttttcattccccacccctgacaaaactctggtgcaataaaggtgagaggagcatcttttgttattgattacaagctccttacaacaacacctgagtctgtatattgacaaaatgatttttggaaagtctctaaggaagggggctggttgccaggagaaccaaccatgtcattagagggttggaactttcaggcctaccccccagcctccgcggagaggagaggagccagaagttgagttcaaccaccagtggccaatgatttcatcaaccatgcctacacgatgaagcctccataaaaccctaaccaaagcggttaggagaacttctgggtggtaaacactggaggtgctgggagggtggcatgtctggaaagcacatggaagctctgtgcttttccccctgccatgccctgtgcagctggctatttctgagccccacccttttataatggccagtaatacagttagcaaactgtttctccaagttctgtgagccatcctagcaaattatcgaacctaagcaggggtcatgggaacctccagttgatagccagccggtcagaagtacaggtggcaacatggacttgcgattggcatgtgaagtgggggtacagggagcagccttgtgggactaagcctaggtagacagtgtcagaatggaattgaatcataggacagacaccctgctggtgtcagagaattggtcagtgtgggaaaaaaactcacacatttggcatcacaagtgttctgagagaatgtaaaagaagtaagggtttgtttggttttccttttaatgtagtttaatacatggaagacaatttttgttctctaagaactatccatcatttcagaagggtactgtttaataggaagaatgccttccatcacttttgaatgtgtttcccgaacctttcagctcatgtcctcattttattccagtacaagtagttctttcatggggatatagagcttgagaatgattaggtagctggatgttaagtagtttgttaaagacatatatctgtaaggtagtactaattattacttgtagaacaatgcaagtcaggtaattggttctgtacatcatttttctgccatggatttactttattcctgcctttccttgtgtgttcacccccagagaagtcatttctccagtttgtggctgaccctgtattgagaatgatacctggagtgccagctagctgacacatgtcagataggattcgagtagaatgttgcagaaacccggaggccatttctgaacactttacactactcaaggtggcaaaggagagacatggagccatttgaggttatcttggttcatgtgctaatgtgccttatattaagaattaatgaatttcagtgtctcagagaagccaacagtggatctcccttgccgatgtttgtgtattgcataaaggcaatcatattttaatgatcatatgagctacttgtttgggggctattatttaattggaaacaagtgaattaaccacctaattcatcaaatctaagttgctatcaattataagatgtacctttattttatgtactattaagaaaaaaaatgcagccaattaaattgtaacacaacgtctaaatgagagtcctgaacagcatgtgaatcagtcatataagtcttagtgctttgaaatttctttcatctattcagagaggggaggcaatttacgtgcccttcaattgcattatttgctgggtgatgtggaaaaatttttttgcatgtgtctcagtaacaaaatgtaacacagcttcatctccttgtcatcttttatttgctcctgaaaggcactcaatcgttgcattgcaagaaaacatggaattacatccattcctccaatgactaatatttgcttcactaatatcaaatttgcaccttgctgctcagtttctgggcctttatgggaacacaacaataagcattcatttcaatgccaaatcatgctgtaatctttttgaagacattgtcagaagcacttaaactcaacacatattgtgcgtataatgcacatgactctcttgaagtgatgacaatgaacagccatggccaagcacccatgcacaggtaaggacaactatgccactgctactgcctggctgactgctactgttgaaatgctgttgactgtaaggctgatttcaggaataccagcttaaaaaaatgtgcacactagaattgatgaaatccggtaaaatccctcaacttagcttccaaatcatttttctaatataaatgtttaagaatggccacaagtgaatgtcatagggtggcaataattttagcttttaaaaacatgcaaaataatgataatgcccaaatagggaatatgggtatatgagggattgagacagatggagttgaaaagagaaatataagaaaaatggaagtgaaagaaatttactcattgaatcatagaggctaccatggcccactctttgacccctgctacatgattttgagtatgctctatccagtgttaagaaaaaagccagtgtcctagaatcaccgttaccctcagtggataccacagacacaacagtttacactttttccgaagtgctggagctaccaaattgttctgagcttcccagtacccccaaccgagaggaaagttaagtgaatccttcataaagcaagtctcaaaaccacagcatgacctcaacagacttatgctctgcgggacagaggtgttggtattcatatcatacttttgaaactttttaattattttagtagaaaggctttttgaattgcattttatgcctgtggaagagattccaactgattggttctatttaaaatgtctatacccccctaccctttatttatttgtaatattgcaatactttgcctcaaagaggtcaacttgaactttgagccgcaccactgtaaatctgtcataatttgttttgctcaaattgggaaaacgagagtttctcaaggagaaaagagagatagagaagcatcagaaaaattacatttataaagcaaaagtaggcttattacggatttcagaaattttattcctaatgggtttgaatctttccatctttcatttccttgtatggacagagctccctttgaagtgtttggaagctttctgtaagaaaagatatatatacacatgggtgtgagctgaaaattgagctcattgttttgcccttttcaaacgtgtttttcaaagatttgcctttcatattgcagatgggagagaggatctgcaattttaccttgtgtaacatctttgcctgaaaagctcaaagtatttgcagacatttttaaaagactggttcccatgtttgcctgctgaggaaagcagaggttcatgtaatttactaccattttatacccgaggaaactgatatttaggaaaaagaggctcagaatttcaaccagtggcaaaattaagaaaacaagcctaaaccttgccaccaagctaatgacacccaggctaatgatcccaaaggttgaatgtaacctccaaaagaaatgctataataagaaaaaattcaccatagatagacagcatcatgatccattttagtatgaaccttgtatgtattatgtaggatcatttgtatttatttttattgctctctagtgtatcagcctatttattgttttagtaactcccgattttgaatctaacattgaaattgagtttcagtaatgcttttgtagtcattctaattcattctaagtgcagaagagaaaccaaaccacatgcggaaacacggaacttgggtctatgtatatccaatgaaattatattttgaccaatttttttctatacacacagaacagttaacaaatgtgcctaaaactcaaaactgtgtatttcagttctcttgacaaatgtatctgaatcatgacataaactcaactgagtgtgcacatcaacatcatctttactaaaaagatcaaatttaatcctaagtagttataattacatccagattattcatttggccatttaagcaaatggaaatgaaccaactaaaataatttgcaatacagaaattatgtcaacaccctttaaaaagggtccatgaaacacaaagttgatgtatctattcttttaccacttaccaagtgccccaaaatgcatggcagaaattgttcagctaaaatacagcaaatgctcaaaacgcaaagacatagttcctgacctctaggagttaatagtctagttgtagggtggcaggcaaccaaataaatggataaaagcaaccacaaactcctccagtagtgactcagctactcacatgtacagtcttatttcagaagctcatagggaattataggtaaagaggttaaaacattaacatttgctcatttctcttccctattttctcatctcagccggtctcccctcccatctgacctccgaatcttccacattcctccccgccccgcaacccccaagctcaactctagaatttcctaacaggagtatcaaatactatcattccttcctttcctacctaagcaatggaatctatggtttgtattttaaagtcattatgagagttgacatcaactttaaggaatttttttttagccttaaaaggttagcttatacaccatgctgtatggtttgttttatcttgctgggttactgttgatctctacacttaaaatcatccctttgtcaagaatcacttgaaaccgggaggcggaggttgcagtagctgagatcgcgccattgcactccagcctgggcaacaagagtaaaactccatctcgaaaaacaaataataataataatctctttgtctaaaatgctaacctaatgccattagaaaaatagaaatgtcttgaaaggatgtggaggtaagaattggatttcccatccatattattcttggtatggtaggtaggtaaatagcttacaattcgccctgtttaatctttgaaataattttccattatgaggatcatttaattctgtctataaaatgtgagtcaagaactagggcttttatttttactttctatgaaggaaataagacccaaaacagaatctccaatgcatgggacattttttggcagatgttcagagggagaaaaggaaaagctggcttgactcataggatcttgcatgtctgtttttctttcccatgaaaacttgtagtttgaaggaacataaaggaagaaaatattctgctttcattaaaaaataacctgtgcttcctgcttctgtgcaaaataaacccttcataaagcagcagaagccatcttcatttacagttgtcactgaaggatgtttccaggctgggaagaatttttttcaaggcatttaaaaaccgtctgtactaataaaagaaaaacacgattttttcaggtcagaagacttcatcatacctggcgatggatatgtttttaattaaaacctgggcacaaaattgggttgactgtgaatcattgtgatgcctgatcactctcctgagacacccaccatcattggtactggttgcctgctcttgacaccggaggccactttgtgtacttagcagttagaaaggtgatgtgtgaggcccggcagctgttggtgttacagctattgtgtgggaaacaaaagccattctgttctgttccccagcctgcctttgtatcacggatagaggagctgtttcataaatgaggtataattctttactggagaatttcattactgcccatgtttcaatgttagcttacacttccaacagcagaggggaatgtctgaacatatctccttttgaaaagaatcttggcttctgacctctgtcaagatgcttgcattttaaatctgttaactagacctgcgattagatgccatcattacaacacatatgcttcccaccttccttgctctagaccacccaacctaaggctggctagagtgtatttgctgtcagcctgcctgtcttggaaattaagcagagtacagtacacactggcacccaggtgaaccagtaggaactagatttctcgcacaattcctcatggatctgtgctaggaaattctcatagagcaaatcagaactgacgtttatttgaagaacatgcactttttcacccaaatggtatatttattattttcatttagaaactatatcaatctaggaagttttcagtagcatataaaaaacaaactggcctaaacaatcaaggaagtgcagtgggctgtgtggttcttcccagccttcatccctccctgggctgtgtcatttgctgtgtgattttgaggttcctccttctaaaggtgagtatatttccctaactcatggatgttaggctcagctacatgacttgctttggccagattttaaaagtattcctattttcacttacctttcacttttctgccattgccgtgagaagaacatgctctggctctcttgcatcaaataagagaaatgtgaggcaggtttggaatctgcaaattggagccagacccacctgagtccaacctagatcagcctacttccagctgacctagaattgcatgagccagaataagtgacagttgttttaagccaatgcattttgaagtggtttcacagccctattgtggcaatatctgactgatatgtattgcttatataactgaagagtccaaaggtagtatgggtttcgggtagggtttgaaaagaattcctgttctatttctgtgtgattctcttggggcttcaacctgggatggtttccctcttggcatgatgaccatagccatttcaggtttcacgtttacaccacgtgccatctagaaaacaagaaggcttctcttcttcaactatcatgcaaaagtcctgggcttcactctgatgaggtcaacttaggtcacatgtgtatcctgacccagtcactgaggaaagagagtgggagtatgccacgtggtttacgtgaatcagagtccctcttgaaaatgggagtgagtccaatctcttccgaaatctgtgttgtgccaaattaaaggtgggagttgtagggtggaacagatgttgagaggtacaagcaatgttaattatggagtctgaatctcccacttttgttttaaatttctatcaatatattgtttggctcaagccattttccttcctccatgttgctaggctatctagagacagagaaatgggatttaagctctagatctgagatgttacctttaaatggcaaagcgcatggccacacccatacccctacagtactggaaagtgggtgggaacccaaataagactttaccattattctgtcagacttccaactcctggtatcccagggttttaagaaaatccaaagcaggtttgacctatcagaatgcggagatttctgatgtagaggatgaagttaatgctgatgtaattaacagcatgggatgaggtgataagaatatctttccactgacttctggtcaccattgtttccaatgagaagtcagctgtaatctttgtcactgtccagacacatagtaagcaccaaaaaatgtgtgttgaatcaatggattaaaaatagaaccaagatcttttggcacatatcccaatgttcttccaagactactctatcacttctttgtaaaactttactttgcacatttaatgtaccccttgcagcttctgcagggaagtaaatgaaatcaatgactaattcaggtaatttttgtaaacatggacattaacatgatcaccagttactttctgtgcttctgagaggcctcctgactctgaagtatctgaaaggttgaacaaccctaataattgaatgcatttttgccatttaataaatgtttgccattttacaaatattattgagcatctactgtccacaagacaccgcgttaagtaacgtgagggacagagaattgaacatgagctaaaacttgtcttcaagtacccaactaatataatttgtcactcaaggtttcagggaaactgtggacagaagaaaagacttgggacctttcatggaactacagattctcagggagtagcttgcctgtctccttgtagtgttacttactagttgtctctaatcattaaggatctcagttctgtatgaaacatctgtcagcattaagacaacatcttgaaaaccagcattttgatgtgacctagctgggatgtcaggcatatccacatgttcttacattaatttcttaaaaacatcttcccatgcattttatggtggctgtacatgggcactattaggtttgttttggtggtaatgtcctggttagataattctacatagttgcaaatttgagggtatgaacactgctacgttttctttgactccttctttgtcttcgtattttttttccagatgagttatgctttaaaccatacaaacagaaaactaacattggaacctaaaattactgtcaatgccaagatcattgtggttggtgcatccagtgttggaatttccttcctagagacattggtattttggtgagttgtttcactctattgattgattggtttttaaataataaaaattatcttcctacatctgaagagaacaccatcagagaacagacctgagattgtttggtactccacacaccctgcctatgtggatggatgaatcagtagaagaatattctagatcaggggttagcaaactatagccctgaggccaggcctggcttgccaactgcttttgtaaataaagctttattggaacacagccacactcatttatgtgttgtctgtggccatttttgtgctacaatagcagattagatggcagactcctctgctgagtagttggaacagagaccatatggccttcagtgcctaaaatatgtacagtctcacccttcccagaaacagcctactgaccccttttctaaaggaatgttttccttactggcccgatcacaaaaaccacctgcagcatttgttaaagatgtagattccaagatcctgcacccaacttacagaatctggactcctggggaatggtctaggaatctgtatgtcaatagacactccacataatcaggcaggtttggcaatgagttttgacttcatacattacaaatacactttcagaaatggcatgtgggccaggacctttcttccagcccttgaattttggatcccctggaacaggtaaaacccttcagggaatatggaggcctgtgcatctcttctgatgctgttttctcatccccctcaaagcactaaacaaggtttcctttcagagcccatttttctgatgggtgatgctcagggatttccagcatccccagtctctctctccatgtgctcacttgagcacctctttaatagaaaacaccctggattagggtctgagagctcgggatcatggcctggcatcatcagcacctaacatggagccctcagtgtattgtctagcttctctcaaactcgctatcttcatttattttttaaaaagtttcatagatgttttaaaaccctgactttgggaaccacagaaccctgaattaagagtccagtttttccaaatcttttgctcaggatcacatgaaaaactttagctaccattcaaaactacaggtgctgagaggtaagcaggagatgggaaaatgcagcctaccatcactcttctggaagccagcagagttcttagctcaggacaggtggggccttgtgaagggctgggtaagcaaatggatggaggaaatgaccctcaaaaggtgtatgtgcctggttaacgtggagacgagctaatcccaagtggttattttgctcatttaacatcacattaaccagataaaaaaagaattgattttttcactttctagccagtttgttcagttctccagaacatactcttaggtaactagaaataaattatgagtcattactgaagttagtaacagagttcatgtgctttgaataatgtggtcagtctgcagcaatatttcactgcaagcatgaaatgatgagaagcacctaggaatattccattcccagggtatgccacgttatagtctgagtgctttacttgttctgatgggtctcttcctcgaaaacttttgaacagcaagttttatgcaaccattttcgaatgatgaattattaaggtggagctgtgaaattatagcagttaagaagttataaacaggtcttaaatcttaattcagctatatacttagtcataatgttttatttaaatgattacattgagacatatacaagtaattttctttttgtggagtcaacttagatctaataaagacaagtataaattttgatgtaagtattgggtcgattaaatttcccaatcaaacagagctttttaaagcattctaaaatactcataattctctatcatcattacacagattacgtacactaaaaatagactggtatcagtttacagatctctaatccttaagagaggaaatagttttctcattattttctctaattattttaagtcagcaatcaccatggtaacctactgcgtattttactttcccagtttaactgccatttgaacttaattttatacatgatttgagctgaaatgaagaaatacagttttcacccaacactgaccaccaatgaggattgaatctacattttggaagcaaaatttaggagaatcagcctccttgtagtcttttttggtttgtttttgtttttgttttgagacagagtctcactctgttgcccaggctggagtgtatggagcaatctcggttcactacaacctccgcctccccccaggttcaagcgattctcttgcctcagcctcccaagtagctggtactacaggtgcaagccaccatgcccgactcatttttgtattttcagtagagattgggtttcaccatgttggccgggctggtctcgaactcctggcctcaagtgacctgcccgccttggcctcccaaagtgctaggattacgggcaggggccacagcgccctgctgcctccttgtagtcttgagctgcattgtcagactcagcaggggcatcatcattcctggaaaatccactcgaggctcaggacagtaacctctttctccagaaaatctggtaattctgtcatctgacaacaaaacaaacacaactttgttcttgtattatttccatgcaagaaattataaaacacatttggtctcctcttcaaaggacaccaaaagcagtttgtgtaaattcctatcctttcttccccaagtgctgaggtgctactgggagagctgaagtgctttgcccaaactcactccctgatattccctaggatgtaagctccatgtgatgaggcaatactgtggtggtgttctgactttttatttttttaagtatgctattttatctgctagctgtgtgcagttaatctgcacagacacatctccttgtctgtggttgtcaggcctgagtcctgcgtcttgtccttcctaggaggagcctgttgggccctccagcaccgggagacatgcatggcaggcattttcctggggtgtcccaggatcccagtcttttacttcccctgctgtcctccgtgccctcctgctcctggccctggtgatccccagcagagccgaggagccagtggccctgctctcagaggcttctacagtctccctcagccctgcgggagacctccaggggtggagatgggcaggggcgtagcgtcatccagggtggggtgggctcagctaattggttccctccccccttgtctggtgcacttggcctctgaggggagcccaggaggaaaggacccagccttctttcctgtcacctgcccagccagcgcaggagcatgcgtgtttgtggcaaggatcaggagctgggcagggcaaggctagggctgtggggtggtgctcttgcattgcagggcattgaggaagaaaacaccagcttgtactatggggtagagggccgtgaattggaggggaaagaacagatcttaagactgtgtgttcttcataatgcccaagacatttaagtgatagatttggattatttttaaatgactgttcttgtgattggtgggttgtgttcatttggccaccccgttctttgggactgaaagttcctggctcggacactatgatgtcacatgtgcattttccttctcggtgcttccattaataagactatttaaaacctccaaccactggagaaagcagaaagagcttggcctcagccgttagcccacctctgctgccaagcagtgttgcagccctgagggaggaactgtcctcatctgtgctgaaggagagtcccagcaggggcccccaggtcctgccagcctgaaggcgccaccacggtagaaactccacaaaccctctcagggtgagatctgtaaagtgaactcactataaagtgaactcccaccaagtctagcattgctgaactcctcaactgcagtgctttgactctttcaggtttccacaaagatattccagaatcctttttttttaattatataaatgctatagcaaaatagaaaaaaaaaagaagaagaagaagaagagaaggagccggaaccaggtgtatgcacctctcttctgtttctgcatcctttcactcctggtgtggcgcgtggaccagcagcattgatatcacctgtgagttcgttagaaatgcacaacctcaggccctgccccagtgtcccaaacaggtttttttccagaattatgcagaacagcatcttgactgtctcctgggcctgcgttcatagagctgaggcagttgctgtccccttctgtttcagcacgagtctctatgcttcagtgttttatagtatttactcctaattatgggaaagttcctttttaatccattatttttaactctttcctaatttaatcccgacgtaaagaatcttttgaagagcctgtaatggcactagaaaaatgcttactggagtcatggatgacagtgactgaaagcagcccagctggtgtccccgcgaccctccgtgtgactagagagaaacactgattcataggaagcaccggtgggcactggaaagcccgggttccccttgtcttccacttccaccactcagaagagttttctcgaaaactgaccaaatcatccagcaaaagatgcagcctcagactttcagcctagacactgatcccctcatctggttgaatgtgtcgaggtaactaagaatagcttggaccaagcagggcatgtttctaaagctgcaattgtggcaatgaccacaactcctgttatcgggccgtgcagttccgcacaatatccggcacagctgtgggctctggcagcagccagcctagcgctggcggcttaattaggctttttatctttacatttgtctgaggacatctgaaaccttcagtgtggcctgtcactaattaggtgactaattaaatagtcagtgcttccttgctgatctcagagctcaaccgcaatggacaggtttgtgattgtgactccccgtcctgtcggtctctgcacgtgtgcgcctcgcaattgccctgttcattgcgctgtgcaaaaacggcatgggagcgaggcccagggcatgtgcagggccgtcctccgatgtgcccaagcagcaggcagcacggacatccacaggggggcatatgggagatggacatccacagggcatacgggacatcagttctggtgcagaggctggtctggtggccagagcagaggggacggtggaaggagctttacctgccaggctcagagtctcagtctccccaggcagcaagagttgacattctgccaccagagaataaggatccagaactcaccctggtgtcactaatcacaatggggtttcctattcgactccaatatttaaatgtaattaatgttaaataaaagcaccttcatttactgaaattattcacccctgctcgtttcagtataacttatctcctcatacccacattagagactcccagaacaaaagcaaagcaatccactttgagcaacattaggccttttcgacgggggaagatcagcttattgtcctttttttgtgggtgctttgtgattctttggcattaaaggtaagtaggaaatgcatttttcatgatcacacaaagcacaaaccatgtacccggatctgagtcgtacacccgcctcctcagtcttcatcatttgttattggatgattttcaaataatgacattggtacctgtcttggtttgcattctttcaaaccaagctgaaaacaaagcatttggatacaagtagtttatttgggagtgatcctagggaactgcctgagagcagggccgtgtgacagggaagtgaggatagccacaaagccaaaagacacccttgtcagtgggtccccactgtggacatctgaggtcagagaatggccgtgggcagagagaggcagacaggagaccccttgcaggtgagcaggtgggtcagggtgaggtgagtaggccccagcactatctctggagtgcccttatggtcccttagtttgcttagtttgttctgttcttccttgttaatattcttgaagttgccttttactgaaactttggcatagacgatgatggagaagaagcaagggttaggtaagaaggctgtggggagaggattttgtgggtttcttgcagttctgaagaggacacaggtgtactatcagaaagttttgctggaaaagagatggcatttaaggaccttgtcttagcaaatactttatttctactttgggatggagataaggttagaatcagtagttttcgaaacatagtctgtggcccagcaccatcagcattacctgggaagctgtcagaggtggggatacttaggccccactctccagggactgaatctgaaacctgggggtagggccaggctctgctttcccagccctccagggaaggcggcaggtcaaggaagtcagaagcgacggtggagtggagagggcccaggagagtgattccaaaacgcagaacttcagtctcctcacctgtgctgcagggaaggcacccagaatccctcctcacacaccagcctgagcatacagtcaggtagcaaatgtcaagcatctgtccaaaggcctagtgctgacacttgttagacggacacctccccactaattaaatttgcatgtctagatccccatggaagcctgcattgactttcaaaggcgggaagtggctggggagctggagtctcctccacgtggaggatgccctcttccccgaggactgggggagccggaggtgcttcccacccgcagctgcatctgactcctggtgagacgttccctggagtctgcagaacatcctcctaagagactcatgtctctcagatatttaatgggatcataaacttccttcatagaaacttacattaaactctcccctcctttcttgagactcccaaactctcaggagcctctcagttttctctcctccttgaacagaggctctcaaagtgccgtccctggcccagcagtatggacatcacttgggaactgttagaaatgcagattttcaggccccacccagacctcctgcatcagaaacactctgggaatcaggcccagcaatgtgtgtcttcacgagacctgcagggacacactcggccaatgccaccaggccgatgtggtgtttacccttcctgcaccatcctcccatccccacttttctcatgggcagcctcactcccaaaaaagcaaaggcatcatacaccctcagctgtgcaccctttcccacttcctcagctctgcacctgccagccactttatttcctccctgcggagggaggattagggccataattcttttatcttggcgcacataaaatgatgcacaagaggattgagggaataaggacatatcaaactgccccccaacttacagcatttgatgttgggtggaaatttggaagggaagcccagaaacagccccgcctgaaaacacaggcatgagggccctccagtagaggtgacaggtggtcctcgttgctggggagtgggaagaccgtgagcctctgtgtgagacccagagcaggcaaagccatctatgcagcagatggcttctggagaccaggtttctctctaagtgtacttctctgaagataatgcctttcaaacagataatccaacacttaccagtatagtaagacataggcttgaaaaaaatggtttgaattctcctttttattttaagaacttgtggtggaggaaaatgttgtgaatcaccttttgagattttagggttaatattaagtaactgtttctataagcaacagattgcaaaagttccaggctctacaattctgcacatcacagccacttggatagggatggggagggttgtacaaatacagtgtcctgggaccctgttcctggagttacaattcagtaggcctggggtgggtttcaggaatatgtacagtatttttaatagaatccccaggtaattccaacatgcaggtgggtttaggagccatttttatagacatttgctcaaaattggcagtctcatctataaggaaacctatttccccctgtaattgctcattgtaactaactcatttttatgggcttgttttccaaaccacattttctaattcttagtgaatcatataacttctaagtcacatcattactttggggcttaccaggcctaatttttaagttattattaacattatatagctgaacccatattcatagtattaacatgctaaattggacctagcagaaagcatttcacgaagtctcatgcttaaactatcaccattaagaaggaaggcccaagaaaaaacctgcccatgtggtgttattaaagccttgctaatagccagcatttgcccaaaacacaaagctcttcttcatcctccccaaccagaagtgatcccactggattttgaattcccataatgttccatgattccatccttaaggaacaaattgatttgtgtcttgtattttgccatctctcatgtgcaagggctttctggcttgtctttgatagctaccatcttggtatttacatctggtatgtgctcagtatatataaacatatgcttaaagtataaatgtataatgtttttacttcctagacatagataaaaacatcattaatcatttcccctaaattataaaggaaagctcaatttcattttcatctgttttgccagaactcccaaattttattcttatcttttcaattgacatttcaagaatggcatgcattttcattttttcagtaaggatttatgtgtttattttgtgatacataagttttttatctgagatcctgaacttctacctagccccttatcctggccaccatgcccctcccctgccaggtccccgaggactccagagagcacccagggccctccaggcagacacttctaccttagtgtcgggtccagggttgagtcacacccagactcagggtaccttacgagacttgctccttgccccgtttctccaggtcgcatcctcattcctacaggagctccaggaccagggagctctgagccacccaaggtggagctgggcaagatggcacccaagagaagagagaagtagggtcagggagagagcttgtaacctctgtctcaccccacgaactgcccactcccttctagatgtgttcagaatcctccatcccacacctcctctgtggatctctctcttcggtctccccctggaggtcagagtgtgtcatgaccaacaactttgtggccatggatgcagctgccgtttaatttttactaacaacaaaaatggattgagtactattaacacactcgaacaaataccccataactccttaatatcatctaataccagtccgtgctcagttttcccagtggtcttaaaattgttcttttacagttagttggtttggataaggatgcaaaccaggtccaactactgcatttggttaatgtgcccctgaaatctctttaatacttaacagtttcctgcaccttccccgttttctgaaattcattttcttgttaggttcttgcatgttagagaatttaagatgaaataatacaatgtgtggtgtttactccaaccactacagtgttggtgagtattttcaaagcagcacaatattagtcattgctaagcttttttcacctcgtgtatatttaaaatcctccaaaataaaaatttttttaaaataaacaaattaaattaatggctcaggaccttgtccaaaagtctcttatgatttaaacagaaaaaaatattgctaaagaaagttaaatttttttcagggaaaaactggtagattctcttactctgctgtgtacttaacaataaatattttgtgtggatttgttttgcctctgatattggaagttcacagagctcccaacttctaaactccacctatagtattttatggcatgtgttgttgttaagactgaattaaatctgagttattttttaactagtagaatatgtagataggttaaatatctatcacgagctaggatttattttcattggcaaatatttttgtcactgttttgaaccattcagaaagcagaggttttagtaaattaaattgaaacatttagatcgatgtgggataataattttttctctacattatctatttgttcaaataacagcattaattaaagcagttaattaaatcacttgctttggttgcgtttgctatgcctgcaccctgcagacacgcacagcacacacaaaatcagctagaaaataactagcgatcgcctagcaggccgacatgtatctactgcccagaagggtaagcaccatgaaaagttttatgtttcttttatcatgttcacaataaatgggcaatgtgaccctctttatttgaaggataaggatgtttagacctaattttgtagctgtcctcctgaagcatggaatgaaacacaataccttttacttatttccctggataccctaatccctccctgctttacaagtatctttgagctgttcctccctttgtatccacagcaacgtgaaatccccactggaattatttgctgtgaaaatgcaggtgcccttgtttaatgtttcattggcttgagcacttaacttgaaactttttttttttttcatgatatggtgacctttgattttggagctgagggctcacggtgatgttagatattgtttatatacattaagccaacaccattagatctgagctttatctgtggttctgctgttcctgccatttcatcaaatgcatgcccaaatgcaagctgtactccgtgacccactgttctatttgaaggaactttttgaatattcataggcaatcaaattaaaaatcagtctattagacttatgtattataaacttcatgactttagaccaatactcttacatagttatagatttaagaaattaaatatttagacactgctaaatcggattatagagagaaccatcacagcaaaaatatgaggttggagaaagaaatgaaaatgctggtgatattttcatataaagtcatgaaagggcagggaaccttctctgaatagcaaggaggttgatgttacaaagaatgtcggggaagtttgcttaggcccagccagaaggacctttatgccacactagggaatttgggctgaacagtttggtaataaaaacacttaccatttattgaaaatgtactatgcagaggcgatattttaagcattttacagacaatgatgcatttaatcttcacagaactcctaagaagcattaggttctagagccacagagaggtcaaataacttgcaaaggtcaaaaagctagaagtgctagagctgggagtggcactgaggcagtccgacttctgagaccgggatcttaatgagtctgatctgcagctaccttggtaaaatctctaccaagaacaaaggtagggattttaaaaccggaaaccgttgagattttatttaatttaaaaagaggtttccagtagctgtgtggaagatgggcagaagagagagactcaagccagagagacaaaccctctagacaagatggtgaactaaggcagtgtgttataggaggggagggttgtgggggcattcaagagatgtggacaaggtcaaagtgattggacatggtggccaaagtgtgtagtgggaaggagcctgagactggctgccaaattcctagctctagaggtggttagttggccaaagctttgatggagatagaggaggagtgggatgaggcgaccaagagctttgtttgggcacatattaaatttgacacccccctggagcatgccagttagggctgataggcatttagaaattagatttagagctcagaagaatcactgtagtatagtacattgtagtaaatgtgcaagaggaagtcctggtggtggataacatcacccagggaaataggcatgcagcttgggaagcttggctagggagaaatggacaaaggaggaggagctggtaaaacagtcatgaaagacagcctcaagacagtgttgtcccagacaggaggttctgtggcaacagctcctgggggaggcctcctgcatggccccagctctcagtgtttcctccacccctgctcctttaggcccaggatcagtgatggcacccactgctgctagaccctgggtactctccttccctctttgtccctgtaaccctgcatacacagctgccttcattcagtaagaccttgtggagtccgccatcttttttttttttgcctggatcctgattaataaggatcttctcatatccccagctcatccttcctccatgagtcaatgaaaatagagacttctaattgcctcccagtattcattctgcacttggtgacaaaaccctggggactgtggttctttgaaacatcactgtgttttctttgaaaaactacattttccagactccctgcttctccctggccatgtcactgagttctggctaggtaagcagaaatgtgggactttcaggaagtctccttaataggcagcactctctgcccatttctccttcctctgcctgtaatgtggctgtgatggctggagctccaggagctaccttgaacctgaggtgaccctgaaaatggaaatcacacatggagaagcagagaagcaggtcatgggcccagctgcctagctgactctgtggatccgtcctatcagcacgaaactggtgatgtccaggtgtcttaagtatagttttaagagaaatttgctctcagagggattgagagagatcaaagaggaacttgaagagaagataggtttaatggggagacatgtctcttctgactcaggggaatggaagaacgctctagacatggtaagaaggaaacataaaaatgcctggtgaccagtccccattttctttatgacataggagatgtgctcacccgagtatgaggaagggggatagtaaggataacaagaggggttacagtagagaacttgaaggttggagaaaggcccagaacagcaacaatgaagaatgtaaaaagatttcaacttgggctaaagaaaaagagtggaaacctgttttttaatgtattaaaattcaaaaaatgcctctatcccccaaaaaatctttgtactatatcattataggttaggttttttaaaaaactactttgttgttttggggaaattttaaattgtacaacagcataatttaggataatgcaatgtggtagtttggtaatttataaatcatctgatccatgttgttcgataattcaaatgattcaaaaccaaatggacagtctttgtagtgaaagatgtagctggataattattaagccttctacttacatagagatgtaaaaaaggcctatatataactattattggtgtaacataaaccacatatctatcatatagcacccaaagctggggtaaattttaactgcttgtgagtataaacacattattattattattattagcatttttcattaaatggtaataaataagagacaagtaatcagtgtgtacttgcagactgtcagccataagtagctgggttaattgtgacctttatgttatttgaagatattaaaattttttattcttattattagaggataagatgtgctcagttttcttcttatcaaataagaatattcattcttaaatgacactcatccttagagactttagagcaaaacctctcataatattgagctatttttaaatgtcaggttcagttgagtttattgcatttctggcctgcgccatcaccaaaagtctcctgcttttagtgctactcaacagattgtcagtaaattgatagcagttccacatttggaacatttccaatcttctcatgggaaaggagggcaggtgtttctctctgacttggtgaaggcttcttttttggcatttggttgattgaaggggaggtgtgaactaagaagagattttagaaaaaaaaatctcatcagcatgaaccctatgaaaagatcagctcacccatgaaattttactgactttaaccagggggtggatttgcagcaagagcatcttaaatcctgatgggcaaacacggagtgagccttgagcatgtgagttcttcagaagtctctacttaggtgcactttacctgtaggactagttagagggagtattgtgggtgcctggagcagggcgctgcctagggccagcaggcctggctttctttcatagctggcactgcttatgagctttgtaaccttgaacaaattacttaccatttccaaccttgattttcttacctatgaaatgtggatcagaaaaaccggtctcttccctatccctagcataaattgtgtagaagattaatctctatgtgaatgcctatgaatgtgccttgggctctggaaagcctgatgcaaatataaagcagttttgctcttaaaaaggaatcctctagaatttcctcgcagatgacactttttggtatcctgatttgagtaactgtgtgtatctgaatgtaataaagctaatgtcagccaatgggaattagatgacctttggatccctctgaacaatttgagatctacaggacagtacaggcagaggtaaggtgagaggatgctggagccaggcatcctgggttcaaaccctgcctccagacttactagctatatggttgtattagtctgttctcacgctgctgataaagacatacctgagactgggccatttacaaaagaaagaggtttaatggacttacagttccacatggctggggaggcctcacaatcatggtggaaggcaaggaggaacaactcatgtcttacatggacggcagcaggcaaagagagagctcgtgcagggaaattcctatttttaaaaccatcagatctcgtgagactaattcactatcacaagaacagcatgggaaagacctgctcccatgattcaattacctcccaacaggtccctcccacaacacatgggaattatgggagctacaagatgagatttgggtggagacacagagccaaaccatatcattctgcccctggcccctcccaaatcttatgccttcacatttcaaaacccatcatgccttctcaacagtcccccaagtctttttttttttcttttttttgagatggagtttcactcttgttgcccaggctggagtgcaatggtgtgatcttgactcactgcaacctccacctccccagttcaagtgattcttctgcctcagcctgccaagtagctgggattacaggcatgtgccaccacacctggctaattttgtatttttagtggagacagggtttcaccatgttggtcaggctggtctcaaactcctgacctcacgtgatccacctgcctcggcctcccaaagtgctgggattacaggtatgagccaccatgcctggccccccaaagtcttaaatcattatagcattaactcaaaagtccacagcctaaagtctcatctgagacagggcaagtcccttctgcctatgaccatgtaaaatcaaaagcaagttagctacctcctagatacagtgggggtacaggcattgggtaaatacagccattccaaattggagaaattggccaaaacaaaggggttacaggctccatgcaagtccgaaatccagtggggcagtcaaatcctaaagcttcaaaatgatctcctttggctccatgtctcatatccaggtcatgctgatgcaagaggtgggttcctatggtcttgggcagctccacccctgtggctttgcagggtacagcctccctcctggctgttttcatgggctggcattgagtgactgtggcttttccagacatacagtgcaagctgctggtagatctaccattctggggtctggaggagggtggccctcttctcacagctccactagaagtgccccagtagggactctgtgtgggcgccctgactccacatttcccttccacactgccctagcagaagttttccatgagagccctgcccctgcggcaaacttctgcctggacatccaggcatatccatacatcctccgacatctaagtggaggttctcaaacctcaattcttgacttctgtgtactcacaggttcaacaccacatggaggctgccaaggtttgaggcttgtatccactgaagccatagcctgagctctacattagcctctttcagccatggctggagtgtctggaatgcagggcaccaagtccctacactgcacccagcatggggaccctgggctcaacccacaaaaccactttttcctcctgggcctccaggcctatgatgggaggggctgctgtctctgacatgccctggagacattttttccattgtcttggggattaacattcggctccttgttacttatgcacatttctgcagctggcttgaacttctcctcagaaaatgggattttcttttctattgcattgtcaagctgcaaattttccaaacttttatgctctgcttcccttataaaactgaatgcctttaacagcacacacatcacctcttgaatgctttgctgcttagaaatttcttctgccagataccctaaattatctctctcaagttcaaagttccacaaatctctagggcaggggcaaaatgccaccaatctctttgctaaaacataacaagtgccacctttactccagttcccaacaagttcctcatttccatctgagaccacctcagcctggactttattgtccatatcgctatcagcattttggccaaagccattcaacaagtctctagggagttccaaactttcccacattttctcatcttcttctgagccctccaaactgttccaacctctgcctgttacccagttccaaagtcgcttctgcatttttgggtatcttttcagcagcgccccactctactggtaccaatttactgtattagtccattctcatgctgctgataaacataagcatacccaagactgggcaatttacaaaagaaagacgtttaatggactttcagttccacgtggctggggaggcctcacaatcatggtggaaggcaaagaggaacaagtcacgtcttatatggatggcagcaggcaaagagagagcttgtgcagggaaactcctatttttaaaaccatcagatctggtgagacttactcactatcatgagaacagcataggaaagacctgttcccatgattcggttacctctcaccaggtccctcccacaacacgtgggaattatgggagctacacgatgagatttgagtggggacacagagccaaactatatcaatggtcttcgcaaattacttgcttcagttccacctaaaaaaaatagggataatagtattactgacctgactggattcctgtaaggactagatggggtaatgagccatgcaaaaggcttgactggaagcagtcatcagggttaagctgcgattgttatgcttccaagcagtttattattaatagaagtagtctaaaatttaaacttcatactaaatttacctccctcccaatttgttttagttttactttgaaaagcacattttaaaaacctgtctcattactaatgtgtagctttttggaagattctatagttagcagctccagcgccatcttccttttttccttgaaatggttggttctatctgaaggttcgtgcaaagaattagtagctccaaaagcaattcaacagttggatgacacgtgatataaagttaaattgaattatgataaacttttgctaaattgcacttaactgcttgttctttttcatttttctttttctttagctctcacatgaagtttaataatcttaccctgatttcaactcatggactcccaggaaaaaaacttctggacactgaacaaaggaaatttttagccagcgagtatgaattgtatttgctttttcattctgaggcctaaatgtcctactctgtgtgcagtctatttaatgctaaatagtagatttcagattggaaaaggagaagtggtggggcttttctactggagttcagacatcacttaggagatacaagtaccagtgtgttcacaagccagtggccaagagtggcaggccagggccaccagtttctatccgtgggaagacatctgccctgttccaaacaattggggtggagcctacggacccagccagccctgcctttgggctctgagtgacactacagggcaatgaaggttggtgactacatttgcatctgacagggcgcctggctgggatatgggtcccacagctaccctggccatttgtactcagcagctgatcaggcaaagaacttccatgccagtctgggtgagctttattgtcttcatcccagtagaatcactatttgacaacatctgttctggaaaataccatgtctttatcacatagctttcattcattttaatttcctgtagcaaaacatggctacaagaaatattagtttctctgcctctagaaacaagctcctaatttttccaataaggaggaaggaaattgttccctcccaggggattcattttagattccatgatgaagggaccctctttcctctgtgaaaaagactcattttgccttcgaacaatgagaaaaaacacaacttccttgccagcagaacgggttcgtttccactttataattttatcagactataaacttttttttgaaggatgtccttatgatacaaaaaagggcatgggtttgagccaggaggatgtggattcagatcctgcccctgccacgaagggcctgggcaaggaatttcatttctctgagctttgctttttttgatcacgagcagtacacgagaagccaagcttgctggattttttgttaaaattaacataacaccaacttctggccaagaacacattctctccatttccctctttctaaattacacgattcccaggaaatgctggttttattggcaaatgtcttaagaggaacttaattccatcagcgtagtgaaagtttccctcaatcccatgttgcgtgtgtttcaggagaaaacagctaccgagggggctttctgcaggtgtgacgctgcgtgggcagactgagtgggtggaagccactggcgtccctgctgctgtccctgcctccacagtctcagcacagcagccagagcaaggctgcggaaagctggctcagatcacatcgcctcctcaccgcccagaactgcactatccaatatggtggccactagccacgtgtatttacatttaaattattaaatgagatgaaaaagtcggctcctcacattagccacatgtagccagtggctaccacattggatagaacagataagaacattttcatcatcgtagaacgtgctgtgatgctccagcctaaactctgtctccatctacttaattctccagcctcaccttttattatttttgccctttttctccccatttgagccacaccagcctcctcgatgttcctcagatgcaacgggcaagtccccaccttgaggtctctgctttttgctcttgaatgttaccttttctatgaggtctatcctgaccacaccattcatttgaagccaacaccccaacacactccagtccctcatactctgctctgtttttttcttgctacttaaatcctcctaaatattgtattatttgccttttgaaataatgtttattcttcatatttatatccagaatccttcaactataatataaacaccacaagggcggaaatttttgcctttttattcattgattcattgatgtatactcaatacctgggtcagtccttggcacatagcagatgcccagtaaataatgtggaacagaggaaagttacctccagaaatacctgcaaaactcctctcaagcaagtgttagggtctaaataacacagccagacccctttgcatgggtaactgcatgtcatcacatttcttagaaaccacatatttcagtaagattgaaccataaataggagatgtctttcaaatggtcctcataaccccaataaaggaaattatctctgatcatggggtttcaaaataacaggtgcaaatgacattcataaatttagtaatttaaatccctgattccaaatactaattttgaacttgtcgttaaccattgttttaatttattattgttagaatttttgaaccatttctgtcttctttcccaccgcccccatccagcctcttgtggaggtgctaatggcatgtctgggatgcagccgaaaggaaggcagtgggagaggagaaggaacaggaggcaggagaaatccactaattggacaatcagcactgattaattgaaagttaattgtgatagtcctttttctaggagtgtcacaattaatcttttatgagaatttctaaggttctttccagctcggaagagtcatgattccacgaggtgcaggtctccactgactcatctgtggcccccagagcttgcttctaactgcacacctggagctttggactaggcttttgaccacaaggttgggggcactataacctagagcaagctgctactcatctatgccctcttccaggaatttccccgtcctccatttttgctttttgtttttctcctccttattatctgtcttcagaactttctatgaagacagtctttcacattagttttgagtcacggtcaagctcacttgaggaacaggaagtttcactgatgtgcctcctttggttccttctctgttttcggatgaagcctagtggaggtatttctctcaccaccaggccatgagtcaggccctgctatgttagaatattaaagcttattcattctacttaaaaaataattttggaaaaatatcacttacagtcttcgatatatagtttcactcaactggtgaggaaattaaggaaggtccagaatggatagtaatatccagaatgggtagcaatcacttatacaatgatattttaaactgagaaatggccaggtaatcccagcactttgggaggccaaggtgagaagattgcttgtgcccaggagttgaagaccagcctgggcaacgtagggagagtcccatttctacaaaaaaaaaaattaaattagccaggtatggtagcttgcacctatggtcccagctgctcgagagtctgagcggggaggatagcttgggcccaggaggtcaaggctacagtgagccatgattgtaccactgtgctctaggctgggtgacagagtgagatcttgtctcaagtaaataaaatcattcaatgtagtaacatattgtaacagcaatcaccccacattcttcaacacttccttttgtgacttagtaaagtttcctaaaaatcagtggtccccagtgccattcccactggacagagcttcacattttaactctcaaatatgcattctgatgtgatcaatgctactgtcctgctgtcattaaaaatatcattgtctttgccttccacaaatttcccctgagagcctttatctttgggcacagcctcataaaatgaatccctgtgcactaactgtatttaacttttcctcatcgtggatggcttagagtagggatctggagcagataaaaaacaatctttcatgggtctctcacaaatgtgggaagccatgacatttcctgtattcctataaagctaatgaaatggtttttacaagagaatttcctctcactatccattattttcctgtgataggccagtccccgattttcttttcttattaagaagaaattttcttgtttttaagttgtttcacagagccctttcacaggtcctgtaacaaggtctaatatgcccccatgactagaattctctttgtgtggtaagaccaggcttatgcgcagatcaaaaggaagaaatgttccctcattaccacttcagaatcttgtttgcctccaaagagagtaaacagggttctgtctcattaatattatttagaataatactcttcacatacgcatcctgcctaacaaagcagcctgtcttacattctcacggtcactccttatagcggtcagcagtggaggaacgtagggagagctcattaccctgtgttaagaggtgaggaaactgaagacagcaggaggatgcagagtccaggcttgtcagcagcacagaccatggcagggttctttttgaagaggactgtgctgccaagcatagaagtggcgcgtgcctccagtcccagctactcaggaggctgaggcaggaggatcacttgagctcaggagtttgagaccagcttgggcaacatagtgagatcctgtttctaaaaataaataataaatagatgaataaataaaaatgttagtgtttttatgttaagagaaaaaaggaagaaaagaatcatacagcctaaattaaaagaagcacttaatgtcctattaccttagactctcagtattcagaacagaatcactaaaaggtggtttacctgaggtcaatcctttcagaaaattctggaaacaaccctcacaaaactgtttaaataaacccaaagccacaagaaacccactcttatcatactacgtgaaagcgctcaaactccaagagagcccagaaaatggaagccagtgcagccacagcacgctgaagccatggcatgaatggccgccctgggcctgctggcggtcgaagtctccgttcctagaaaatcacctctgccctgaagggtgaatcccaaagtctccagggagtgtacttgctgcgaacctaactccctaattgctatattcttgaagtaaaatgggttttgttgttttggcaggaagccatacgctaattctcagaatgagtgattactgaaaagtattagcgaataggaagggttctcggtattcaaagattctgacccctggctttgggaatcctcaacaatgtcactttcttccttctcattcccattgaggctgtggtcaatacaccaatttaacagctaaagtaaatttacaaccactctgaagtagaagcagaagaaaggtatagtatgagtgatttcacacacacacacatacagataaacacacacacacacacacacccctcccaccctcccagttgtgggctgacctaagccaggtggaacaatttagctttaatgggaagatgtcaatttgtaactaagtgtttcataacgaaaaatctcctagtatcagtcctggtaaactcacagcaagagcacggactcagcccactaggggacttgaaccagctcaccagatgtctaattaatgcccgctgtcagctgctcagatgtcacttacggagcttctctctttgcagccactgttttaatgataaagattatgcactgatgtcactgtgctcctgggttaatgtcgtggtgggtagaatgaccggcatagaccgagcagccaagcacgttgtgctttccacggacgagatcgtgccctacgaccacctcatcctctgcaccgggcagcagtaccaggtaaggccgggcacagggggcgcaagccacgtgtctggagagctccatgaaagccattcatatgtttactggggcacacacactctgggtaaagagcatccctctgcctggacagctgctgctctaaattcataaaagcacccttcagggcccgcacacataaccagaattatgtccgcaaaccctcccagaaacccattccaagaaaaacattctgctcgaggataaaaatcacagcaagttggagaaatgtcattctttaagctgttgtccaaaagtctaacacatactgctcgccctagcagaatccagacgcaaccaggcatgcatttgtggtaaattaatttatgcctcaagaggctaacatttggctgtggcaatgggctctcgcaaaagtattgcaaacacgtgcaccttctgtcgacccttattttattttgtctctcagttatgaaaataggaaatctgattgattggtttcccagtgtccatgctttccttttagttaaactctccatccacatttgagtaaagcattgctggataacactgaagctgttcaatgtcttagggcagcagattttaatattccactttgtaatatgcatgagtgtttcatgtagtttacagcagtaaggtatttctccagtgacaagaggcttactctaactcaaggatgaagtcttagaccaagtttgtgaaacccatggcccatgggcccaaggtggctttgaatgtggctcaacacaaatttgtaaactttcttaaaacattatgacttttttttttgcagttttttttcttcagcttatcagctatctttagtgtttgtatattttatgtgtggtccaagatgattcttcttgtttcagtgtggctcagggaagccaaaagattagacaccccacttagaccatcttgtgaatagttgtgggattcgatgcgagcctgtgtatgacagttttccttcacgtcgccaagcgcagaggaggcagcgcatgaaggagacagggtctccacctgggtgttgccacagaatgtgctcagcagctctaagcatcacttaccctatattttctgccttggccgcacattgagatgacctgggtgctttgaaaacacatccatgcctaggctccgcccccagaggttgttttaattattctagggtgggacccagtcatcagtatttttcaggtgccccacatgcttctaagctaaagctgagaaccacaagcttgcactttcttgactaagaattcctcatctataccttagaatagcacctctcaaactgctgtgcacatgaatcccctgagcttcttgttaaaatgcagattaggagcaggaggccatgggatggggagcctgagatgctacattttcttttcttttcttttctttccttttcttccttccttcttttttccttccttccttccgtcctttcttccttccttctttctgtccttccttccttccttctttctttccttccttccttcctgtacttttaattccatttattgttggatgagtctattcctgtgccgtaagtttccatttcttcagtttcttctgggctatctttttcttctgcgcagcctcttctggtttaggaacaatttgttccttttcaataaggctcatctcactgtggcaggcagagctcacacatgggttaacctgaccctgagctctgtgagtctggccacacatcttgggtactttgttcacctggctatgctcaatgaccagagaatctacatgtaaacccttacgttcagcatgactctgcatttttaagcatgtgcagcaaacattcagcactctttttgggccactgaccctgtgtccagtcccactgtttggcctggacgcacctaccaactccacctttgtaacgtcagaatggtacacactgtctctgtcaagtgacatctttcagatactgggtggctcttgatatatgcataccctgacggcctgagcagtttcacaggtgttcttcaatgaacacgaagatttgaacctctcgatttgcctgagttcacatttccacagattgtcaggccacttaggggaacaggaagatgttacatttctaacaagctcccgggtgaggccagtgctgccagtgaatgaacaaccctttcagtagcttggatcaacctctgaagaatctctctcctcccctcccctcccctcccctcccctcccctcctctcctctccattcctctccccttccctcctctcccctttcctcccctccactcccctcccctcctctcccctttcctcccctccactcccctcccctcctctcccctttcctcccctccactcccctcccctcccctcttctatcccctcccctcctctccattcttctcccctcccctcccctcccctcccctcctctcctctcctctcctctcctctcaattctcaaagggtataaaaggatatttttatggttaaaggataaatatttactgcagggatacttcgttttgatatttaagtattcctctgacttgttaaaacattaaacccgacagaaatgccatatgcacccccttagcttgtcttcctgtcacctgcctgccaggttccagctgctgccacgactgcgtactttggaaactgagtggaagacccagccagctgcccagagcctcgggcatctgcccatgtgtgcccagctgcccctgcagctttactctgtggcacattaagctcttgccctttttacaacggaaaaaaaatgaaatgaagaagtgataaagggagttccaatttaatttttccagaaggacataaaatcaaagtacatagagtggtacagaaagggcagctgaattcactggggagcttttctcccccttcccccattgtcttcaactctctcctggttttgtcccaattttgtgattttctaaaaaacaaattaaaataatgaaaacagagcttaaacccaaagcaagaagacaaccctctataaaatgtaatgacaaaccgcaacctctaatcagaccttttaaatggcacgcctcactctaaattgttgtgtaatgtttttaatatccaaatgcacatcgctatttcttattacaaaatccatgcacaaggtaaaatactacattgcactgcacggctaagcatgaggagagctggtctctcccagcccactcttcctcccagctctctttccagaggcaaccagtttgaagcatttctgttcttagtttttcagtggctacctgcataactccaaatacagtaatatgtttatagaatgtccttccttgctctgtcaacttcagacattatctacaacctctccattttcgaagatgaagatttagctggctcactttccagactctataactccttctccagccctccaatcaatgttgatcatttttgttggcaaacacactctggttttgaaaacccctctgagatcacagggccactctccatgactcatggacggtcatggagcagcagagagatgccttccccaggcctggatttgaggaacctcataaagaggaagaacaaaaatgtaccaactgaaatcaaatgagcttggtgttgagcatgagaagactgtggtatggactgttcatgggtcgggggtcactagcagctgacaggtagggcaggtacttccaagcaagcaagaagaagagctgagactgtagtatacagtgagcttgatgtgggtcggcaatgttacattgtctccaaaggggttaatcatgtcttagactgggtcagtaatagtgtggcatccagaatggtgcagcccaggtgacagccttctacacacagcagggaggaaagacccatctacaccagtgctgtacctcccagtaagagacctgagaaagacactcccccgtgtcatttgacagcacctactatatagagatctcactctgagaatgattacaggggaaaataaaagcatgcagtcaaagaaaactggctgttttaaaaatggctgcaaattctttgatgcctcttccatctaagaggtagagtctatgtctcctctccttgaatctgggcagccttgtgactgcctcggccaacaaagtgcaaaggttgtgacatggtgtgacttctgaggccaagtcacagaggccatacagtgcctcctggattgtggcagcagtcgctcctggagtcctgaggtgccacgtgagaagttctgatgccctggggttgccacgctggagacgctgtaggtgagctctctgcctcccaggccccactgatcccagcccttcagccagccttgcaaggcactgggcatgtgagtgaaacaatctcagatcctccagatcagtccatccaccagctgaaagttgccaagtgactcctgtccacagcacacagaataaaagaattgctcatccaaatgctacccaaatttctgaccaacaaaatcatggaaagttaagaaagtaggtatttaagctactaagttttagtgtgagtttgctgaacagcaaaggacaactagaataaaaagataacacagtaagagaaagagaacaatacaatatttggaaaaatcagaggaagaacatagttgtgaaaatgttgaaaaatttaggccacacacacacacacacacacacacacacacacattgtaggcaactatttatcatcctttatacaatttgatcacctggcctctgaaatgggagctgaagccattgaaagagcagaggcaaagctgagaaggccacacataaaaaaggagatgggtgaataagaaaaaattaaaatgaaatctccatcagagacagaactgctgctaaacagttagtgatgctgaagacaaagcactcctggagggcagaagcagaggacaaagggatatgcttggttcaggagaaaacagggtctgataggcatggaggcagcatagaaataattggttttcctgaagaagagactcaagggacaataattgaagatattctagaagaaaacttttttacccgaaaaacatattgtccagctgaccacattctaggcaaaatcaaagaaaaattttctcagttatgttctgacagaatttcaattctttcttagtcacccatctccctttttgtctaaccctgtggccttcttagcttagcctctgctcttccgatgcttcagctgccatttcaggggctgggtgatcaaattgcattgaggatgataaatagtttctcatagaatggcaggaaaaaattgaacaaacttcaaaagaaaaataacagattacaacctttctccctaaaaaagaataaaaataaaacagatatcaaaatttttatctccagcattaaatagcaaaagaaaatgaaactaatcccacagaattttgacgaaaagtggtgattcagtaattatgtgtccacctaaatctctcatatttgaaaatagcaggtagccattcttttatatacaaggcctcagaaaaaattatcttccgtgttctttgcttaatgtgcactcaaaataattgagatagaaaagaaaaattagaacttcagccaggcgtggtggctcacatctgtaatcccagcattttgggaggccaaggcaggtggatcacttgaggtcaggagttcgagaccagcctgaccaacatggtgaaaccccatctctactaaaaatacaaaaattagccaggtgtggtggcagggtcttgtaatcccagctacttggaaggctgaggcaaaagaatcacttgaaccaggaggcagaggttgcagtgagccgagattgtgccactgcactccagcctgggcaacagagcaagactgtctcaaaaaaaacaaaaaaacaaaaaaaaaaaagaaaaagaaagaaagaaaatatagaatttcatagtagtacaaaaggacaggtggcaagcaccacaaacaatttaaaaatgtaatctaaataattgttgtaaatctgagaataaatgcaaaatagaaaatgactcttaagctaaattaatctaataaagaccaagaagttgttgaaaattgggagggaggtggcaagggaggaatatgcattgtcttaaggggagaaacccaagagtactatttcagtgttgactcttatatttagaagaaataagattaaagaatcctttgaaacagcatgaaggaattcaccttcccaacactgcagaagataaaagggagaaaacaaaggaaaacagacacaatggttaaaagtgaaggtgtaaaccagaatgacataaggagaaaaattcagtgagtgtcatgggtggattagggttagggcttcaaaccaccctgttataagaaccaagactctgtttttacacttaattcaaaatataagagaaatacccaatcaaagggcaacaaaagcttaaaaataagaagatggttcaaagtgcaccagcaaaagactgtcaggcaaatttcacacagctattagaaacagcaataatattagtgcccaagaaagtgaattggagaaagaaaagcattaatcttgatcaagggtaaaatccatgatgagaatatagaggtcatgaactttttacctgccgaacatggttgtatcagaggatggccacaaaaacagaagtgtacttgcaatatgaccttcgttccttggagtcccactgaagaagggaaggaacaagctgaagcacagcgagggaggggctccgtcactccagatgcgcagccagaggagtgaagattcagggtgtgcaggatggccagccagtcttcaaatacttgaagacttttcatatggagagcgaaattagtcttgcacatgatggctctgggaaacagatctagacaggccccaaaagtgatgggaatgcagtgtttattcatcccgaggaacagctttccgatagagtgaaagtctactccaaagaaaacggtcaaccctaggagacaggagcctgctgccaggcagcctcaaagcgggagagcacctgactgccgttgaatgtttaccgcgagacagacacatggtaacagatggaactctcaccatacactgaggtcactgccattggcatccccatgttgtaggttagagaaccgagggtgctgtgaagcttaggtagtttgcccagggtcagttagtagggaggtgatagactagggtccaaactcaggtggtctggccctggatcaagcactgtctctgtttcgttctctttccctctcctttccctttcttgttgcttccctttatctctcattgacatggtgcagggcttatacttgatggcttttaaaagtcattaccacagagattctagagctttgtatttacagctacagtcaaataagcagttcaaaaagaaaaagtttatttccttctctcattaaaaataaaaatatctggagaaaagcaacccaggcccggtaaggtggctccctgatgtcaacaggaacccaggcccttccatctttttttttttttttttttttttttttgacaagttctgactcctgtcacccaggctggagtgcagtggtgcaatcacagctcactgcaaccttgacctccccggctcaggtgattctcctacttcagcctcccgagtagctgggactatacaggtacatgccgccaaacccagctaatttttttttttttttttgtatttgtatttgtagtagagatgagatctcccatgtttcccaggctggtctcaaacttctaggctcaagggatccgcctgcctcagcctcccaaagtgctgggactacaggtgtgagtcaccatgcctggccctctttctatttttaatgtgtggtttccattctcagcatctcaagatggctgctgtgttccagtcattccatttgcaagaggcaagaaagaggaaggactagagcatgatgacttttctcattacctcatccaaggactcctgcttgtatctcctgaccacctcttaggtcttgagttgggaaatgcagtttttcagccgagcatatttcccaagagtctgttactaagaaaggaaggaagacagaatattgggttaggcagccagcagtcctagccaccgtgagttattgctgagtgatggtggcactgtgctatggcaaatcagtgtggttgaaaagttatctgctgctctccactcagaagttagtggcactttagttagtggcagagaaccctcagtttggataaccagtccttgtggcacttcattaaatataaccaagcccttatattaaagactgttctctcccttgcctcttttaccttttcagggctagtgacctctcttgaccaacaggaatgtatgggtgtaagaaacttctgctagcttcttctaaatgtctgcctacaaactcctcttagtgtttaaatctgctgttcaatgaaagaaaacagtatgtgatgaaccattcagaaaggaagcttctttttacttttcaggctggatagctctgtgtccccataagcacacatggaagaaggaaatttcttgtactggcttcttctcaatgtctccatacaaattctttttctgctagaagcttccattcaatgaaagaacacagtaaatgatgaactgatcacaaagcaagcttctttttccatagatcgttttctaattaattgatgtctcctaaactctgtgcagacaaatttatttggctttggaatttataattctagcttcagttttgcctgctttgtgaaaatgccataatcccattagtttttctttaattgctcttattctttatagtagagaagtatgcaaaacaactctacacatttaagtgcacacaagaattatgtggattatcagaatgcaattacatttcaagattgtagtgagctaattttcaatttggaccttattcttttttctcctcttcctttttatttttgcctaaacaccactacttgaaatgataactcattgaaacttttataaatgaagtagctctcaatttgttctttagcactgccactttccgccaaggctttttcacttgttaaatcatgacttattaaactgatgtaatgttacccagattttattttcttttatgctacaatgctccttgtagttccagtgaggtttcaaaagcccgaagcacagtattcagtattgtgcacgtcagacttttcgccaaagccttcagtgggctgctttataataactatgaatataatgctatcaacattttagtggggtattactaaacgagctatattactaataagaaaactttacctctgcaattttggttacagtaaatgaccattatttatttagttgttcccttttgctaaatacaatttcactgcagcctcttaatggagagagaatatccagctttaaacattggttctgttttgctgtttcattttaatttaatctagtttgaaattgcattaaatacatcacggcaatgtactaaggctttacaatttctattgaggaagtgtataaccaaaagtttcctgtcagctggaggttagtcaagccccatgagtttaagcaccagccagcatttgcctgcttgtcaaaggagaaagaacttcctctgccccaacatccctcttgactgcaagtaaacttattgcctgtcataactctaggagtattcttgcctcacagccctgaggtcttagaccctgagtgcagcaagccagtgggtatctgccaaaggcctcaggctccctctaggctgcccctctgcttgccccctttttctcctcataactgccacctggcagccaattaaaagtcagagggaccaagtggtggcccatttggggaacctcaggtcactatgctgttttatttggtttttgcaatgacacttctttgtctgattttaatttgaacgaatataataaaaaatcaggagtctacatgaaaacccaagggcctggcatttcttgggaagtcagatctggccatactggatccatactctacactggcagcaactagatggaactcagtcatggctgaaatctctggcccaagcacaaaccctccagtttgccacagtatccttgacaaagaagacgagtatcagctatcatccgttattgtgtttttactgttactttccttacagtagaggaaagtttctgttcccacacacatctgcatcaaaaatgagagaaagatggaggggaataaagagaaggagaatatttctctgacaagacaaggaataatcctatacttttcaaaagtaaataataatctgtttctttccttttcttttctgcctagcccctctatatccttaaatttcaaccccagatacaatttctgtggcagattatttttgccaaaaatggccaccacatccaatgcattcccatgtcctcttccagagccttgcccctcctacatgaagaggtggagtctaggttccctcccctggtcctgggcaggcctttatggctatctccatgaatcgaatatggtggaagaggcactgctcaacttccaagactaggttggaaaagaatatggacctctctctattggctctctctttctcagaacactttcccttggaacccagccaccacgttatgaggaagcccaagctacatggagaggccacatgtaggtgttctggccaacaaccccagctcagatccagcccttagccaacatcaactgcaaggcaaatcatgacaatttgttgtcacatttgaatacccagcatattttccaggggaaagaaaaaggattgagatagtttaattatcttcagatgatttcagcccccagcccctgagtcacccctagcctttgagtcttcctagctgaggccccagacatggtggaacagagacaagtcattccccaccttgccctgtctgaattactgtcctgcataagctgggagcctaatggttgatttttaccactgagttttgaaacaatttgttacacagcattacataactagagcaactccctctgagaattgtttctaggtgctctttccacctgtttttgtgttttttttttttttcaattaaaatctgattgattgtatctcgggacagaaaaagacatactgaatattgctatgtctacttttttttttttaaccactgtcaccactttatctattatcactgaaataagcatttctctaacatgcttcaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaaggtaaggatgtcggtaactgtgcatctcttcagaatagcgttttatttttataatgagtctcattcttcatctagttccagtatataattagtgcctaattaattccaaccaaatcattcatctgtcatgctttgttttccagattaatttacaacttgttgtcatttttggatacccagcatgtttgctgggggaaagaaaaaagcttgagatagtttaattatctataattattttattatacaaaatgaatatccgaagagcaaagcatggctaaaatcattaactagttaaagaataatttaataagcaaacatgtttagcaattatatggaaaatatgtcttcttttgtgaaactgaaaagacctaggaagaaaaaggcctgtattggaagggccttttcttcttttcacaacccattgttctctttcttggtgttgcctgaacagttcttcccacaaatacacagactcgagttgcatgccactttttaaatcgaaatgaaaaagggaaacatttgtgcaaatgcctctgccactcaaaagtgtattctcaagcatctttctattgcttgaatttcattgaaatcattcagctagtgaaacaaccagaagagagcctggctacctttgtgtctttaattgaaacctaggagtcaaggtttggagataacttagagcagcccctttcttttgcctaaaagtgagaagatggttagtgacctggttgagttccacagccacctgtggtttagagttcagtccagggatgtaaaaccactaagtgcccagaaagtgagcatcactgtgtaaaattaaacatgctaatttatttaatacatgtatataaatataatctaattatatttgttaatacattaaaattaaatataatttattctgatttttggtggaccatttaggtattaacttttgccaagttataacatttactgcattaagaagttactaatttactacattcaacattttaaaatgagtatcaaagggcattcagtgcgttgctggattcaatttgctgatactatttataggctatttgcctctaaattcataaatgagattgacctgtagttctctcttttatgcattgcttgtcaggtttttggaatcaagggtatgctagtctcacaaagcatttttggaagctccccatattctttggggatctgaaatacaaagtaacttaagggttgcacagaaattacccataaaaccaactgagtctggaacctttgggtagaggtgggatatatagatagattataccggcaacccagattttttaaatgtcataaagtatttcatactttcatccaagcttggaattattttcagttttgcatctatgtatgtttaaacctgttttagccttttagtcattctgtagtaatcaccccatgatctatgtagactcagagtattttcttatcagggaaaattctctaatccatgggttggtgaatttttactgtaaaataccagtaaatatcactctggggggccaaggtgagaggatcacttgagcccaggagtttgagaccagcctgggaaacacgggaaaaccccacctctacaaaaaatacaaaaattagctgggcatggtggtgtacacctgtagtcccagctacctgggaggctgaggtgggaggatcaattgagcttgggaggtcaaggctgcagagaggcatgattatgccactgcactccagcctgggtgacagagcaagaccttatcttaaaaattttttttcttttagactttgcaggccatatggtctctgttgcaactcttcaactctgctcatttagtgagcaagcaactatagacaatatgtaaatgaatgggcaggtttgtgttctgataaaatttatttattaaaccagacatgagctgtagtttgtagtaaccagcttttagccataacatttttgacaaatcattaccatttcatgaagtccagacctccaaatgtaccataagttccccaaaagcagaaaagccagtggttcaagacaaaatgcacagttcatctttaagactgcacccaatcctgtcagcctgcagtgctgtgctttaactttgaacctttgtgtgttttggttgtttgggctagggagcatttgaccaagaaaagagccttcgaaagtggcactgcaaggtcttaaggtggaatattgatagcagagaatttagaaaccccaaagcaagaagcgctgtagtctctttcatgtgcctttgtattgtcctcttggttctcagatggaggaagagcatcagtgttattctgctgacttgcccagttgtcagggatggtgatgctgtggtgcccccttaaagggaaatgttttttcaagatttaagactgactcccagcagccagtgcataaagccatttggagtgcctgcttttgtccaccaaatagccaggataagaagtatgtggaaattagtttcctgtcttacatgtaggtgattttctccaggtctggtgcttaatgactcccccaggcacctctcaggtaggtgctcttaacactgaaatgctaggaccaagctctgggagccttcagggaaacctgacctggccaagttcatttaactctgtgtagaggcccttttcaagtaaattctcaagtaaaaaaagttaagaaaaaatgttaacatcttgccttaaaaaaactttctcctctttgtatcttttctgtaatccaggtcatactcagacataactttagtcccattcagaccttattcttgccattattattcttgcagcatcactggatcacagtccaaatctcagagcagaggaggcctaggacagaaagcccgtccccacctgagccaagaaccaacaaccacagacagaattatacccacagaggctcccaggaaatgcagcaaagagtaggatccagtgtgagaggaggcctcgaggtagagcctcctaaataaaccattggcttctctggcaggctgaaatacatttagctgggagggcattccatatagaaatacaaattcatgccaaatcacttcagtcaccttgtgacctctatttcttaactgagactttgggtatatgatacttgagtttcattgctgggctttcaaatcccttttcatactgcagaaagcctagtgatctttccagaactgcattttgaaaagaatatagctgttgcagcattgcttctgagacatctacagtaccatacttggctgaagctccaagccatttctttgataatttcagctctactctatctcagtgtcacttgtatccagcatagtgcctggcacatagtaaatgcaaaataaatgttttactgaatgtaagtgaagacagttcaggatgtaactcttttccttacctcccacatggtgagttttatcaaaactttttgcattcggcctacctggaaatagatggtcaattgagatgaagacaagagaacccttgaatgaaattgaagctattctttaaaaattcatccttagtaatgagagtaataacatgctggctacacaggatgagttaagctcctcctcacgaataacagacatttataaagtcagtctagctcaggttctggagtcacgtgacttgggttcaaatcttgggtctgccgtttccctgggcaagttacttaactgctttgtgtctcagattctagataatatctacctcacatgggttgctgagagggtgaaaagagataaatgagattacatgccatactcaggacagtctctcatacatagaaagagtttcatagaggctgccattagcattgctcttacttctatgtgtgatggaattaaaggtaccctagagtagaagtctcagcccttgccaccagggccctgatgaagttgaggatatcagtctctatttaaagacagggatccgtgtacaccaggtgccagtcagctatagaggcactgtggccttcaggagagccctggaggctgtgaagtttggagaaggcctccccgagaaaggaggatttgagctcagtcttgaagagggacaggataagaagagagagaggctgggggagtttggattgtgtccaaaagacactgggccaacaacgtgggctgggcagagtctgtgaagggcagcagcaggagatgaagccagaggcatgggcagggacagacactggcgggccgcaagcacccagccacgtccaagtttaactggttaccttttagggatgggagctgaccaggcgggtgccgctgtacacacatagcactttgggaaaatggcctttccatctgtagtacccatgccagcagagagaaggtgaccacgggagaatggcttaccatggatggcagtagccaataggggcgaggcagctgtggatgcaggagctagctggaagtggccacccttgctgcatgtggtggtcttgctgacacagccactgctagcttatttccaagtcagcgatgagatggtggtgttgcagggcttttccgtagttcagctaaagatggggtccttgtccgtcccgtggccacgaaaacgtagcctcgcagacggtttgaagggtgagttaaacagggttttactgggtgaaaggaaaaaaatggggtggaggagggggaagcaggatcctccgcaaggcaagccggctacttgattcccaggttccacacaggaagaggaggggccaggctcctccccactgcagatggcatgcatttccggaggctccaccccaatgtgcaggctggttggagtttttctagggactccctcccacctgcctgtctcattggcatttgaagccagaagctagaagtctggcacatgatggaaagcaaggagcagggctgtgcttatgcacgtttgaaaagtcgcatggagccatccgtgaccgtcctggacatttcagtccttgctttttcttcatgtcaccctaataacaccaggaggaatgtggacagttttcatcatagtttatttttactccctcagtgctaatttccccttttttaaatactttagcatgtgagttggggcaagggagccaaggacagtgaaaaatagtttcatcgtgtcccactggctgtggttgggtgacatgtccctccgggaaccacaccctgaatcctaacaaacaccagtgctgatgttactgaagcccagggatgtgaggggagaatggtggatggattgttctagaacagtggatattgggcatcaagaacaagagatactcccaggaggaagtcggctctcctttgaacttctacccattgcagacgcacacagataccaccccagagagtagctccttcccacagtcactgttgtatttcacatcttctgcttccaaaggagaacacagtggttctgtgatggaattagtccatccagaggacatggttttccgggctctagagttggatggatttatagaagtaaattaccctaaactattagaactgctctagtgccatggagaagagctgacatcacaggctcaaatgctgctttcaactgcaaacaaaacctggagtgttctgctggggggtttctgatagaacccagcaacccgatacattataacaatttatggcactaattgaaactaattgaaattcatctgctattacctctgtactttccatgaaaatgaaaagtaggatgaaagtaaagtaaaaaaaataaactaccttaatggctcaaaatggatcaattattttcatctttagctaaatacagtttactgccttattaaaagcatgtttgtaggaaaagtataacattaaaattccactgcatgcatcatcgaacagaggctttgttatgttatatctaatatattcttccctttttattcagcagagcagaacgggacaggtcacgttttgggcatagaaatcttatgctttggcttctaaaaagtaaaaagcgcattgtctggttctattcgtgggctatatatatatatatatatatatatatatacacacacacacacacacatacatatatgtatatacacacacatatatacatatatgtatatatacacatatatacatatatgtatatatatacacgtatatgtgcatatatacatatatatttcattaaaatacaaaagaataggtaaatatgcatagacataatttaaaatatataaactataaaatgtaacatacacatatatgtatatgtgtacatatatatatatacacacacatatatagacagaatcttgctctgccatccaggctggagtgcagtggtgcaatctaggctcactgcaacctctgcctctcaggctcaagtgattctcctgcctcagcctcctgagaagctcagattacaggcatgcaccaccatacccggctaatttttgtatttttagtagagatggggtttcaccatgttggccaggctggactcaaactcctaacctcaagtgatcctcccgccttcgcctcccgaagtgctgggattacaggcatgagccaccactcctggcctgttttttaatgagtgtttatttcacaatttattaataatctgtgattgctacttaaaaatatttcattatctagttatttgctgaagatatttacccatataaaatgccagttggagtatattttagtaacgtgttacatatccatctgcaagtgtactgcagtgctatgagacctgattttgaaatagactcacagggtttgagtcctggtgacccacctgcttgccatgtgacctgaccttgagctcaagatttaacctctctgtaccttattttctggataaaatgataaaccctgtctcacaggcctgttgtgaggatgaatgagtcatatgtaaccactgtatgtctgttttgaagcagaaaaaggaaacataattattcattaaaatacaaaagaataggtaaatatgcatagacataatttaaaatatataaactataaaatgtaacatataattcttgtttctctggccttaaaaatataataactatgaagaaaacttcatgttaatattgtgtgcataaatcctgaatttatttcttatactcttgagatctaacttcatggccagaccaccagaccagcaaatctttccctccaagtcccgattctctccatggagaagcttcatctttatagcattgagcgtgaccatgaaatgacagcagagcacaatttccagatgttttaaagtcaagcactcagttcaaaagaataaaatgactttttagcatctactaaaaataatttctttaaaagttgtcccattacttttagggtacatctatgactaaaagaattagcactttattttacttcttgaacttaatagggaaatcaacttagttttcctttcctgcgaagtcattttacctttaattacttgttttctaactcctgaaactcttacatactgcctttaggaaccaggatgatgaaactggcatttttcccccttgattaacataaattgaagaacttcttgcatcttggtgcattattctttttttttttttttttaagacagagcctgtctctgtcaccccccagtggcacaattgtggctcatgcaacctctgtgccctgggttcaaatgatcctcctacctcagcctcccgagtagctgggactacaggcatgatccactatgcccaactaatttttgtgtgtttttagtagagatggggtttcaccattttggtcaggctggtttcaaactcctgacctcaagtgatctgccagcctcaacctttcgaattgctgggattagaggcgtgagccaccgcacccagccccaggttgaaactttaaaatgtgatcgctttatgtgcatggtcactgtcaaagttgctgatttgttcatttacaccttgagaggccaaggtgagaggatcacttgaagccaggattttggaaccagcctggtcaacatagcaagaccccatctctacaaaagttttttttaaaaactagccaggcatagtggcacgtggctgtagtcccaactactcaagaggctgaggcaggaggattgctggagcccaggagtttgagactgcagtgagctatggttgtgcactacactccagcctgagtgacagcaagaccccatcttaaaacaaaacaaaaacaaaaacaaaaaggtcatctctacatttctaccaacattttaattggcaagtgctagttcccttcagtctgaagtggggaattgacagctcactcagatattgactgcatcatcactttccgtctctctctcccctgttgggctgttgacgctgacaccctccttcctctaggaagcacccttgcacattctgtttcaaaggctgccactggttagcagtgcgagaatgacttcgggctccttcttgcttgccagctttaattttcggagcttccacacagtcgcctttttacgggtgctctgcctggaccctactgcccgtctcagatctgcaatcagagtaatgcacgatttattcgctaaaaggagcaacaaagattggtcttccatgaaaactgccatggttatattcccttatcctttatggggaatccacccagagtgttcttatcatttgttatttgccatttgaaagtggggcagcccatcctttacctctgtcacctgttaaatcgagagcaaaagctggtcatttctcatctgttaggtaagctgatctgggaaggaaacagtgactaaatcttttagcataaaactgatatccaggggaaatcatcagtttttccactctacttcttttatatgtgtctagaaacttcaaaaacagtgtatgtgatattccggtaatgtgaaggaaggttccatgagttataaagtacacaatggtaggtatacatgaattaaattcatctttaatatggacatactatatatccagaaaattaaaatttaaataaataaattcatatttaattaactgaagttttccggcttattaaaagcatgctgtaggccagtgtggtggctcatgcctataatcttagcactttgggaggccaagataggcagatcacttgaggcccagagttcactaccagcctggccaacatggtgaaaccccatctctattaaaaatataaaaattagccgtgtgtggtggtgggtgcctgtagttccagctactcaggaggctgaagcatgccaggaggcagaagttgcagtgagccgagatggtgccactgcactccagcctgggctacagagtgagactctgtcttgaaataaataaattaattaattataaaataaaagcatgctatcaaagaacatatgtcataggccccccataactggggctatcttacctgtctatacagctatcacgctgttctgtgccagtggaggcccagacaccccctgcacatactgggacacataactgtcagccccaacacctccctcaggcacagccaacagagtgtcccccggctccggtcattattcacttgccctcggtttgtcccgcccagcagctgctttctctcacatacttttaaacactttcttccttccagctcttacccagggattcaggaagatctgtttctctgaggcacctactgtttgactgtgtctctgcccccctttctttctctctccatttccttccttccccatatctccttcttgattcagcccaaaattgacttaaccgttgcaaaatgagttacccaactgctacttccatataaaatataagaaagcctggtcatccaacgtcacgtttacatctaaaagaaaaccaggggtggaaatctctcaaacttctacaaattcccagaagttatatcagcctcctgagtaactaggactagaggtgcgtgccatgcttaattttttttttttttttttttgtagagacagggctatgatgtgtttcccaggctggcctcgaactcctggcctcaagcagtcctcctgtcttggcctcccaaagtgcttggattacaggcatgagccactacattcagccctgtctttctttaaatagcacattaaagacgtaatttcttgtttccctgagcttaaatgccaccaatatgacaggagtattattttatatctatcatttgttgtaggcacacacaattttggttacattagggactatgtgggattttatgagcctacactggaaacctaataaccagatctaacatcgttaaggggaacatatttctatcttacatatctcaggtgtatagcccattctgtgactggatagttcttatagtgccaacttagtagtgaataccaagcagaaatatgtgctgggaaaatctggctacagtgagtcattttgtgctaaatatttacaggatccaaaagtatgatccagctagcaggaagaaagtcttaggatcagcaatctaataaatatctgacatatatccatgtatctggtcaggaaatagtactgtggtgataattacagtcacatctagtgtaggccacaggcactgtgctaggctccagggataacatgatgggtagggcaaacatggaccttacagtccaaacaagtcatctcgctgcgaagcctggctgtagcctggctgcgtaggccatggtgagtgctgggaaggaaaggtggagaccgcccacaggcctgctggggcctcacctgcctggaggctggacagtctgtggggcccagatatagctgtgggcagcctgaggccttgacatgggctcttcagaagcactggttccagctcatccatattagtaaattactctgataaatgtaagtaatcatatttttaaaccagtttgatttgtcccaaaatgaataatcaaagtttttgtctactaggcttttttctggagggggccccaaaatataagactttggttattctaagagttagcaccatgcttatattttgctgtatgacaacattatatatgggcatttgagtgaaacccatgttattgttcacagttctaaatgctattgttatcaataatgataacaatatgagggattatgtataaaagtacctaactttgtgcctggcatagaggagtacagagataaacatgaactggatctaaaaatcctttacaaagtaaatgtgagcagtgttgcagaaagaactcacaactgcacaaagattatgaaaagaataacctcccacagaatggagacatttaaaggcaagaaattgggccagatgcagaggctcacgtctataatcccagcactttgggaagccaaggtggggagatcacttgaggtcaagagttcaagaccagcttggtgaacatgtcaaaacttcgtctctactaaaaatacaaaaattagcctggcatagtggtgcgggcctgtaattccagctactcaggaggctgaggtgggagaatggcttgaacctgaaaggtggaggtttcactgagctgagatcgcgccactgcactccagcctgggcaacaggcgagactctgtctcgaaaaataaaaatgaaaataaaaaaaaggcaagaggtggacctggtcaagaatagtaggccatcttacatattaataactagtttttatcatgttttattctatttgtggaaggatgtgatttgacctgtaacatgttttatttatttaatataacattatattatcacggcattctactatattttatgggaaatgaaagaactataactagtcttagaaagcctgtttaaatgaaaagtttgagatgaaatcactcaggcagtcatctcccatatgaccatgctggtttgcactgctggtcagtaaatattcatccttctctccctcctgtgtgggcagagtggacgtcctcactcccgtgctcatgggcatgaccatgacacttgctttggtcaatgggatgttagtggatatgatgtgggcagaggcttgacatgtgcctgggcccttgtgcttgcctttctgtgcacctgcatttccccatagatagcaaatgcctcaggtagctgtcaatccaagcaggatgaaacacacatggtgcaaacaaacccagccacaacctagagccagatcagctgacatcagtccacccacaggtgtgtagaccacccacaacgtgcttcttgtttgacattgagttttgacgtggtttgctatgcagcattattatgatgataactgactcttaagataaccgaagtctcatatttttgttaaacataaaggtagccaaaactgtttagaagtcacattatctagaaataaacctgtaattttgaaatcagatattttacaaaatgtattacctttggaattgaaaagtatcgtcctctccagctgcctgcagtccgtggaccacccttgctggatcagacacctctccaaaccccagcagcaccacaggcccagttttccatgagcctgtgaagaataagcccagctcacagtagagctgctaacagccatcatgaaagagaccagaaaatacaaaatccttagctgtgtgagacctaaacacacttaaattcgttcaactgaaaatgaatattgttttggcttgcctatttcaaaaggacagaagacctaaaaccttttatagttttcggttcaagttttgcctttccttgcaggctgattctttgttgtgccagacagccaagattcatgtttcgtagcagctgggagcctcaataatttaagcaaaatgttgcctctttcagccaaggaaaatgcagctcaccaaggaatgttgcattgtagcatctgaacagagtgggggtcatagccataaaactctcctagcgtcctagcgagggcaggaatggagagaccccactccctcacttcagtgccttcttggctttccatagatgaagagcagggagtatgggagaattttctagatgctgttagcttccaagaagccatctgaaagttactgtagtttatttttcctaagcaaacaagacaagccatcacacttcctttcaactttggattgaaaacaatttgggcatgatttcctcaaccaaatcaaattaatacacttgccatttattttggcttgtaaaattccttttcatattatttcatgaacaggagaaaaacagagagacattcaatgaagtgtacattttgtggtaaaattggtatatcttacctggaaaatgagtctacagcagtttatttgtgaaaatgtgaaaatgccaattcaatgtcaaaaatagcatatactacatttcattaatttaatagtgtcattgaccttaaaactgctaaaatagtagaatagcatatgtaattgcttctgtagtctttttgagaaatgtaaatagtatagactatttatcatcaaaatgctcttacacaagggaaatctgtcaagattattttgtgattttatttttgctaacaaaaatactgtctttcagtccctctagctaggtcttgacacattatattctaaaaatcagggttgaatctttgtaaaattatctggtgaaaagcagaatgttctggcctttaattctcaaaaaagggaaaacttccttgaaatcaatccagttcaacatttaaatattaaaatatcagtaacatcatgagcatgaatattttttaccattgcctttttgtctgtaaggaagaactagtatacattgccaacattagtaatttggtttccttaataagtatagcaaattgggaacaaaagcaagataaaaggtttttttctagacagtttctttcagcctaatttcaacttcaaattagaggaacataaatgaatgtcctacttctgcattaaaagtacttgactactttgtgggatgttttgtgctgattctttactaaatgatcttggtcgccgttgctaggtaacaccgctggcttcctgcagctgaaaaatgagagggttatacggagcaattcggcattattagcatttgactaaggttttttggttttctgaactgtatatcttagcgttttcccttctttcctagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctgtaagtgggtccctgcaaacctcactcaccagccagggacagaggacatctccaagggatttgggggtctggaagattgcgggcagtgaatttgtagtaccagatgttggattttgttttctgtgtgttcagattacctcttgctgggtaacaacccaccccagactcagtggcataaagcaacaacaaccgtttattattcttatctctcctggttttttattattattttattatccttatctcttctggctttggccagactcagctgggaagttctcacttgaggtcgctcatgcggctgaagtcagcagtgggtgggctggaattgtctcaaaagcatagtcactcacatgtctggctgttgatcctgaatcaactttagttgagattttcaccagaacacttagaagtggccccttcatgggactggcttcctcacaacatggtggtttgggtctgagggtagagtggagagagaggcagtgtcagctgtgtcaccctggatgacctggcctctgaaatcaagcagcattcctcccaccacattctatttgctagaggcaagttgccaggaccagcccatattcaaggagtgggaaattaaaccctgcctgttcatggaggtcaaagatttgaatggagagcgcttctctttacggagagcttgccatgccccaggacattctgtcaactcatcaggacagctctgtaaagggaagtatccccagtttacagagaacgctgtggctctaagtcagtggcactgctggttccctgcccagcccaaggtctatgctgccattaacctcttaagattctggcaacagcagtggtgagtctttccccatgacacacaacttctggcaatgtgtatagagagagcactttcctttccaggtgggtgacaccccaccttccagcctgcaccctcagagtttacagcttaggaggttagtagaagccctcagggagggaaggagggaaggggccggtccatctcactgagaagcaggggaaccttgctcgaaagggaagctgaggtcggtatgaggataatggttgtgtaggtcaagggtgtgtgttaacggttgtgataaagaatgcctgctaacatccagtgggcaagccatttaggggcaggcattcacagcaggcccttacctaggagtggggggtgatcagcctaagtcagggcttctcactcaggtgctgctaaggattgagaatggtggctctcacccccaccccaacccagaactcaaaggacaggggctcaaagcagaccactgaaaaagactaaaaaggaagattttttttagaatctctcattttatcctgagatccatggaaattgtgtattctactctgtagttcattcatttattcattcattccataaatatttattgaacacctgctaggtcccaggctctgtcctcgatgttagggatgtaacagtgaaaaagacaggacaagtccactttattttaaaaagtgatactgtctatacatgtatgtcatgacacctatttaagacaggaaatatcaaaatatttttgcacaaattttccctcaaaaatggcaaacctggaagattgccacgtttattctggagcacctctagaggtgagtgtgtgccttgttcaggaagcagaggcctgagaaaacctccccaaacatcccattggatagcagctcttctgaccttcactttcctattcagattagaatcaaactcctgacaaaaacatctggcaaattaaattgacccttgaacacatgaggagtaagggcagcaaccctcctcacaaagttgaaaacccacatagagcttttgactctccaaaaacttagctactaaaagcctactgttgaccagaagcctaactggtcacataaacagttgattatatgaaaatgtattttgtattttatatgtattgtatactctatcctcaccataaagtaaactagagaaaagaaaatgttattaagacaatcataaggaagagaaaatatatttattcttcattaggtggaagtggatcatcataaagatcttcgtcctcattgtcttcacgttgagtaggctgaggaagagaaggaagaggaggggtgggtcttgctgtctcagggatggcagaggcagaaaaaaaatctatgcataagtgacacacagttcaaatccatgttgcccaagggtcagctgtaacctcaactgtcttgatccaaggcaccttcctgctacattttcatcctaacaccgtctgagtcagacattggcttgtttgctgttatattctttctcctaccttccctggtctgcttggtctcacaaagaatggcccctgcagatgacatttcccaggttccattattctctgattttcatctctatttgaacaatagtttgtacctgtgggagattaaacatgggaagcggggagtcagggtaggtatctctcatactgtctgctttgggcagcatctgtcagggcattaagcactttttggtggggatgaatatgtccatcctcttcactatggtcttggtgtcatgagttgaattacatcccctagaaagatatgttgatgtcctgacccccagtaccagtgaacatgaccttatttggaaataaagcctttgtcgatgtaagcaagtaaagagaaagtcatcctggatcaaggttggccctaaatccaatggctggtgtccttaaatagagagatttgatggcatacagggacacgcaatgaagaaaacctcacgacagtggaggcagaggttggtgtgatggcagctgcaagtcatggaatggcaggaattgctagcaaccgtcaggaagtaggaagaggcagggaagccttcttccctagagcctctggagggagcatgttcctgacaatacttggattctccagaactgtgagagaataaatttctcttgtcttgagctacccagtttgtggtacttcattacagcagccctaggaaacgaaagcagatgatgtcacagtgtatgtacctactaaaactatgatgttgataaccagaatcatacattatatactatttttctatttggcttcatttactcagcatggtgattttgagattccatatagttccatgtatcaatagttcattcttttttatggctaagtagtattccattgtatggatatatctcattttgtttatttatttgcctgctatgcacattctggtacatgcctttgtgtggataatatttttatttctcttagctataaacctagagattgtctaagtcatatggtaggtgaatgttgacctttttaagaagttgccatgttgctctccaaagtagctataccattttacatttccatcagcaatgtatgagagttccagatactccacgttcttgtcagcacttggtgttgtcaaattttagtcactcttgtgggtgtggcatggtgtgtcattgtgttttttttaatttgtgctttcctgacaattaattatgtttggtatcttttcgtttttttagtagccattagtatttctcctttttgtgaaatgttcaagctattataaatgtatttaaaattttgaaatttccagttgatcactgcaggtttacaaaatgcaatttattttctgtataaacattgtaacttgaaaatgctaaattctcttattagcttttgtagttgttttttaggtccataaacatgtcatgcaaatagaggcagttttactacttcttttctgatatttaggtcttttatttcagttacttgctttattctactcactaggacctacagtgcaatgtttaataaaagtgggggaaatagacatccttgccttgttccatatcccagagagaactttcaggctttcactgttaaatatgagataatttggctgtggatttttctttggtgctttttatcagactgaagaagtaaccttccattcctagtttgtttagaggtttttatcatgaacggctgttgaattttgttaagtgaattttccatatttcttaaaaagaaatatggaaattttcttcttaattctttaatacagtgaattacgttgatcgatttttgaaaatgttcagccagccttatatctctggaatgaaacctaattggtcataatgcgttatctttctatatattcctaaattttatttgccaatatgttttaagaatttttgaaactattttgcaactatattcatgagggatgttgatatagaattttctgtttcagtaatgtccttgtaaggttttggtgttcgagctgtgttggccttataaaaaaattcgggcaatgttccctccttgtttattttctgaaaaagtttgtgcaagattggtattttttctttcttggacgtttgacagaattaaccagtgaaacaatctgggcatggagtttatattgttgaaaggcttttgataacaaattcatttttttaactagatataaggctactcaaattttctgcttcttctataaatttttgtaagttgtaatttttaagaaatttgtccatttcatttacatttgtcaaatttgttggcattaagtttttcacatattattttgttatctatttgatgtctaggatctgtagtaataacccctcatttatttctgatattggtgaattgtgttcagtctctctgaccctctctctgtttgctgccagtctctctgtctctgactctctctctttctctctctctcccagtgtagataggggtttgtcaattttattgatctttttcaattaaccagcttttgagtttgttaattttctctattatctgtcagttttctcctctattgatttctgctcttaattattttcttccttcttcttgctttggatttactttacccttcttttttctagttccttaaggtagagccttaagtcgttgatttatataagcatttcagcataagttttccattatgtttgagctgcatcccataaactcatatgttaacttttaattatcacttaattcaaaatattttctaatctccctgtgattttttattcaaccttggattatttagaactggattctctaatattcaaatatttaaggttttcctaaatattatatttttaattgatttctagtgtaatgctgttgtgatcagagaacagtgttttaagatttagagccagggacggtaactcacacctgtaatcccagcacattgggagacctaagtgggcagatcacttgaggtcaggagttcaagaccaacctgcccaacatggtgaaaccctgtctccactaaacatatgaaaattagccaggcatggtggtacatgcctgaaatcccagttactcgggaggctgaagcaggagaatctcttgaacctaggaggtggaggttgcagtgagcccagatggcgccattgcactctagcctgggcgacagagcaagaccctgtctcaaaaaaaaaaaaaaaaaattattgagacttgttttatgtccaagcatatggactaactttgtgaacatataaggaatatgtattacgtattatgtgcttgttgagtttaatgttagttcaatatggttgacggtgatgttcgacgctcataagtctttactgatatttttatctcattctattaattgctgagagaagggtattaaaatctgttactattattgtggaagtctctgtttttccttttaattcttttgatttttgctttatctttttgggggctctgttattaagcccatgagcatttatagttgttatatctgccttgtgaattgtgccttttatcattatgaaatgttcctctttatctctgatatttaataatatcccttatcttaaggtccagattatctgatactaatatgaccattccattcttcttatgcttactgtttacatgatatatttcccatccatttactttctacttatctgtgtctttgtgtctaaagtgtgtctcttgtaggcatcataaagattatattaatgtttttagtgctgcatgacaaactgccacaaatttagcagcttaaaataacatccatttactagtttatagctctagtcagaaatgcaggcaaggtgtggctggcttctctgcttagggactcttaaggctaaaatcaaggtgccaatcaggctgcattctatctggagcttgaagtcctcttccagacttgtgtgatagtaatagaagttaattccttgcagctgaggacagaggtccccacttccttgctggcccagccaggggctactctcagctcctagaagccattcatatttcttgcctcatggccccttccatcttaaatccagcaacagagaatcttactcatgtcaaattcccttcatatttcaaatccttcttcagaaaaagcctggtcccttttaaggtttacctgatcaggtcagacccactgagcatgatctccctgtcttaaagtcacatgtgccatataacatcaccttacacattcacagttcatgcttgtacttaaggaagaggtggaatcttgggaaccaccttagacttctgcctaccacatgctttttatcctttctatctctgcattttatttaaagtacttagaccattaatatttaatgtaattactgatatggttagatttaggtctaccattttattatttgtttactgtttgttccctcttctttcttttctgttcccccttgcctgctttctttaggattattagagtattttttagtagtctatttcaattggctctttattttattttattttattttattttattttattttattttattttattttgagatggagtctcgctttgttgcccaggctggagtacagtggctcgatctcagctcactgcaaactcctcctcccaggttcacgccattctcctgcctcagcttcccgagtagctgggactacaggcggctgccaccacacccggctatttttttgtatttttagtagagacggggtttcaccgtgttatccaggatggtctcgatctcctgacttcgtgatccgcctgcctcagcctcccaaagtgttgggattacaggcatgagccaccgcgcccggccttcaattggctttttaactatatcttatcttttagtaattgctctatggattataatacacatcagcaatctttcatgttcaatagagttaatattgtaccatttcacataaaatgtaaaaaccttgcagctatgcagttccttctccccatattctggatgtctattttgttaacagccatcctatatcttacatctacaaacactgcaaaatcagtaaggcaatattgtaatctttgttttaaggtcatatgtattttgaagaattaaaaagaatagtcttttatagatactcagatatttactaattttcttgttctatcttcctttttgaaaatccaagtcttccttcagcctaaatgagcttcagagcatttattgtattgtaggtctgctaaaaagtaattctttagttttgctccatctgaaaatatatgttgctttcattcttaacgcttattttcactgaatatagaattctgggcttataggttattttttcccagcactttgaagatgcttttccaccatcttccaacatccatgcatttttgtttaaaaatctacaatcatttaaaacattcctctatatgtcattttccattggctgctttcaaggtttgctctttatccttggtttttagcaatttgatgctgtgggtattctgtgtttattatgtctctaagcatggtttgttttttttgtttttaatttgtcttgtttggcgttcactgaacttctcgaatccataaatttatgattttcactaaattttaacaagttattggccattctttcttaccctattcttctctcttctcttcctgggattccaattacatatctgttaagagttttttatattgttccctggggctctaaggctctgttttttcagtctcttttttctctttctcactattcttcaaattggacagtttctattcatataacttcaagttcactgactctttcctctatcatctctatttttctattagggcataagatgactgcagctcacccttttataaaaaacctctaaattgaggccagacacagtggctcacgcctataaacctagcactttgggaggccaaggtaggtggatggcttgagctcaggaattcaagaccagcctgggcaacatggtgaaggccatctctacaaaaaaataccaaaaaattagccgggtatggtggcaagcacctgtagttccagctacatgggggggctgaggcagaaggattccttgaacccgggaggtcaaggctgcagtaagctgagatcttgccactgccctccagcctgggtgacaaagtgagaccctgtctcaaaaaaaaaaaaaaacaaaaacaaacaaacaaaaagactctaaattgaatacctgtatgtggaaatggagagaaaaggtaattgaaaaagcaaacttaaaaaaaaaaaaaacacctctaaaataagggaaattatccccatcctggtcatttctccaagtttttactgtaatacacaagctacccaaacttttaaatactaataagaatcctcttatatcagagtttatagttattatcagtgggattcatctcaggaggttataccaccaaggcagaagcagaactctcttgaaattgatgttttgtccccacatcaaagcctctccacatcctgcctgatagtggcgcctcctgggctcttagcaggtggtccagcctccagccaggttaggatgcagtgacactggctctcaaggcagactttcccatcttgttggcattcatctttccaattagatcatgcgctccatgcttatgtttttcaccaagatgttctggagaccttgcacagtgcctgggacaagaagtgtttgtctgaatgcatgaatgaatgaagtttatcagactactgactcccacccttctccctagctaaccaaggagttttgctctccttaatcagaattatcaatataagtagtcttgaaatatgtactcagaacatcagtgtggccagccattacctcttcctatttgtacccaatatgtagtattccactggcgttacagaagcacataggttgtatttgcaaggtctgtaacttgtaacacatgttcttattaacaatgttggatttgcttattcagttttcactccagtctacaaactcctatgaaaccccaaatgtagccaaaattgtgaatgcctacaccaaaagtgtataagtaaacattactgcaatactggtaacctttaaaacccagaaaaacaagaactagtatatttaatgtactacttaacaaaaagtaggcttaattagagaaagaaaattgggtaggtagaagaacttctgtgaggatgctgaaggagacttctaaacattttcaagggctcaagaggttgatagcactgtttttatttataatttaaattcaaatcagatatctttctatatatttatctgggtaggaaatctattttttatagagatggggaaagagaatgagaaagcaaaaaaggagtgtagggagacagaaagattcagaatcagagagagactcagagaaatatattttcctgtggccactgggtaagagttataagacagaaaaaaaaagaaaaagacttgaaagaaagaagcatcctgggatgggattagacaactaggtgaataaagacaggacaagggcacagagtgtatctccctgagggaggaccaaggacatcatagagatgatggatctgagtgctgctgtccaatagaaccttcttcaagatggaaataggctgtatctgcactgcccaatatggcagccagtagccacctatagctaactgagcacttaaaatgggctattgcaactgaggaaccgaatttttcattgtatttaatttaaattaatttagatgtaaatatttatagccttgtatgactagtggctaccacagaatcagaaagctccctgaaccattcatgggtgtggggcaggaatactgaaggggctggctacctcttgcccaaggacagctgatgtctatacagaatgaaacagttgaggggggtaaagcaggaatgtgatggaagtggggagatgaccatcagtatggttgggacccatgtcttatgttcattttttagcatgcttttaataaagtggcagactattttagggaaagataaaatcaattgagcgtgtttcaattggtccaacaactaaagacaaaaacaactaacttgcactgcttcagtgactttcaacatcagtgtggaagacgatgtccagatgagcatgagaaagcattgaaatttgagcacagaatggagagggcatacaaataatttctaaggagcatgcaaaggggttggtggcccctctgcttatggcaccctcacacagtgcctggcatatggtaggtatgccatcagtatttcttgaatgactctgtgtcgtatgagagcaggaagcaacaaggcaggaacccagacctagtagatacagagactgatgaagcatccatcttctctggagcatcatatagggacaagcttactgagttttaaaagctagcaatgggcagtctgaaaactgaagactggatgagatcaacccaagaaggaacctgcagagacccgagtgtcagacacaggaaggggaagaggatggaggctgcgctagagctgttcaaaatgtaggagcatgaggggaaggcagggtctgtacaaatgtaaaccctcttccgccgaaaaccactcacacttttgtgggagatatttcatcacctggcatccttctctccactggatgagtgaattgagtgaataagagtgacatttggggatcttaatgggttcttcatgcccaaggcaatctatctctcatacgcacacaaacaacatgatagcaaacttttagtatgtgtatttttgtgccccgaataataaaatgccctggagactagtcacacttttgggaaggtaaaatgaagagtgataactgaatattgctgtaattgttcacttcgtagatgttcttcagcttctgtgagaagaatgtggattatgaaacgtttaaagccctcaatgatgcatgtcttgtgtatgacagtcgacttgtgattgataccaacttccacaccaacgacatagccatcagagctgctggctccctcaccaaattctccaatagatactactcaaatgagtggactcacagcaacttcagttccaaagaaattggctttcagctggcagcagctatgctacatctctttgatccaacccttgagcctgtgaccgagccaccagctaatcttgaccggctcatccccatgtacaagggagccaagattcaaggtatacgagtaggcttccttctccttgatgaagccacagattaggtatggctcagcagtcaggccagtcctccaggtttctcttaggcttggggaaaaggctcctccgtacctcaatgggttgccacagagacagagaaagggtctataatttctgaagcatttattacaaacctggaattattgttattacggttctttgcatttgagcatttactatggaccacatcctaaatggggttcccactttacagataagaaaacagacaagggaatgattattaacttgtctggatgtctcacagctggaaaatgatggtttgccctgacatcttacccaaaacttccattctctctgtaagttcagagataaggagacccttccaggcagccaggcctcagcctgctctggggatggataagcttaaccatttgcagctgtaaagcagtgcacttttatcccataaacccttctgacccctaaggaggagatgatttcatgagtaatgcagggttccttcacgtttagggtatgagaaatacctttgaaaatggtgtttctgaatgttgtggaccttttaccagaaaaatgcacatatttacaaaattacgtgttcccttcctggaggtttatagatgaacccacaaagctgtacatagacccccagggtgtccatgaagcccagtccagtcaatggaatgtcagattacagagacgaaagccccacattccatccttgtcttcctcttcctaactaggcagccccacaaggtcttgctctgcttctcactctgggtgagacctgaggaaaggtggtggccgtaggcaggcaagagaagggagggctgtcagaagccagagctggcacaggcccagacctcaggaacaaaccaaaatattaagaattcgataatgacagtttctaaaacattgaacaaagaactttgttgatagtcctaattaaattcaattttttaatattttggctacattttggagaagtgatgaggaataggaatgctgtttgcaacatttaaggcttctaaaggtcttgatctggttttggcagatacaggttaaagggcggggagctccggataatcacaggatacacaagatcggcttggcacatcctggagcaatggcggctacattatgggatatcatatcacattcacatcaatttggttaaataaacgtcaaccaccccagggagttccttgttgttagtggtactttagtgtgaaagtttgaggagcatacgccactgcaggcatctgtttgtcctgtgatgaaaatatgagctctgttactcacctcattaacaattaattttaaatggaaaacttgccatctcttctagggggcattcttcctgggtcttaccattatctgcatattgccaagcctgccattccaactcccttggaggtacaaatggcacagcctaattatgtaagtattatttctgaatttcattttactttcaaatacaaaactttgtttataagaggatgaaattctttacttggagtctttactgtaatgtgttggttcacacatcagaagcccactggagtaatcgtcccccaagatggcccttagtgactctcgcaccttggtcttcatgcccttgtgtggctcctcccacactgagtagggctgacctgtgtagccaacaggatattggggaaatgactgtgtgacttccaaggtcaggtcaggtcaagaaagatacgacagcttccagcttgcacacttctagatgacttgctgccatgctgtagggacgcctttagagaggtccatgtggcaaggaattgaggactcctgcaccagtcatgatcagtttgccaggcagacgagtgtgccaccttgaagtggatcctgcagcctccttcatgccttcaggtgactgcagccccagccaacatcttgactgaaaacttatgaaaggccttgagccagaactccctagctaagccattttcagcttctgactcccagagaccgtgagataataaaaatttattattgttttatgccattacttttttcaatagactttattttttagagctgttttggtttcataacaaaattgagcagaggtacaaagatttcccatgtaaccccaacccttcaaaagacatatagcctcccccactatcaacatcccccaccagtgatatatttcttacaattaataaacctacactgacacattattatcaactaaagcccatagttgacattagcgttcattcttggttgtgtacattctgtgggtttggacaaatgtataatgacacatatccaccattacaggattatacagagcagcttcactgccctaagaaccctctgtgcactgcctgtttgtccctccctctgtcctaaggcctagcaactactgatcttcatactgtctcagtcactttgccttttccagaatgtgatatagttgcagtcatacagcctatcgtcttttcaggttggcttctttcacttagtaatatccatttaagcttcctctatatctcttcatggcttgatagctcatttctttttggcactgaatgatcctctattgtctggttgtatcggtttatttatccattcacctactgaaggacattaagcctctacattttgaggcaacctgtgatgcatcgatagataactgaaatatccactttcatgtcaatggagcaagtagattgcttagcatctggaatggccatggagaccccactgttttcctcccctccaggaaaagcagaagctgtgcagttgggaattctgctgtttaaaggacacaggtggttggtcagttgaagagctcctctaataagattctctgacccatagtcccagcccggtgtgtgttgtcatctgggggcttccttttggatatgtcacgtttgatttttaatcaatgaggcagattggaagctgtctacttaacttccattcccattttcttctcttgaatatttttgagggtaaacaatatgaccaacctaaaataaacacatttcccagatttcctcaaggacagggtcagccatgtggcaggttctggccaatgagatgtaagcagaagctcttggaaaaatccttaaatgggggcctactcaaatggcacaggctatgggttcttcacccttcaggaaatctcaatcctattccatttccttcccatggaccttgaacaagttcttcagcatctgcatttctgggattgctggggagcatacataaagtaacattgtcaggaacaaaacaggtagccagtaagtggtgaagatggctgttttaatcattattccagataaataatgaaacccagttcttccaggaaaagggtagatgctgtatgtttaaaacttatttcccttagccctttcccagattcttttagttgccctgtacacatgatctgatgcaacattttcttataataaaggaaaccataagatcatcatagtgttccagtttctattgctgtataaaaaacacctagtggcataaaacagccatttgatcctgcttacagatcctgtgagtcaggaatttggacagggcacagtgggcacagattgtctctgctccacactattcacagccttagatgggaagactagagggttagatcaatggtccagatcatctgaaggcttgtttactaaatccgaaagcttgttactcagctgggctgggatgactcaaggaccggaagtgttcaccacagcctccccacctgggctgtcctcaagtgcctgggcttcctcacagtatggtggcctcagagtagccagactgctcacgcagtggctctgggctccaagtgcaagtgttgttactagcaagctggaagctgcgttgccttttatgacccaccctcaaaagtcccacagcatcacttctcccactctctctgttggagcagtcacagcaaccaccgagattcaaggggtggggaatagagaatccatctctcaaggcagagagtgtcagggtcatattgcgggacggtgtgtgggatagggacactgtcgtggccatctttagaaagtaaatctgccaccagtgaggtggggcatgaggtaaataggataaagcccagagtattcacaggctaagcactttgatcatcacagataaataactcgagtctaatatgcacaagagctagaacatattggacttggtttcagccagaaccagattcttcaaggacagtgcatgatttcctacatgcggcatcgtttatttatgagccaccgactctctctaaataaagtcagaggaggagccaaaaggggtttttagataatgagagttttaataagagtgcaacttaaatagattctttggctggtgctatgacagtatgtgaacaggacccctgactttaattaaccattttgccaggtgggcctcctttttaattagtacagaagatctaaacagattttttttccattttattatccaagaaagaaaaatgtaggatggctccatggcaatcttttggggttggaattaatttgattaagtgaaatcgttgccaaaatggtcaggcagtcacctaaatatagccaattgatcaagaatggagcccattgaacaatatttcgccagagaaattgaattactattcatacactagatatagcacagacaaatcttatcagacttttatagtgctcactaattggaatatttaagtcggaagatactgtagtaattcatgagctctttgagaggtaacctgacaaaaggaagaaaggggaccccaagtcgtctacataataaactaatttacagattccagtccacatgctttgttggcgtatataccatggaagaaagaaatttgtcacaacaaattctgccttggataccatcaaatttaaaattgtgtgttcatcatgagagctgggaacttgatttcttgaacaccaagtctgatgaatcctgtgtcttccatttggcatgaattccagaaccattttccaacctttgtcaaaatcataaaggacctcaaaaggataattatattcagggaaaaaaagaagaagaaaaaccacatcagaatcagtgactccatcaaaatcttaaatttaatatccaaatttttaaacaatttgctcgtatacttaaaataggggaagacaccagatataccctaccaaaccggaaggttgcaaaataatcgtcctgaccccagaaccctgcaccatgtgggcagggctgggaggtgccctacggcatcacttagtggagcagctttctatgagcaattgcagcaagagttctgggcttcactgggttatcctgttctgtcagcgactgtgaataggagtggcctgcactacaagggtaatttgtgtctgagaaacccctgtttgagtgaattgtatttaacatgaatacaacatattttgatgcactctcagttcccagatggacccctccagtgatgctaatgtggtgccaaatctccttcaaatggacactgctccttccaaagttaagatcagccatcagtgcaacctcctcatcgctttctctagtgtagctgcttctggactctaagccctcatttctgtaaggccctgtatgccaggattatgcggacaaaacttacagaggaggccaaaatatgataatgcagtctttacgtttaaaaataataccaaaaggtcgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggctggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaataataataataataataataataataataataataataccaaaaaatgcaacaagtccataacaaaaaaaatcactaaaagtgatgctgatgacagactctcaaggaacaggatgacatttaaggccacaaaacgctcagactctcactgctctcagcctgcagcctgcagggctcctcaaggacttgacaagtcaccaccaactaagtgactgtgaccctcgtcttgaggtgcacagcctcggccacgtacatggaatccaagtcagccctcctaaacacaaagaagtccttgtaagctgaaggtgggggatttagtgagactcttggcaaagtcaagatttgttaaccacatgggtggatctcaaggtgtgcccccttgacacctgggctccctttcttaatcacttccaacaatgaaacctaaaaggaggaggaggcctggggaagcctggcagataaaactgtgccagagtctgtggtgcgtcctctcccagacagcagccttactgccgtggtgcaggagccacccctcctcagaactcgcctgcagttttccagctttttcaccaatcatcccttactgtgacggggacatgtacccctgggttcagaagccaaacctaaagctgctgtttccaaactcaaatggtctttcaagtcttgtgtttaatttagaaatacacatggcggtcacattcttcactgtgtatatatctacatatattttaattctgaaatactgctgaatatcctgggccatcaggtaaagttgacaccaggggttattctgtgaggtcatgcgcccccacccccaccccatgcaatggtgtgagtcattgctcagaccacgaagtcaggacttgaggaaacacacgggaatgagcaaagcccatgtggcatccaggcctagagagatgcctgtggcaggagctgagggcaagggatgagcagaggagaccaggcccctgcagccagaggctcagtcctggctttttccaaactcttctccagaggagcccgcccttgcacaccaacgcctgcatgcttccctccttccttccttccttccctcctttccttccttctttcttttcttcctccctcccttccttcccttccttcccttccttccctccttttcttccttctttccttccttccttccctccctccttcccttccttccttccttcctccctccctccctccttccctccttcattccttccttccctcctttccttccttcacctccttcccttctctcctcccttcatcccttccttcctttcttccttccctccctcttccttcctttcttcacccctcccccttccctcatcccttccctccttcccttccttccttccttccctccttccttcccttccttccttccttgcttccttccttctttcctttcttcatccctccttccctccctccctccttcctgccttccttctttctttcttttctttcttcctccctccctccttccttccctccttcctgccttccttccttcctttctttttcctccctccctccttccttctttactcccttccttccttccttcctcccctcactcaatttgttcatcaaaaaatctagttccttgccatgccacagcctgagtatttaaaaataacttttcctcattttagaagtaatgatcattttttaaaaattagaagctgcagatagtcaaataactgtaaggataaacaataaaaatgacccagtctcccaaccacagaaagtgaccgttaacattttgtgaaaatgttgatacaaaacaaatgaaatgatactgtgcatttttgtaaactacttctaaagcataaaatgtactgtgaatatatctccctgttatgaaatatattttaacactaatttttttgaatacattgtcccccattgtcggtgggccattgttttttggataacatcttaataagtttggattttttaagcactttgttatggtggtagatttcccgtctatccatccatttctataaacaaaggaccatttcctctcccttgaagcaccatcccccaaccccacttgctcctccctcacccccaaatgcccaatctctcacacacgcacctgggggtggcccaggactcacctgtcatgcctcctgtatatctcaccttgtaactttacagttggctgagtccccccagagggctttgccatgtgataccccaacacccaccagttgcctgtattgatgtaaaagttaaaccgtgtgtccttttgtttagacaaaatccccaggtgatgtccaggactaagtaaatgtttgggatccaggcagttcaaattgccttggatttctaaatgccacattcaagctcagaagagaagcttaaatctatatgcactcaaagaacatttattgagcgttgctgtgtactaaggtcagagtctaaggccaaagtgaaggttcagtcaccccccacaaaactcatgtttgtctacagaagcttcccactgcctgagccagtggggagccatccacggctgaaatagaagaagtcactgtggcatggaattggagcagcatctacccttgtcacttgggctgatgtggcaattggaggtggtttctacagggcagaaagtcacaaatccacacttttaacaatttgtaaaccagaaaaccacctgcagaatgtgtatgtgcatctcccatagccttgaaccttcttcctgggaacagaccttttcaaatgactgaccttgcccaatccccgccatcaggcctggccttttacttctttcttttgttcaagtaatcttgaaaataactgaaattatttctgatcagttttgactaggaggtttttctcaaaacgatgctgtgaaagcaaagaaatttaacagtgttaaaacacctcagaggagagaataaacccagttccacttattagctgggtgtgcagtattaataaagggttggttgtaacctagcaactagtttagaaacacagaacaaggcaatcacagttttaaatatccttgtagtccctgagtccaagtatgtggtttctgacacactgtcaccttctgccgagtttagtcaatatctattactgttatttgcaaagagggataagatataacctgtctgttatatttgaaaaataaattgctatgataaagttcccaaaatccaggaatgtttctaatgttgtttttcttgtccacatccctcctccagggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctataggtgagttggacattgcatttgactacagggaaatacaaatatatatataatgtctgtgaatgagggacatgtgttgtgatgcacccgagagcaaaacgggaatcccagagagaggctgtgtggcagagatttcgttctaatgaagaacacctgacgctaatgtgggctggggagcagagagtcacaggatgtgtccacacctggcccccatggccacaccagggcctggaccccaggtgcaaccaagcctaccatggacgggcttggaggagatgatattcaagtccctttccacacggggctgctaagagcagtggtcagaaatgtaggaggtcaatttgggaacagcatgaggaagggtctgatcctgatgggactccgcgatcatgggacggggtgtttgtgaccccagccttcctcctcatggcatgtgttcaggcaggcccagggtggtcatttgtccagcgttttggtaagggaattcccacactgacaggtcggttagacttgaaacctttgtcttttcaaactcttaagacacacttcatcctatccattaggaaggcatagaatttccaagtggaaagttacttctgaatgtagcttgctgcttagcaaagttaggagactttccctattcacaaagcaaggtgatgcagacccagcaccagagacagatgtggaatgaaaaccatgcagttccagtgttctcgacacccacagaagcaactgccaggattgccatcaatctctcttgcctcttaaaaattttttaaattgtagaatgcatcatacaaacaaaaaagtatgtgaaatatgtatggacacttaaaagtactggaaatctatgggcccactgcctatgttaagaaataattccttaacttagcagtcaggaagtccctctctgatcacagccctccctcatcttcgtggaggtagccactgtcctgaagtttgagtttgtcattctgttgcctataaagcaaggatcagtgaacttcttctataaggggcagatatagcctcagttgcaagtactcatcccagcccttgcagtgagaaagaagccgtagatgatgtgtaaacaaaaagacacagctatatcccaagaaagcctcattcaccaaaatgggcattgggctggatttgcccccagtcatagtttgtcagtccttgttttaaagatgtgtacttagacacatgtgatttcctaaataatatattaatttgccttgcctacttctgactcaggtttatggcttaccaaagaaagcgagcattctgtttagcacggtgtttgtgagaaccatccaggatgatgtctgtagctgtggttcgtttgttctccctgctgtgtggtattccatcatataatggtcatgattcagtcatggcttttcctgttgactgtatttacactggttccagttcagggccattacaatcggacgttgtgaacactgtggacgtacttcatgtgcagaatctctctaagatatcctagccctagaaccgctgggtcacggaacatgcacgtcttcaactttactagttgatgcccaaatgtttcccaagtatggtcacgtgccacataaacacgttccagtcaacaatgggtcacacatataatcggagtcccataagatattaatgaagctgaaaaatttccatctccaagggccacattcctgtcacctagcacaacacatgactcacgtgtttgtggtgatgctgggtcaacaaacctactgtgctgcccagttggtataaaagcatagcacacagttatgtccagtgcagaacacttgctgatgataataaatgaccatgttactgtcttatgtatttactatactatacattttatcattattttcgagtgtatgccttctacttatgaaaaaaaagttaactctaaaacagtctcagataggtcctttgggggtattcagaaggcattattatcacaggagatggcagctccacgtgtgttattgcctctgaagcccttccagtgggacaagatgcagaggtggaagacagtgatattgatgatcctgaccctgcaggcctaggctaatgtgtgtgtttgtgcctcggtttgtaacagaaagtttaaacagtaaaaagtaaaataaaataatttgtaaataaggacatagatgaatatttgtgtatagctatacaatgtgcttatggggttcttttgttttttttgtttttttttttttttgagatggagtctcactctgttgcccaggctggagtatagtggcatgagctcggctcactgaagcctctgcctccctgggttcaagcaattctcctaccttagcctcccaagtaggtgggattacaggcacgtgctaccacacccagcttatttttgcatttttagtagagacggggtttcaccatgttggccaggctggtctcgaattaccaacctcaggtgatccacccgcctccgcctcccaaaatgctgggattacaggcatgagccaccgtgcctggccttgtgcttgtgttttaagctaaatgttattattacaaaagagtcaaaaagttgaaacaaaataagattataaagtaaaaagagtaagcacaggttaacttattattaaagaataataaagattgagaaacatgtttttataaatttagtgtagactaagtatactgtttataatatcttcggtattgtatgataatgtccgaggccttcgcacccactcaccactagctcactaactgccctagagcaacttccagtcctgtaagctccattcacggtaagtaccctatacaggtataccctttttaaatcttttatgccatatttttactgtaccttttctatgtttagatacaccaacacttagtatggagttacaattgcctacagtattcagtatagaaacctgtacaagtttgtaacctaggagcaacaggggcatataggccaggtgtgtagtagtagactagactatctaggtttgtgtaagtgcactctaggatggttgccaacaacgtgtttctcaggacctattcccatcgttaagtgacacatgactgtcgttatttatttaaatttcccccagcagtgaatgagagagctcctcttgctccacagacctgccaagccttggtactgttagacttttaaatttggccagtctagtggcatacaaaggtatcctcctagggctttaatgtgcttttccccacttaatgatgccttttcatttgttcatgggccatttgtggcagtttctgtgaaatgccaattcatgatatttgtccacggagcagggctgtcttctcattactaattcacagaagttatttataaacaaactggacacaaacttgtgttggttatatatttttaaccaactttgaggcttatctttttactttctttatgatgtcaacaatattcttaatttaatagaatgtttgtcttcttcaagagggtcttgggtatttttgtcctttcattcttctaatagttttataatcaacttgtcaagatccatgaaaaccccattggatttgataggaaatgcattaaatcttagatcaattaggcaagaattgacatatttgatattgagtccaatatcataacatagtatagctctcaatttaggtattctttaatgtctttcaataaaggtttatcattttatccatgaatggcttgcacaacttttgtttgatatgatccaagatgctttatattattttttctgttttaaatgtcattttttatgaattgatgcttgtgtatacagatgaactaattttagtatggttctgtattctgaaagttttgaataatttacctgtagatttttagattttccgagtagaaaaattatatcatctgcaaatagtgacagctttgtttcttcttttccaacttttatactgtttatttccttttcttgccttactgcactggctaagatttgtaataaaaagattggctgggtgaggtggctcacccatgtaatcccagcactttgggaggccgaggcgggcagatcacctaaaattgggagttcaggaccagcctggccaacatggggaaaacgcatctctactaaaaatacgaaaattaactgggtgtggtggctcacacttgtaatcctggctctttgaaaggctgaggcacgagaatcacttgaacctgagaggcggaggttgcagtgagctgagatggctccactgcactccagcctgggcgacagagtgagactgtgtctcaaaaataaaaataaaaagttaagtaggggtagtgaggggtagtgcccttgccccattcttaatttgaaagggaaagtgttcaaaattaagtgtgtaatagttgccatatgtatatttttatagatgtcctttatcagattaagaaagttccttttgattactggttttctaagcattcttaccatgaatggatttttatttttatttttcggaaagagtacttagtccctgaaaccttttatgtgtaaggatgtcttcctaatgctttcaaatataaactacgttttggtaagtgtcaaaatttaaaatcatgagctttccctcctcaaatctttgtaggcttggctccaatacttattttaaataatgaaaactgcaagtatttaaaaaatgaattcatttgctccttcacttatatataggattttcttggtcaaccttacccaaaatatttgagttaagggagaattagctgtttgttacagaaagattttggttggtggggaatgatatgctaagactttccggaaaaaaaatgttttcacatttgaccatattcagggccctacctggtttgtttctccctaaatagaaggtgattctgaaacagactcggtgagtttgagactactacagggagtgccgctgttaactgatgagagtaataatttcaaaagttaatttgatttgtgatgagtgtttgggatggcaagacggggtgacactggctatcaggaggtgccgatggacatctgtcagaaaggagcagggacaggaagatggccgccagtcatttctaagtgaggtcctgagagcaccgctgtgccttgtcagttactccaggcgtgtgttagtgggtacatgcagctgcgaccacattcttttcaagtgccacgaaatgctgccaggtcctagtgctaatttttgcgccagcactcctgccctgtctgttgtcagactggctggcgaggctctttccaagcagggtgaatggttgagctgattttggccgcgatatgattaccgattgatttcctgaccttggcagcatcagcaacgtccctcgttcagaccaggcacgtttcatttgcgcacttccatccaccacgtctggggcacctacctcagtgcccgctgctgccgggagggctgacagttaaccagctgcattgttgttctgcaagtcaggcatgacttcagtatcagttcctctccgcattcagagaaatcctttggatccttcctctccacttccccctatctattctcactccatcgagggccaaaacagcgcaggcactagctgtgccaatgggaacggtggcagccctgcgggtcagatgttgctgtggtagccgaggcctcccaggcagaccctggctgcctgcaaggggctcacttggaaccatatggggacacgaggtggcggccgagctgtcagccgccatgatgcacaggcagacagctgtcacgggaccacagtaagcgaagtgtctgcggcccaggctggcttggattccacctatattttattctctgtttttacctctgagtaccagtacaaaccattggcactgaagagagagacagaactaatccaccatcggtgactgtgtgtgtgtgtgtgtgtgtgtgtgtgtgtgagagagagagagagagagagagagaatttgatcaatggattgatttactactttggaaaaagaatagagccaattttatatcgtttgttgctttctgaaccaaccagcatttaaagtcacacaaatatgttactaaaaatcttcctttccccaatcttccccttaaaagcatttgtgcccccacaggcctcgctcatgcacacctcactcacacgtgtgcacacactcatgcacactcacacggcactcacaatgtacactcactcacacgcccagtcacacgctcacacacacctgcacccgcctctccaaaacctcacagtgcccccgcctgccaactcccttggcagtatttagaatggcagcaccttctgccctgctgaaaatgctcctcccttcaggacaccgggcgcgaaaggaccttcagtgagggtgtggagaagtggggaaatgggagctgtgggtggagaggagaggggaggctgaggcggcttcttgagatgccgcctgtcaggtacccgaacacccctgtcccgtgtcttctcggctttcctgactccactccatcgtctttcacccccacttatcgatgaccctgcaaaagagaggtctcgcctacagaatctctcccttcttcaccttaattagcagtctgtgcatcctttatcctcgtggtgtaaataggtcttgccctagcttctttgtatgagcccatcagatactcataaaccttgattaaacctcttttcacatcttaacatgctcagctctcaaagactgccctcagacagcccggccctcgcgcccgcgccaccaccgcctccacacttccccgcacacgccggtggcctacatttactggctgagtgttgctgtgcacagtgttctaaatgggatttgagcagccctttacaaggctgccattaccattttgaactgtgaggctccagaagttcttccctcaggaaagccaccttgtgttatctgtctttggaactgcaaagcaggatgctgccagcccacgtggccccctaatttattgatttgactcccgttggaataatttaatcatgactttaaaatgtttttctgcgcctctgtagtcagcagccttttgctgtgttcagtggtaaattgcatactacattccaggtgcctgtttttccggatttatcaaaatcttcttgaatgatgactgcccactccagcttctcaattttttggtccatacctaaaaggtggtggatggtaattctcccaatatccgcctcatccctcacacgcttccctgcggccgtgtgccaggccactgacctgctctctgtagactctgtaagggttcctgctcctctgtttcacttcagatcgtgccagtcctgtgcgaccagcctcgcaaagaatcctttcccaaatgatttgctaaaaatcaaaatccattctcttccttttgcttcccactcattcaattacaggctatttatctgccctcataaaaggcaatcgaggtcagtttgctcacgtactctggggattcctcattgaccatgccttggccttcttactccaacaggcagatccttacctagagatgtttctgctactattccagaggccacgaggccaaactcaaatttttgaaccttacttgttcccaagatggtcaactttagatctggaagtgtagaccaaggaggaggcgaaagtccactggacacaatatgtgtctgttcttattggcgatcctattctgatgaaaactaggggtcttttttagcatatgtcacctcccacctctttccactatggcatttgtgtggaagtaacctttcctggggtaaaaggtgagaccatgtttgaactgccctgaaattacagccagcacatgtctgttttcagatattcatgccaaagatgatagtgtggaagaaaaacagactcacccatttgcatagtccaaaatgaatgttcagagaaatgaacacatggagttctgcaagaagtatgaactttgaaacatttacctcatttaccatgaaaatatcacttggcatatcatgttagttaggacttactagaaaggctcggattgagattttttatggttttgaggtatcaggaatgtataaattctgatttcaagtgcctcagtctcactagtgttagtaagaatctttgcctgaaggatagtgcccgtcaatgaatgaaagaaacatgagtatccccctctaacaggcaagattttgttttatgtttaaggcttttattaatgagaatgtaagaaatgagggaggaaattgagccccagttaacatcaatctgaagttggggtgagggtgggagcccatgtctattaacaggtaactctccaccaggattccccccacccactgagtcaacgtgcactcccacagtccttacgttgccctttccaggcaggcagaggaaggcgctggcattctccctggctatacaagaaaactagtgctttcattatttgaaaggaaatgtgtatatttaaatcacatattaatactaaggggagacaatttcagcacagggatggccctgcatcccagaagaccgtgctgaaatgtgaaccgtacatgaaacaaatcatatagtgtgagacacaatttgcacacgtctgttgactcatatctgcaatattacgaataaaaactgaactcttcaccaagctttacaaaaacaaagaaataccttatggtgagcccaccactgccacctctcagttatccatagcccccgcccttgtcttcttagctgccaccccgaccaccctctttgtcctgtgcccctgtgcacacttggtatatatcctaagagaatttagtttgaaactcctacagtctgtaaaagcaaatcatcacttccctttccttaacatggaaaggacactagactaagaccaacagaggggtcaaattcctgcgttcttgcttatcagctttgtgaacttgaagaagccatttaatctcattgagcatcagtttcctcacccataaaatggagatgtaatccatgataaatcttcccacatcatgggatagaagtatatgttgatggacagtaaagtacaagtgcaaaaagttttttaaaagtatgtaaagtactatacaagggcagagctttgtaatgactttagctcgtgtgttcctgttcgctacacatcaatattatcctttatggagagacagaaacacttccagccttctatacagtattccctccccctcccaaattaatacaaatttaagaaaatgcagtgcttcttttaataatttaaatgagcagatgttttaaaattgcattcgtgtatgtgcttgctatatcttatttttaaaattgtatgggattacatatgatattgaatatgcttgttttcagagtcatgctctaagaaaaaaatttatttagagagaggtcattatcaataattaaataagtgagaaatctggtgctttacttagaataaatgtactaagatgagagtcgataatgtacctcccagggcactttatagaaaagggatggatcagatgcttccatataagtttcacttaaaaatgatttcatttccaaccactgggcacccaaagcagccaaatacattcttaatatcatttaaaatgtaaaattatgagctgtttgagttgtaaagtgtgtctagaatctaatgtcatatagttttaaaagttgctttggaacattgtttcatgcattgtcgataatcactaatactctagacctgcactgtccactatgagagtcaactgccccacgtgacaagtggcgaccatatcagacagcggagaatagagcatttccattgttgtggaaagctgtgttggacagtgctgctgtaggccagttgcatccatggaatttggagtgggcgtgttggatgtagcatctatgaacagtcgttccctaaaatgctaattgccagccccatttggatccgacattctgacctgccgatgtagctatcagatgcgtgctcagtgaaggcccagtggagacagaggaagtgatttctctctgtgcctgttttggtggggtcaattagaaaacattctctccagatcatgtgccaaaggtgtacagatggggaagggggctggtgtgggggaagggggctggtgtgggggaaggggcggagcaggtaagctttctggggcacttggtcactctgcaggccttgcaagggacactcggccttgctgggtgagataaaaattctgtcttgccctatgcttatacttgtttcaagctcagctggccaaccccaggcagcctggcacttccctgccagagttatgaagacaaccttgattactaacatactgtcttgttgtcagagcccaagtcttgatttggggtttaggaatgctgactggtaggttcagaactgacttccatccctctgcacatcttcgtaaaatcgctgttcttttcaaacttgtacagcaggagttaaagtcctttatagattttcttcctccatttcattacatacccatctggcagcatgtggttgaaggttattacttatgagtttaaaataatagctgatgagccgtggttatctttaaggctactaagctgctttaatataaatacctctttgccgaactccaagaaacaacggagttgttttactgttgttggaactgtgaaaataaatgcatttcagaaatcatgttctcattctactgagccacgagaaggaactggcctgcctgcctaaattttttatggcaaactaacaattgcaaagagacgctttgaagccacctgggcagtagggattcacaggtgcagcattctccttctttccctcctacacctgagtctttataggtttctttttgagggttatttaagcatatttgtttaatttttaaaaatttccactccaaaagcaatatgtgtttattacagaaaatgcagaaaaatatttcaaaagccgagtagaatataaaatctatacctaatcccaccacccagaacctattttagatgattgcactatgaaatgaaaagaattgaaggggaactgcgatttcctcctagaaataagacctgcagcaagcttgcagacagcacagctctccttcctgggtgccaggcagaccctaactgcagccccgcacacctgtctcgtacaggtgaggcaagggagaaccagagtggccgggctttccacgtgccacaaccaagacagtggcaccaataggaccagaaccagagtttcctgactttctgtcaagtttccttcatacaggacaaataggagtaggtttgccatcatgcaatgaccattctttagtaaaagcagttgttgtgtttgactcatcatttacctattataagaagattggccaaaaaaaaaattatgtttgggacaggagaataattttgctctctgataaaatacctcagaagatgcccaggataattcatgtgtggaggaagaaaatattagaacttctgtttataattttatctttaaaaaaaaaacagaaatcatgttttattagtattcaaagcacacgcatgggtgccctcttgggtcagatggaagacagctgtgcattctacatggcctcaacacaccataatgggacagtgtcacagcttggaggggtcaaccttattaattaactttgtttttgtttttgttttttgagatggagtctcgctctgtcacccaggctggagcacaatgacacaatctcagctcactgcaacctccacctccctggttcaagtgattctcctgcctcagtctcctgagtagctgggtagcaggcatgtgctaccacaccctgctaatttttgtatttttagtagagacggggtttcaccatgttgcccagactggtctcaaactcctgatctcagatgatccacctgcctcagcctcccagagtgctgggactaccaccacacccagcccttattagttaactttggaacctactgcagcttttgtgtatctggttctggttttaactaaactaaccctccacaaaattgacatgagcatttaacggattgttcaaaagaaactacagaatgcaaagcctggcaaagcagacacacatgaaccaggaaagggcagggccagatcatctcctcttcctcagccacactgtaagtaccatggttcgtctctcagctaaggttccactgcagacagcagaatcctctctagctggtttaaacagaaagcaatatactgccagttatgggtgctttatacaattccttcaatgggctggaggagcaggctttagactgccttccacgaaaaattcagaaaatggctccgcagacctagccaatctctgccacagtgaggaatttgtggaactgagaaactgccacaaaagttgccagctccatgaccaatcctctctggcaaaatccacaccagcaaaatgggtacactaagccctgatttctgcccccttctgctacagctgacaccaaatactgccacagccaggcttgccagcaaaagcaagaaatgcagtggaagcacctcctcagggtgttccatggagtgagggagagtccctcctcagggtgttttatagagtggaggcagaatctccacctcatggtgttcatgtccatcgtccacgtcctgcacagggctgtctctttggatgaaactcagtcccatgtagaacctacactggacatgagtctggaaattgtagtctttcccttcccggcctgtgatattttggctaaatcatgctacacagtatcttgagtgtggctggctgaaacagtctacagtatctctcatagctaactaatcaaccttgaccagaagtcagcccccacaaaatgcaaaactatcaagaagactctggagtttgtatttatatctactaccagtgaggatgatggttctaataatatacaggtccacaaaacccttatccaaaatcctaggagcagatgttgtggaattctataacttttttcaaattttgggaggaaccagacttaccctcccacatgaaacaactaaatagctgccaaaatgtaagaaacaaatttttaaaaaagatattagacatcaggcaatgaaggactgtgatctttgagagatgggaaacaaagaaggtgaaccctgtggttgatccagctgacggccttgagagagttcccaggccacagcaaggggaagcagagcccatgcagagtcctgagtggaggagagggagccgagagtccggggagaccaaggcaggtggagttgtcaggacagagggagagggagctgagggtccggggagaccaaggcaggtggagttgtcaggacagagtactggagaggagaaggttgcacagagagagaagcttggagatgtgcagaagcctcccctgggagcattcagttgagtactggtcagtccatgtgggcaaggaaactgcccaagacaggggaaagaaccactctaaaggattagaaaaagcatgacagtgtctaatactcacacaaggctgggaacgctgcctgttcccaccagccagacttgagaactttaagattaatgaggcaataggtagggtacacaaaagggactcatctcagtagcagggaataattagtcctaaaccaaacattgctgcagtccgacttaataaatcttgaaagcaagacatgaatgtatcaaatgctttccaagtaacttatctacatctgaaaacaagtttaagagtgtttataggaatactgaaaatttccacacctaacaaaatgatacaatttctgatacctaatcaaaaaattactgagaaggcaaagaaacaagaaaatacaacccataatgaggagaaaaatcaatcaacaaaaccaacccagaactgactcagatgttagaattagcagacaagtatgttgaaacagctattataactgttactataactgcattccatgtgattaaaaagttaagatgtggaaaacacataaaagacccaaatcaaacttttagagatgaaaactacaatgtctgagacaagaactaccctggatgggcttagttgcagattagacctcgctgggaaaagggtaagtgaacttgaagacataacaattgaaactgcccaaaataaaacacacagaggaaaaagaatataaaaccatgaacagggtatcagtgaggaatgggacaacttcaagtggcctaaagaaataacgaccaaaatttttccaaatttgatgaaaactcacaaatctgagaagctcagtgaatctcaagcataaaaaaaaatgaagaaaactatgccaaggcatatcataatcaaactactcaaaacccacaataaagagaaagtcttaaaagcaacaaaagacacgggcacattctttacagacgaataagatgaaaatgacaacagatttctcatcagaagcaatgcaagccagaaaacagtggagcaacattgttaaagtaccattattttttcaaattttagaatgcattgattatatattatgtaacagctccggactaataaacatggcatacccccccatattacatacaccatcctacccatgccaaccaacatttcttgagttattctgtatctcattatttaactatttaatttctctattgccttactgtcttccaactgatagccttgcgtatagccccaatgctgtggactgaattatgtcctctcaccaaatgtatatgttgaagctctaaccccctatgtgactgtatctggacatacagtctttagaaggtaattaagatttaatgagatcataaggatgggactcttaggagagaaagagacagatgtcactctctctctgtctctgattctctctctatctctctctctgtcatgtgaggacacagcaggaaggtggccatctacaaactagaaagagagccctcaccagaacctaactatgttatcaccttgatcttggactttcagcctccagaagagtgagaaatacatttctgttgtttaagccacccaatctatagcattttgttatgtcagcctgagcaggctaagagatttacaccccaagtttgttgcttctttatatccccgcaattcagtaggctgcggtgtaggcaaacagagggtgttttgctctttccaatggcagatggtcattctgtccaaggcccatggtacccactggacacgtctgtgtagcagtgatgggaatggcatccatgtcagaacctggatccagtcccgggttctaacattataccagccttaagttcattctctaggcataaaggtagtgtcctcattctcaccaaaccgagtaacatgagtgaaaatgagagagcacctcgtgggtgtcttagtctgttttgtgttgctgtagtagaatacctgagactggggaatttgtaaagacgaggtttattgagctcacagttctgcaagctggggagttcaacagtggcatgaccctggcttctggtgagagcttctctgctacgtcataacatggtggggaaggtcaaaggggaaatggagacctgcaaagacagtgccaaggggcactctggctttaaaacaaactgatcctgagggaatgaatccactcccgtgagaaccaattcagtttctccagagcaagtactcactcactaccatgagaatggcaccagctattcatgaggcatctgcccccactacccaaatacttcccactgggccccacctcccaacactgccacattagggatcaaatttcaacatgagagcgagtgcagtggctcgtgcctataattccagcactttgggagactcagcagggaggatcacttgagcccaggcattcaagaggagcctgggcaacatagtgagaccccatctctacaaaaaaaaaaaaaaaaaaaattagcagggtgtcttggtgcatgcatgtactcctagctactttagtggctgaggtgagaggatcactcaaacctgggaggcagaggctgcattgagccaagattgcaccactgcactccccagcctgggtgacagagtgagaccccatctcaaaaaaaaaaaaaaaaaatcaacatgagttttgttggggaaaaagaaaccataaaccatagcagtgggggtccttcaaaccttgctgagtgatgctttcttatacaagccttggtttttgtttttttttattattattatttattttttttattattattatactttaagttttagggtacatgtgcacaatgtgcaggttagttacatatgtatacatgtgccatgctggtgggctgcacccactaactcgtcatctagcattaggtatatctcccaatgctatccctcccccacccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcgttttttatggctgcatagtattccatggtgtatatgtgccacattttcttaatccagtctatcattgttggacatttgggttggttccaagtctttgctattgtgaataatgctgcaataaacatatgtgtgcatgtgtccttatagcagcatgatttatagtcctttgggtatatacccagtaatgggatggctgggtcaaatggtatttctagttctagatccctgaggaatcaccacactgacttccacaaggattgaactagtttacagtcccaccaacagtgtaaaagtgttcctatttctccacatcctctccagcacctgttatttcctgactttttaatgactgccattctaactggtgtgagatggtatctcattgtggttttgatttgcatttctctgatggccagtgatggtgagcattttttcatgtgttttttggctgcataaatgtcttcttttgagaagtgtctgttcatatccttcgcccactttttgatggggttgtttgtttttttcttgtaaatttgtttgagttcattgtagatgctggatattagccctttgtcagatgagtaggttgcgaaaattttctcgcattgtgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatgtttgtataaggtgtaaggaagggatccagtttcagctttctacatatggctagccagttttcccagcaccatttattaaatagggaatcctttccccattgcttgtttttctcaggtttgtgaaagatcagatagttgtagatacatggcgttatttctgagggctctgttctgttccattgatctggatctctgttttggtaccagtaccatgctgttttggttactgtagccttgtagtatagtttgaagtcaggtagtgtgattcctccagctttgttcttttggctcaggattgacttggcgatgcgggctctttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcatttatttccttgagcagtggtttgtagttctccttgaagaggtctttcacatcccttgtaagttggattcctaggtattttattctctttgaagcaattgtgaatgggagttcactcatgatttggctctctgtttgtctgttgttggtatataagaatgcttgtgatttttgtacattgattttgtatcctgagactttgctgaagttgcttatcagcttaaggagattttgggctgagacaatggggttttctagatatacagtcatgtcatctgcaaacagggacaatttgacttcctcttttcctaattgaataccctttatttccttcccctgcctaattgccctggccagaacttccaacactatgttgaataggagtggtgagagagggcatccctgtcttgtgccagttttcaaagggaatgcttccagttttttcccattcagtatgatattggctatgggtttgtcatagatagctcttattattttgaaatacgtcccatcaatacctaatttattgagagtttttagcatgaagggttgcctgtaatcccagctactcgggaggctgaggcatgataatcgcttgaacccaggaggcagagtttgcagtgagccaagatcgtgccactgcactccagcctggatgacagagtgagactctgtctgaaaaaaaccaaggcagacagagtctcactctgtcatccaggctggagtgcagtggcacgatcttggctcactgcaacctctgcctcctgggttcaagcgattatcatgcctcagcttcccgagtagctgggattacaggcttgagccagcatgcccggctaatttttgtatttttagtagagatggggtttcactatgttggtcggactagtcttgaactcctgacctcaagtgatctgcctgcctcctcccaaagtgctgggattacaggcatgagccactgtgcctggcctcttatgcaagtctcttgattcctctaagccttgtttcccttatctgtaaaaggggccttataattattccctggggtgtctttgaaaactaaaggaggtgctgtacaggaagctttcagatctgaatcacccctggagggactgttccacagtccctgggctgcacagctcctctctctgccctgggattgcactgctgcaggccccaaacgtcttcaacctggcactgtgcgtgctgctcagcggtgtccccagcacacacccagacagctgtgcacagtgacagatggcagagccccagcatggcctcagccattttcacttctcttttaaagatactttttgtcaccttcttcgcaaaccttaagttgtgttttgtgacttattgttcactctatctagtaatttggggagaagagggcaccaaatgccaccaacgatgcccctgcagctgctaataggtgccactctttggatcccacggtaccctcttggccccagcggctctgacagctgctggggcactgtctgccaggccaggatacgtgctgaaggctctgagggcagaatagaacccagcgcagtcacgctgggatcccagagtttcacggcattaataatctatagttcaatcattaggagcaaatccaagtgaaataggaaagtgtacaccacgctggaggccgtgaggctgctgggagaaaggcttctctgctccttggcaggcttaatgattagttcccagccactagcagccccagctgacaaacggcgcctgcaagctgtaggctttctgcatgtgataattgacaaatgctggaagtcattcaggatattcacatggactggctaccagggatctgctgggcttttcaggcccccaactcaaaccctctcttgtaccaggaaggacgtcccttcttgggtcaatcgttgccctcaggacagatctgcaagtggatcttatgcagggtgcctccaaggctgctggagtcctggggaggatttgacacatgaacgaatgtgaccccactctctttttccaattatgtgttggattgaagtgccaacttaggcctgtattgcaacagctcaatctgcagcacactaagtaggaagagatctgaagcagagaagcatttttaatttcagagtttttaaaaaaatcattcatttcaagaggttattggataaagcatttttaaaaggttttatttatattcttcttggtcataagcattagtcaggaatcttgtctgcaagtgacagaagcccagctgaaaccagcggacactgggaggagactttcgtgtctcccacagctaaaccgaggagtgcagggctggcaccggaggcatgatttgaaacgccgttggccctttgtccctgcttccttctctgggattggcctcccctgatggtggaaatcatggggagtcccaggcttatgcatcttacagcttgctatttagaggatagagcaccctctcttgcctagtgccaccttgaaaagttcctggggaaggactccaaacagcctggctcccatgatgtgtctgcccacttagaccatcagcatggccatgtcccagccctgaggccagggggcaaggctgcttgggggtcaggagggatcctgggcagacaaaaagctttccttaaacatcagttacttactggatgtattcacagactttcagcctctctgggttccctgagtggttttggctcctccttccacttctggtattgcataaaatcctccaccacagttcataacatctggctcccaagaggccacatgatgcagggcagaaatgcagggtgtaattctctgtggataggaaggagccggagaagacaaaacccttgtctccgcctcccattggctgtcccaagaccctgattctctatacagcctgtcctaagttatccctcatggctgagtgagttctcctagcgtgaagcagtggcctgcccataatacatagttctgcattgctccccatcttccaggaataatgagaagctcctaaaagcttccagtgagtaaagcaggtcacttagaaaggaactagaatcaaactggtgtcagatttttgaatagcaacctcagaacctaagagataatgaggcaatgtcttcaaaagtctgaaaggaaataattccaaacaataattctattactgatatggtttggatttgtgtccccacccaaatctcatgttgaattgcaatccccattgttggaagaggggcctggtgggaggtgattgtttcatgggggcggattttccccttgctgttcttgtaatagtgagttctcatgagatgtggttgtttaaaagtgcgtagcacctccccttctctcttcctcctgctctggccatgtaagacatgcctgcttcccttcaaccatgactgaaagtttcctgaggcctccctagatatgcttcctgtatagcctgtgcaactgtgagccaattaaacctcttttctttgtaaattacccagtttctggtctttctttatagcagtgcaagaatggactaatacaattaccatccatcaagtaagaaccaatgggataggactattagtgctcataaatgaaggagaaatagtatgactagaatatcatcattttccagaaccccctagggaatcatggacatgggtatggagcatcagtggctgctgatatagaaaaggaggcagccagacctcatgcagtccttggtgggaaaacacaccacctgcgaaaaacaagccaaattgaacctgagtctgactaggactgttgatctaccaccaatatgtaggaaaccgagaggatagaggaacatgtaaaacatgtaaaacacagagctgaagtatattaaatacagagtgggaaactatgtgacaaacagcctgattccctcaacaaataaattgcaagaaataaaacttgcaatggaggggggcctatgaattagcatagtttttaaaaacatatcaccctatttggatcctgattcagataaactgttaaacaaaaatctgtgccatttatgaggtgattggaaatttgaaacctggagagttaatgatgataagcaattatgattaatttttttagcagtaaagatggtatttcagatatatagatatatatatattatatatatgtaatatatataatatatgtaatatatattatatatatgtaatatatataatatatgtaatatatgtaatatatattatatatgtaatataatatatgtaatatatattatatatgtaatatataatatatgtaatatataatatatgtaatatatattatatatgtaatatataatatatattatatatgtaatatatatatatttaaaaacagaaccattatcttttagagatacatactgaagtgtctggagacatgcttcaagataacccaggagggagaatggtagaaggaactagagatgacccaagactgcccttgagctaataactgttttaattgggtaatggatgatgggagctcattataggtatatttctaacttaaacataatttaaaattctcataataaggagttatttttgagaagcaaccaaagttgtaaactaagaaggagtaaggaaggggctgtggcactgaggggcaatgtagagaagtcccagctgccaagaggacagccaggtgggccaaagaggagaggagggaggggtcctggacacaattaattacttggattatttgaaatgtttacatggaaaataattttgaagggtgctttacagagctgctggaacagtttgaaaaaaattatactagatacattaaaaactaacaaaaatagggcagttattaattctaagaaaagttaaaagttatacaagaaaggcctgtgattaatattgcattgttaaaataatgtaatcacagaattcaaatttaaccaaaaaactgtgatacaaactatttgggaaattgggagagagagaagtgagggtttgtgttttaaaaagataaaacttcatttatcataacaaggtgtcaatagttatgcctaaagttaataaatgagagtgtctggtgattctcttcaaaataacctaggagggagaagagtaggaggagctagcaatgacacaacatgggccatgagtcgttaactgttgaaactgggtgataggtgatggtaacttatataagtaatcatatttatgtcaacaatcattcaaaaagtatctgataatctctgaattacttaacactctggttgcaagaaacagaaatcaaccaaagctatagatttaaggtaaaaaggagaatccattgtgaagtttcatggttgtatctaacaggacaaagggcagagataagactaggttttgggaaggaaccacagcaggacagacaaggtagggagagatcatgcagtggctgcttctttctcttgcagactggctttctctgcttcccccacagctcccatgtttacgttgcaagccccaaaacccatagaaattatccagatgtacgttggtcccaactccagtttccttggagagtgattgataggtatggcttggtgagacagtttcaaactatgactgcaaaccatttggccctcctcccagaaagagtgtaaggtgtatgtcccctgcccttgaacctgggcaagcttgtgattgcttgcttttaccaatagagtttggcagaagtgagaccatgtgacttctaggactggcttatagaaggccatgcagtgtccaacttgtttgctagaatattccctctgaatttcctggcctgacatataagaagtctaactatcctcagaccaccatgctgtgaggaagcccaagccacatggacaggccatacaggcactctagcaagtgtcccagctgagccaagccttcaagtcatcccaacccaggtgctagacatgtgagtgaagaagcttccagatggtttcagccacagtcatctgagtggcccccagtcactcattgttccatctgatacccctgtcatcatggagcagagccaagtgatcgtaagcataataaaatggctgttgctctatgctactgagttttggagtggttgttgcacattaatacataactgaaatgctcggatcaaatgacgttccctgtttcctgacatgaagtcccaacatgactgttgggggcctacccccacaaagagagagggatggcagggggttgagcggattccaacaaacctcaaggccttcactccatttctgagcctgatttcacagcagcctgttgcctatctgggtgcaggaaaggaggtatggactgagaactcttgacctcctgtatctaagcccccttctcaattcttgttctcccacatagtaagccagtgtaaaggaggaaagagggaagtggtatatatttgccgtggtaaatggtatcattaactcccttcccttccagtcccatggtggtcttccagcagaaacagttaccaagaaatgggaactaccctcagagttctggcatcttccttctgtggcctctcgagaacagaagagatcattagagggtcctcgtgttgcctagcaacctgtgaatgctgtttgctatcatgttattaatatggtaggaaagtgtttcatagaagacattcatcttgcattaatgaaaatcaaatttactaatatgacacaaaatctgttcttccttgtgactttctatacttaagtagcttatttattgaattagactgtgagtggtttccagggttgagactgttaaagttatcataataatgactttgttttcaataatgtcagatggcccttcatgatgagattatgcagctctgactttgtgatcactgttcttagacaaagcactgctgccctggggcctagccccatacctgtgagctactctgccactcgacttcaacttcttcccgccaaggctcagctaggcgaggattctagtttgagccagtatacctttaaagagggccccatggaataaacggatctcattcagcatgggcatgaaaggcactggagaagttattcagccttcgtcttcgatttttctaaaaaaggacaacaaacaaccctaaattttcaggccttcaaaagagagtaagaaatacagacagtcccctactttcaaacacaatttgttcctaaaagcaagtatggaattcaaatgcccagaaaccaaataatagacccatctcttaaaaaagagaattctcttcccaagagttaacatatgattgctgaaaatgttctttattatttttagcacgtgaaagtctcagttcagcagatagacagaagttgaagagtattgatggctaagatgtaaacagacaagttgtattaataacgaatggaatgcacagagccagtatccaaaagccaagggctgcacctagaggcacctagaaagaagccatgtaaaaacctaaactgcagagctaaatttctagaggtttttttaaataaagtcttgttttctatttataaaagtagtacatgatcattgcagagcccaacatgggggttgtggcgggggtatgaaataaagaattgcaaagaaaccaattgttaatttttttggtgtgtgtcctttcatatttttctctaaatatacaatgtatatataaacaatatttcacgtgctgatttgcagcttgctattttagcttctcagcatattctgaacatgttcccatttcttgagattctattttaatggcgttattttttaacgactggatagagttctaccataccaacgtgccttacttaattaactgggctgctcttaactttttgttttcataattaaccctgcaataaacattcttgatgatacatctttttggcgtatccttgattatttccattaaaattgttttaatattctcaattcttatgcattcaatgtatttttattgaacaatagtgtgctgcttacttgaaacacagccattgagacgtgccctcttccttcacagagcttaagattaagtaggaaagatagaaaattgtacatggctgttaaaaaaaaattaccaccacccaactgaacttttctccctccgctcagtcccactcctctggccaacactgaccgcagtctcagtttgtgaatatgtgtttctcaaatgggattatactgtacctatttccttctagttttttcacttaagaatctgtataaatattgaagttctttccatgtcagtacacatagttctcactctttttaatggcttttttatctttcatggaatagctaaatcccaatttacttaatgatttttctactaatgaacatttaggttattttcaagtttgtcctggcattgtatataatgttaccactgaacatatatctctgtgtgcatgaatgggatttctggatcagtgggtatatacatttacattttgatcaagatattattttaaattatcttcaaaaaaggttattcccactaacaggacagaagagagcttttttctccccatgctcatgaacactggatatattctgcaggaggaagaaagagtgggaagtgtatctctcattgtactttcaacttgcctctcttcagtgtccactgaatcttttcataggtttattagtcatttgtatttattcttctgtgaattgcgtgtcattctttgcccatttttaattaggttgcctgtttctttttcatttatgagaatttattatatttaaagactagtaatccttattatgtacattgcaaatattttacagcctgtctttaaaattaatagacatttttagggcagttctaggtttacagaagaaaatgatcagaaagtacagagttcctttaaggccaggagtttgagaccagcctgggcaacaaagcaagacctcctctctgtaagaagaaagtacagagctcccacataccctcctccacccccagccacttacacagtttctactattatttacatctttagtgtggtctatttgatacaactgatgaaacaatattgatacattattattaactaaagttcatagtttacattagggttcattcttgatgttgcacattctgttagtgttgacaaatgtatactgacatgtacccaccttacagtgtgaaacagaacgcctttccatgcctggaaatcctctgtgctgtgcctactcgtgccttcctcctgcctcccccacaagcttctggcaaccgctcattttattactgtctccgtagttttaccttttccagaatatcatatgttggaatcattcagtatgtatgtagtcctttcggactggcttttttcacttagtaatatgcttttaaggttcctccatgtctttttagcactgaataatattccattgtctggatataccacagtttgtttatctgttcacctactaaaatatatattggtggttccaagttttggcaattatgaataaaactgctgtaacatgtacaagtttttgtatgggcataagttttcaactcttttgggactataccaaggaacacaattttggatgatgtggtaagagtgtttagtttttgtaagaaaccaccgaactgtcttccaaagtagctatacaccattttgtatttccaccagcaatgaatgagagctcctgttgttccacatccatgtcagcatttggtgttgttaatgttttagattttagccatacccattgttgtttttaatttgaaattccctagtgacttaccatattgaccattttgggatcaataaatttaaaatgtatatatatttttaacaggtctcactaagttgtccatgctggtctcaaattcctgggctcaaaccatcctcctgtgtggctgggattacagggacatgctgtcatgcccaactcaaatgcttgcttgctatctctatgtcttctttggtgacgtgtccagctcttttgcccatttttaaatttggatgtctgttttcctactgttgaattttaagagctctttgtgtatttggtttactattcctttattggatatgtgttttgcaaagattttctcccagtttgtggcttgtctttttattcacttttattatttgtttttgatatctttttttataaaggttggaatttttacataatcaaaccgtctctaacaaagaagaataacaaaattcttctttttgaattctgtctcctacttaggaaattttctccacctggaaattgtaaaatatgctcctattttcttctatcactttcgtagctttgttttacattgacatctttaattcatctggaaaactgtgtgtgtgattgtgtgtggtgtaatataagaatttaattttactgtttccaagtgtagagataattttcccaacaactctttctaaataattcatgttttttcctatgtaattgaaatactaccattatcatacactgagccaaaatctttttctacagagaattcagtttctgaatttcctaccctgtttctttgctccattttgtctgtttctgtactcttccatgctgttgtaatgattgagacattataagttggcttgatatctttaatgtgtagtcttcttagctattctttccgaatgtattatcatgtccaactttataaaaattatttttggaattttaactgagtctgaattgaagttacaggttaatttggggtacatttataaaatggaatattaccattcaggtctttttaaattttcttccatgaactctgataggttttttttcatagagcttgcacatttatatttaagtttattttagtatttttatagttttgttgctgctgtagatggaatctttttgtttcattacattttctgattttaaaaaagatattggtagttgggaaagatgtgggttttgtatgttgctcttgtgttgaagtctcttttttgtttaagcatattttattagattatcttggaatttctttgacagatgattatcagttacaataacagcaccttttttctttcctctccaatacttctactttctatttatttttcttattttattgaattgcctggaattacatgtacaatattaaatggtagtggagatagtgcccacccttgtcctcttcttgccttttatgggaaagagacaatgaacaagtaattttttaaagagaaactaaatcaggaacttcgaaggccagtgcatatttcatgaattaggaacattaatgcaccttcttattatctttcttccctcagaaaaattaaactgaaatgtctctaaaaaatataaatgtaactcacattatgtaatatgtttccaaaatggctggcatgagctctcattttgattgtttaagagactctctttgggctaaggtcacatgtttgtatctttggactgccattaccttcagctttaggtaagagaaacattattttagttatgtttatgttatgacataatcaagatcttccccaagaggaagtggagctatctacccaatcctagagaaggtgatttcctggaagaaaagaaatgcattccagcctgggcaacagagcaagagcctgtcaaaaaaaaaaaaaaaaaaaaaaaaaaaacagaagaaacaggaggctttgaggtccctcaaagtccctatcacaggatttcttgcaaatctttcttcccagtagatcatatccatgagtaacatgaattgctgggtgatcactcataatgatgtcagcactcatctgccccgggtgagcacccacagtcttgggcgtcaacaccccttgctttcaggcactgctcttctctccagtcagaatccatgcggaagcgccagctgtggttgtgcaggctggtttcagtgctgcttcgctttgataagtaactaagtacaggatgtttgaggaataaaaagaaggccagcgtggctgtagcacagtgagagaaggtcagaagagctggatcatgtagatcatgtggaggtttggacttgggatcgttgtttcaaagcatgaagggtagcaacatgccaattcatgttttaaacattccccatatgctatatggggaatggagctgttagggagacacagccataccccaggtgagagatggtactttggatggtcatatttcagatgtattttagaggcagtgtgtgcaagacttgcttctaagctctggtgatatatacaactgcttacttgactctcaaacttaacaaggccaaactcctagaagaaaacaaagaggaacagctccttgacattggccttggccttgacttttgtgatatgaaaccaaaagcacaggcaacaaaagcaaaaataaacaagtgggtctacatcaaactaaaaagcttctgcacaacaaaggaaacaatttcaaaaaaaaaggcaacctatgaaatgagagaaagtatttgcaaaccatacttctgatagggggttaatatccaaaatatataatgaagtcatataactcaatagaaaaaataaataacccaattaaaagtgggccaaagacccaaatagacaatttttcaaagaagacatatagacggctgggaagtacatgaaaaggtgttagacgtgactacttaacggggaaatgcaaatcaaaatcggaatgagatgtcacctcgtacccgataggatggctgctctctgaaataacaggagctaacaagcgttgtcggggtgtggaggttgggcaccagcccaaatccggtctcaagatcctctcaactccttcttatcaagaaaccccttgggaccttactcttcctactgcagtcagctgaataaacctgactttgtttacacgccaggttcctggtggtttttggctggtaggaatcaaccttttgctccctctccctgtgttccttgtcatttcttctgctgacactttactcaagtgtccctcactgcccccctgatcccaccacccctcaggacatactgcgatttccctgggattgccatcaaccgtcttgtcatctcttccttgaaccaaacctgtctcttggggcccttatccagctccatctgtgctagggtcagtctggccaactggacattcccactttggacttctgcaggcacttctgtctccactttaaaaaaggaatggactcattccttgtcctttgcccctgttcacctctctgtcctgtgctcctgcttccctgcacctctgagccagggcctgggaatatctgcagatctttttccttcactcgcttctccctcacctcctaaatgtgtctccagtcatctgctgccattgcagctgcatttagcagggcccctttgcttccggccataccctgtccagtgtagcctcaacatggcttccagagcacctgttctgaaccataaataggatgtccacagcactcacttgtttaaagccttcccatggctttccatcacttgggagataaagtccaagccccatacacaagcatttagagtctgccccgcccactgccccccaccttgcatccgactggacgttagagcagtcaaaccacctgtcattcccagcaggccctgcctgctttgtgcctccacgctttcccgggcctggtttcccttgcaaacaccgactccttctccagtgcttcagtagatcctccccgtgcctctgtacgcagcgcctgtaagtgatggcggagctcccgcctgctctagtgcagccatcatcccacagtattgtaccgtattgtggttctctttacatgtccgtcatctcttgctgtcagagcacctctggatgctgggcccactgcacattcatccttgcatttgaaatgatgctcacaggaggcggtcaacagactcactttcttcacctttctatctagaccagtgatgtccagtagaaatataacagaagccacatacaaaattgtaccctttttagtggtcacattaaaaacataaaaagaaacagagaaaattaatttaataatatattatatttaacccaagatatccaaaactattgtcatttccacatttagtcaatacaaaaacagtaataagctattttacatttttgttgcattatcttcaaaattcagtgtgtattttatacaggaggtacatctcaattcagactagccgttttttgtttgtttgtttgttttgtgacagggtctcactctgtcacccagactggagtgcatggcgccatctcagctcactgcaacctctgcctcccaggctccagtgatcctcccacctcagtctcctgagtagttgggattacaggcatgtgacaccccacccagctaatttttgtatttttttgtagagacagggtttcaccatgttgcccaggctggtctcgaactcctgacctcaagtgatccgcctgcctcagccacccaaagtgctagtattaacaggtgtgagccaccacacctggcccagaccagccacattttaagtgctcagaagccgctggtggctcatggctcctggaccagaccatgggggcttcagcaggtgcagcggtgggcctctgttttcctacctgtagaacaagaaggttgccaaaatctgtaatctcttatccctcccagctctaaaaaaatggggctctgataccttgtgaggaattcaagagaatgtcctctctcagagtgaagtgtccttcaccagctggtgagctggatcccagcagttttgttaactgtgatcacttggttagaatggaggctgcaggtttcttcccctggaaagctgctactttgagattatttatacaggtatttttaccttcataactaattagtgatactttgagactatataaataccttatgtctcataatttcttctacaaattttagactccatggacaattcttggctgaaataactattactgcactgtttaccaaatggtgatttttctacttccataattcttacatatttattacttagcatcctactgtaaggaagaattgtcccttctcctccgtttatttactcattcattcatctttatcattgtggacttaaggattcctgcactcttctgtgggttgtaatccattaccctcttattgtgttttggtgagatatgaactaggaatatgttagttaaattttcatgcttgatttttggaaaccacaaccctgaaatcctaagagtgacaaaaaaaagtgaagaaacagtttgtggtttattattctctctgtaaaagctttagaaaaaaaaaaaaaggaacacattaattagaaaagcctatttgctgaaagagaattatttttaacatgtattcattatttatttttaaaattattttaaacacatttcaaacatggtgtgtgtgttctgtcctggtcaatgatatttctactgagcacttgttcagaatttaaagagccattactttaaccaaaggaataataagggagtgaaatatcttgctctatggagtttgctagttcttgcagcctcagcctcacaaaaggtcattctctcttgctcctttgtccccctgactcgtgggggtttatatgtgcacatatacacttttttttttcttttcctacagaaaatagataggaaatgggcatgattgtgagtgaggctgagtggccgcctggcctaatgctggcctgggctctctgcagcctaattaaaggaaaatggttgtgctctctatgaagagagaagcagaatgagagcagacaggcacaggaagggaagctgaagcactaagagcttccccttttctgcagaattaaatgctaaccttgcctcatactattagtgctgaacttatataacaaatcaatgtaaatagctggccaacttccagggcactagatttattgtgcaaattcaattagtgcagcccctaagaaaccagcaatgtgcaaacaaatactgtagatggactaaaagggaagaggcagagcactaagactcagtcctgtaccctgacggcagacattgctgtaaggcactgccaaacccagcttcccaccatggcaaagtgtgtgaatgacccgcggctgtgctttcaggataaacttaaatagaaacaaaattcttaagtgtctaaacattatgctatttctacaagaaaactggttcgctctggcaagtaagaccaaaagtcagacaggtcagaagaaaattcagcctgcttgggctttagaatgcctgggccttaattccggggccacttttcccaactgccatctcaatatgttcagtgaacaactggtttaactattttgatttacttggctcacccagtgtagtaagcaggcaaaacagcaaagaaataactccatttggacagtttgcatttaattttcatcaattcagacacaaaaaaagtaaggcctcagtttaacaatttccatgcaatttttatttgtttccacagaattcttttttaaattaaaaaaggtctcactttgttgcccaggcttgagttctgtggcatgatcatagctcactacagcctcaaactcgggctcaagtgatcctcctgcctctgcctcccaaatagctaggactacaggcacgcaccaccacgtccagctaatttttattttttaatttttgtagagacaagcgtctccctatgttgcccagactggtctcaagctcctgtcctcaatcctcccacttcagcttcccacagcactgagattacaggcatgagccaatgtacctggcccatttccacataattctttagtgaaagacaaaacttcaagaaagctagttacgatgtcctcttacctttattgctctataaaatggcaggcaaattaatttatgcagtactttcaaatggaggaaaagcattccctgaggagaaaaactgcagttatgccaaagaaagactttctttgaattaagcagcaaacaaaaaagtattttaatattttagtttctaattcacaccagaaaggatgtgaagcagcctacacaaacatatgcaataggataattaagaacaatagcagtaataatcattgatacggagcctctcccctgtgccaggcataatgccacatcttttacctggagtgtctccttgaattcggatagtaactcttggaacaaaggaccatcattatccccgttttacagctaagaagactgagactaagagagactaacgctaactagctccagattacataagctgacaagtggcagagctggggtaaaaagaaaaaggacattagtaaatgggaaactgaggccaggtcagcaacacgaatctgagctgagatggagagaccaccaacgcaagcatcggtctttgtttagtcaacttgcatcctgagaatggatcaccaactcagcccatatgtgtggcttcccactccttagagatcagagcaaggagagaaatgttagcactggctagattcgtaattcatgaattaacatattccatcttctaagctgttcccgggctgagtgtctgggattcagaaaaacaaatggacagcagacagatccttcaggtaattcttcaacattctgaaaactaagactctggttgcaagggtggcagggaatttctggtcccgtccagagcaaatgtgacctgatgaaggcacagaaggtcagattccatgttcttatagacatcaaaggacctaaaggaaaacttgtgcttgcaagagagctcagcctccctccctcgtcaggggaggtcgtggggcctgtgggctggtcaggatttccctccgagacagctctgggtgttcagctcacagacaacacacatcatgctggtcccagtggcctccagcagaggcaaaccatgcacttggagcagagaaagccttgcaaagcagtgcctcccagcaccagtgctgccaggcaagggagcccagggtgtgggaggcacctagttttaagcaatgttaacttcttcttttttttttgagacaaagtctcgctctgtcgcccaggctagagagcagtggcacaatctcagctcactgcaacctctgcctcccggattcaagcaattctcctgcctcagcctcccaagtagctggtactacaggcatgcaccaccacaccctgctaatttttgtattttttgtagagacggggtttcgccatcttggccaggctggtctcgaactcctgacctcaagtgatccgcctgcctcggcctcccaaagtgctggcattacaggcataagccgctgtgtgtggccatagtgttagcctctgaattcccaggtaaaccaggatcattggcaaaacagtgctctgtagcattaagagagaggaattttacaagccattcagaaaatagctgatttctgctgaaaattagaatttcagtcttagtgccaatgaattgtaagccgtttttctgcagagcaggaaacatctgaggccagctctgcattgtgacaatgagaccacagccaaattatatttcgaggctgctgctctttcggttatgtaaatcatagcatgtgacaattacaactggtcatcaaagaactagttggttttgctttcaaaatcattaatcttacctttctagatctgcctcaaagcaatcaaaaaattgactagatacggattcttgcaaactcaggctgaactcaaggaaatattcagtccgatttccatctcagtctttgggattttttgttgcagggcatcagggctgtgtctgctcgtgtcatggggtctcatttccaagcaaacccaggaataactagaaatacttacttgttcctattcttatttttgaaaattgtactgaaatgcatgaatttacattctttcatgagtagaataaaatgatcataaccctacctgacagtgtgaatgcaaattgtgcctgttctctgcagttaagccaggtcgggccagatgggaacatgtaggactctgaggatacagggagtttcccactggcttggaggtagaagtcacacatggaaaatattctgtgggtttttttccccagagtgttcggttttggagtagttggagtctagagtgataaacatgttctagctctggaaacctcaaccaaaaacatctcccaattttcataaatttaagaaaagatttttgttaaaagtagatgctgtagagtcttcggggtatcacagctgataaaacatccattctctctttccccttcaggaacagaattctgatttataaggaagtacatcatatctaaaataaatgacagtggttcccagcctcccatgcaaccaagaaagccatatggccaactattggccaataagatataaatggaagtgctttgtgaaacttccaggaactctccttagaagaaaggagatgagtcctctttttcccatacttcatcccagaacatatatgtgatggctggagctcagcagccattttgaatcatgaggccaaggcccctatgaatgtactctgctctgatgtccatggaaccaccctggcagccctagactccccatctagaccttctctacctgaaaaaagtacacttctgccttttgaaagccacagttactttgaaactttctgtaatttcaatcatatctaatcctagctaatgtaggggatacttgggaaactggggtgattaagagagttgctagaaagactcgggaaaaagcataaggaaataagatttggttgcacagttgttcagagcatgggttacacagaactatgggtaggacctagttcagccacttattaactctgtgaccttgggcaactcatttaagctctctgaatctatgtcttcatctgtaaaatgggccagcatgtcccactttctaggattagaattaggatgaaatgagataatgcacagaaatggtgtgcaacagagtctgtgggtttgtgtccccagatgaatctaagtgtgcctccagcatgaagctataatagaacaggatgcctcccagagtgtagcaagcacccaccaggtggtatgcaggatagctcaggcagcacagccacatcttactaatgatggatttgttccaacaggaattagaataaaacataacgagcacatcaaacctgtgatttcataggtatcattacttaggacaagacaaaagtaattatttcagtttttttaaagacaaatcaatgtaaagaaaattttgggccaggcctggtgcctgtaattctagctacttgggaggattacttgaggctaggagtttgagaccaacctgggcaacatggcaagaccccgtttctgaaagattccaaatagaaaattaggcaggtgtgatggtgtgcacctatagtcccagctatttgagaggctgaggcaggaggatcacttaagcccaggagtttgaggctgcagcgagctatgactgtgccactgtattccagcctgggtgacaaagcaacaacctgtctctaaaaaaaaaaaaaaattttaagaaaatttggaagtattcagtaatgtagtcacacagaaaacgattgattcccaagtgactgaagtttggcaaacactagcccaagagaggtagcctagggatgaagctgcagagaggacaaagaagtgaggtcaagagggccacagtgccaggccttgtggaacacactccagcccccacctccccagcgtgcacccctctgcagccctgccatgccaggccatcataagtggctctgacattctccacccccacccaccatgtgtgcatttctgggggcaggggctttctctcaccatggtaccctcagtgcccttcacatgtttgacacaggcgtgagggccatattcgattcatggcaaagaattgaaccctaggtcttctccttccttgcaaccgttaatgtcagaagctctgaagacacctgggacagagaagagagggagaaaagtttacgtggaagcatagggaaggaagggatgtttgttgaggggtggtgtgatgcagcagaggaagaggaccagaggaaagcagccactggaaataaggaaacagggtttaggaaggcctcactagacctgttaggatggatgcatggatggatggatggatggacagaatgggtgggtggatggatggatggatagatggatggatggatggatggatggatggatggatggatggatggatagatgggtgggtgggtggatggatggatggatggatggatggatggatggatggatggatagatgggtgggtggatggatggatggatagatggatagatgggtgggtggatggatggatggatagatgggtgggtggatggatggatggatagatgggtggatggataaatggatggatggatggatggatagatgggtgggtggatggatggatggatggatggatggatggatggatagatgtgggtggatggatggatggatagatgggtgggtgggtggatggatggatggatggatagatgggtgggtgggtggatggatggatggatggatagaataaaaaagaaagctaggacatggttctagtgttcttagcagacgtcccaccatggaagaggtcatggagcacaggggctttgggaaaggtgtttacaatcctgcctgcctctcacccagacctcttgccagggttggcacacccagatgcctgctgtgaccaatggagaggagcaattctggccagactggtgggaaagcaaggacgaaccacggaggccatccctggcaactgagctgacagctgccacacgaaaatgaggacacagcattgcctaatctgactcatcaaagaaaggcctgaaacccaaattccaaatgtcattcaggccaaagtagatgcgtccatatatcatacctggccttgggtatctgtttgctaccatgatatttatcactgcctgccttctgtgtattgaatggagacaggacacaggctgcttcatagagaggaaagccccaccagctatgctccatcctctggcatcacaagattgacactcatggctgagcttgacgttcgggcaggcatcttagaaggagaacagtctgccctccaccgtgccagaaaagacacatacaagcaagagcatcattctctaaggaaacccgcaggcctccctggcggcagctgcctgcctggagaaaagtggctcctcctgactttccagcagccctctctgtaggcgtgagtgtcagctggggagcctgtgaacagctctaaaagtagacacttttttttcatgccaagagaaaactagaatgctttttgttaaaaaaaatcttggaaaaagtgatatgtttcttccctgccacccgcctcctccttgccacctggtgcatagttgagcgcggaccgccacgctgtgccaatgctggaaagggcagacctgcagtcgcagcactcctttcctgctggccaggaaggccttggccttggacttgagatcccggcctttaaaggacacctttaccacttctctttccccgtagatgtgttggactttttcctacaatttctcccagtgtgttatgttgatcagctttcctcagccttcagcgtgtctaatggccaagccggccttcacatccccactcagttcatgagtctgtcgatgtaactgcctggatgagcaggcaaggatgacctctggagacgtctagtcaattgcttaatgatcggactatatcgaccagaaatggttaattcagttccgcaagtcaaaatctcccagggcttcttggaaaagtgtattacttgcagaagtgatggggaatttaagtcctcccagataaaccaggctggccattggcagcatgaacagagacagtaatgtcttctatttcagtcttgaagaggtataacttttttctcccagctgtgcaaaaatgatttttgtggcattgatgcccacgtgcacacagccccttaaaaagcacgttggagccatgtgcatacctggccctctctcctgaagatttctagacggcaggctgtgtgggttacttcatggctcctagtagtcttccccttttgaatataaattgggggaaaaagttaatattttttatttttaaaattcacaatattcatggaaatacaaatttcccaaaagctcatcacgaatgctgatagcaccatagtacctggcggccaaaaatgcagaaacctggccctaagcttcaccaggatccaagatgcccctctccttcctatggatacagaaggagcctaaagcatagaaatcgttcaacctgggggaggtctaaaacttttatttttatttttttagagacagggtttcactctgtcacctaggctggagtgcagtaggctggagtgcagtggcgtgatcacagctcactgcagcctcgaactcctgggctcaagcgatcctcccacctcagcctccctagtagctgggaccacaggcatatgtcaccaccacacctggctaatttttttttattttttattctttgtagagatgggggtctcactgtgttatccaggctggtcttgaactcctggtctcaagtgatcctcctaccttggcctcccaaagtgctgggattgtaggcatgacacatcatacctggttcctaaaacttttcttaaagcagaatttcttcctaacattcttgtatcaaaaggaaaccatcttcatttgactcaacattacgatcaattgtaaaataggtttggttaaattcagagcttttccagtttgaatgacgaaagctgccatgctgctgctgtaggatgattttaggaagcccacaagatccgagacaccctcactcctcctggccaccttcacctgggagcctgtagctggtgctgaagttctccttggataggggaaagcagccgggtctgagccctgccctcaccatgcaggtctctgccaggagcttgggccccgaggcccagccctgggccagccatcatgggcacctggagtgcacagcctcaagtcgcaaatccattccctttagagttgctggcaagtgtgatgtgtattgttgtgtggttgggagaacaccactctatttctgaaataaaacctggacactaggatttttttcaatgttttacaaaaattgctacacagcccccattttctctaatacaattcaagttcctccaaagttaatttgccaggggttcagagggaggcaaggagagagggtgagtaggcagatcacagagggctttttagggcagtgacgctcttctgcatgataaggctgtgggaacctgggtgtttagatggagggccagagctcgtgacagaccacagtgggttcccaaggaaagtgggacttcacagaactccctctctgaagcagacgatgaagggtccccgacgggcaacacagagagcagagtttaaaggcgccgggcagggagcatggcccgagagcacctgggctgttggaacaggcagcactggaaatgaggaaagcagcgagcaggcggttccgccaccagacggaggtggccgtagacccccaaaaccaagggggtgggagctccgatggtgccatggaaacaaacatgggggatttcagccgctgaggaaagacagtgtgttaacagctggatgaacataccacctaaacagcaacgcgggcaagtcagcaggaactgatgccatgttctgatccagcgagtgggcgtggggtgaggcctgatactgctgagtgccaggctgtccctaacacagactctcggcgtcgtatctgtcctctagtgcccccgtggcccctgggacactttacctccatccctaagaactaacttttacgtcttggaaaacggaaggtgcccattcacgtgggggcaccaggtttttccttcccctgtgcgcacacacaacatccataaacagtaataagggcagctagctcacatccagaggagagcaaagcccacccgagcgacgtggctttgaccctgaagcagttaagttccctgttccaagacacttaaagtaagagttaaaataccaataagagttcttggttattccaaaaatgcatcaaattttccagttaaataaaggataatcttattgttctccatataaggaagcatttcaactttcagtgaaaagttagcaaatatgaacaccaaaaaatgcagctctcctacaagagattcaattaagcgtcgatgcaaccgtgcgaacagcatgttgcagcacaaaggcagcctgtttttctggccattattaatctagaaagcttaatgatgaacaacatttgtgttattgtctacccaaatttaatttatttatgcagcagttaatcttgcaatctgtttttctcaaacgagggcagataatggagacaccgttctttacaagtcttcaggcttttaaattctgataaaatcaggattcttcactgggtcttgccccagctctgaattaaaccactttaaatgtaattatgggacctggccttacagcaggaacatccatttaaaaaattgattggtcaggctgttccacaagacattttatgagcaaacgattgcaatgaggccagaactgtaatttataaaggcaaaaaagcaggtaaatactttattagtggtaatgagagggttgccagctcactgagtctcttctttccttaccagctacttcaccgagccgtggtgcctggccctgttccacgatcgttttattgatctcaggaaagagttacgccaaatcttagcctccaaggaggtaagagtgattaatggatatgtggattattccttgcaaattataagcagctgatagctgttgatcatttagacttttccctacattcccattttatggttttactttttaaaacaacagtatctcatataaacaaactgcggagcatgtaaatgcagactgtgttatttcaggggaagtgattttatttaaatctttttatagggggcaaatttctttttcctttttttaaagaactgtatttttctgatcagctcagagtgctggcagaaaactgaatctgagttgcatctacttgccctcaagaacgaacgttgcattcctttagtttctgcctgtgtttgccagccatttgcggaacatatgtgtgtgtgtgttcttttaaagatgtacagggaagccatccagtgtgcctcaaaagcacactccttttataaccagaacttctttctcaaaatactacagaattaactggacattaggctgcgtagcccaagggctgcacgctcagcaagaaatttgaccccaaggtataaatagtgaggtatttgtgaaactttaagttaaaatatttctttcaatatgagaatctctagcagaactgtggaacgttaagagctgtgttcagtgagtggttgaatctccagcctggctctaccctgcttcactcagccaagtgccggggcctgggttagcttctacctcgtgttaccgtctacataggcaactcccacatctccattgtcacttcctcctgggagcccccacgcgccttattggacggcactgctagggagcgcgcaccctgttcccagtgcgtgccccacttaatcacagctcttgctgtgatttaaggagagtggagaagccactgttatcatcttgactttcccagtgaagaaactgaagtttagaggggtttttggagttttttgtttctgtttttgttttttttttgagatggagtccccctctgttgtgcaggctggagtgcaatggcgtgatctcagctcactccaacctctgcctctcaggttcaagcgattctcctgcctcagcctcccgagtagctgggattacaggcacccgccaccacacccagctaatttttgtatttttggagagacagggcaccatattggccaggctggtcttgaactcctgacctcaggtgatccgcccgcctcggcctcccaaaatgctgggattacaggcgtgagccatcgcgcccgaccagcttagagattttaaatcagctccatggtaacacagcaagcttcacactccggggtgtctcaccccaaagctgggaacatggttactgaaccatacagggccgaagtgcgtgtcctgggaccttctcctcagtgcccccacttttcagtttcactcccagggtccagctgggaactgtaaatcatttcctaatctgaagcaggcttagattgggaaacagaggtttaaagttaaaaccaaacagcagtggcttaggatccagcaagtaaatgcagctgagggaagtggagggctgggtggctgaatgcccaagtcagaggctgctgaaggcgtgcatgtggcaatggaatccactaaagatgctgcaggccaaacagagccctacacttaacccagggctgcaggaggccaacctaactggaaacctgaacccgagttgtaaggctggggctcactgaatgctcagctcctcagacaccttccttccttgcagaatgtcatccgcagcttcctactgcccctacagtaaagggcccttcgtttccaagtgatcccatcaaaactctgtgcctccgtctttcttaaccccagatctgagctcttcagttaacattgtgcacaaagccagggggttttagtcttaaagcttaaaagggaagccatggaaactgtcaagcccaaggcatccaccacgtttcatacaactcactgagataccctcaaacttctacctgtgtacggatatttgctgtggacccatttatgaactcagtgtggacagcaggcccaggcagcagaccagaagtggccacggacctttgcccaagacacactaaaggccctccagccattcttgtgggtcttgtagatttccagaaaatgaaacctccggaagaaaaaaatctccactggaggatttttctatttgcagcatttcgtttgtcaaatgggaaaggccacaggaagtggtgatgcatagagtggtgtctgcctagctcagctggactatgcaatgtggcctctgccagaccctcccattcctgcagaaccgtggccagccgtcccacctcagagagctgtgggggagtagcagaggggaagtgtgcgatggcacagaagagtggcccagtgagtgctgaccaccacgagcagcagtggaggtgacagtggagaagggctgctgtggaaacgacagccacacaatcagatatacaggaatttcaccaaagagtctggtattaggaaaataaaataaaatgaatagcctgcactaaagaataatcataatttattttctcaaatattgaaatgaggtacaaatggccaacaggtatatgaaaaatgcttaacatcactaatcgtcagagaaataaaactcaaaactgcagtgaaacatcatctcaccccagtgacaatggcttttatccaaaagacaggcagtaacaaatgctggcgaggatgtggagaaaggggaaccctcacatactgttggtgggagtgaaaattagtatagccactgtagagaacagtctggagtttcctcagcaagctaaaaataaagctgccatatgacccaccagtcccactgctgggtatatatccaaaagaaaggaaatcagtatatcgaagggatacctacacactcatgtttattgcagcactactcacaatagccgagataggggattaacctaagcatccaacaagtgaatggataaaaaaaaaatgtggtctatatacacaatggaatagtacctagccataaaaataaggaaatcctgtcatttgcaacaacatggatggaactagaggacattatgttaagtaaaatatcccagacacagaaagacaaatattgtatattctcacacatgtgtgggagcttaaaaaaaataaaatttaactcttggagatagtagaatgatggataccagaggctgtgaagggtggcaagaagtgggtggataaagtggggatgattaatgggtacaaaaatacagttagataggatgaataagatctagtatttggtagcacaatagggtgactatagttaacactaatttattttatattctaagataactaaaagagtggaattggaatatttctaacacaaaaaaatgataaatgcttgaggtgatggatactccatttaccctgatttgatcattacacattgtatgcctgtatcaaaatatcacatgtactccataaatatacacaactattatgtactcataataattaaaattaatttttttaaaatattcaaatgatgtaaaccattttatttcaccttctaccttgtcttcagggaagtatacaagttcaatcccattaactatcatatcctagagcttggtatatcaattttcttcttccacatgtaaagaaaggaagaaaagaccattatctatctattatctatgaatattgttagaagtcatctgttatgaagattagaatcattataacatgggccgggtgcagtggctcatgcttgtaatcccagcactctgggaggacaaggcaggcagatcacctgaggtcaggagttcgagactagcctggccaacatggtgaaacccaatctctgctaaaaatacaaaaaattagccaggcatgatggcaagtgcctgtaatcccagctactcaggaggctgaggcaggagaatctcttgaactcaggaggcagaggttgtatttagctgagattgtgccactttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggtgtgagccaccgcgcccggccgattgtgccactttagtccagcctgggagacaagagcaaaactctgtggcttatgcctgtaatcccagcactttgggaggccgaggcaggtggatcgcccgaggtcaggagttcgagaccagtctggccaacatggtgaaaccctgtctctactaaaaatacaaaaaactagctgggcatggtggtgggcggctgtagtcccagctacccgggaggctgaggtaggagatttgcttgaacctgggaggtagaggttgcagtgagcccagaccatgccattgcactccagcctgggcgacaagagcaaaactccgtctcaaaaaaaaaaaaaaaaatcttcataacatttatttttaaaaagcaaactcattccaagatatctgaaatgcccttgtggaggtaaagagaggaacactggcactgcattatttagctgcaggcaaagccacagcatcactgaccaaggtgaaattttattcagtcaaaatgatccttcaaaatcctttacgaaagatataacaattataaccatatactcacttaacaaaagaaccccaaaatatattaataaaagcagaattgaaagaagaaatagttctaaaacaataatgcagacttctgtattttactttcaataatgactagaacaaccagacagaaaatcaataaggaaatagatgacttcaatagcactataagccaagtggacccaacagtcgtggatgaaattctctgttcaacagtagaatgcacattcttctcaagtgcacacggaacattctccaggataggccatatgttaggccacaaaacaagtgtcaatacattttaacagattaaaattattatattctccaaccacaacagaatgaagctggaaatcagtaacagaaggaagattggaaaaattcacaaatttgtggaagttaaataacacattcttaagcaaccagtgggtcaaaaaagaaataaaaaagggatattagaaatgctaatagatgaatgaaaactaagatacaacataccaacatttatgagatccaaagaaagcagaatttaaagctataagtgcctacataaaaagaactcaaatcagtaacctaattttataacttgaggaactagaaaaagaaaaccaaagtaagcctaatgccagcagaagaaaataataaggattagaacaaagataaatgaaatagagaataagaaaatagagaaaatcaataaaaccaaaagttagttctttggaaagatcaaccaaattgataaacctttagctagactgcctaagaaaaaagactcaaattactaaagttagaaatacaagtggggacattactatcgaccttatggaaataaaaaaggattatgagaaaatgccatgaataattatttgccaaccaattacataacctagatgaaatggtcaaattattagaaatgaacaaactaggctgggtgcagtggctcacgcctgtaatcccagcactttgggaggccaaggtgggccgatcacgaggtcaggagttcgagaccaacctgaccaacatggtgaaaccccttctctaccaaaaatacaaaaattagcccgtcatggtggcacatatctgtaatcccagctactcaggaggctgaggcaggagaattgcttgaacctgggaggcagaggtttcagtgagccgagatcatgccattgcactccagcctgggccacagagcaagacgccatctcaaaaaaaaaaaaaaaaaaaaatgaacaaactaaaaactgacacaagaagaaatagaaaatctcaacagagctataacaagtaaagaccttgaatcaataatcaaaaacctcacacaaagaaaagcccaagaccggatggcttcgttagtgaattctatcaaatatttaaagaattaacaccaattctcttgaactcttccaaaacatagaagaggttggaactattcaatgagatcagcattaccctaataccaaagctagacaaagacactgcaagaaaagaaaacttacagaccaacaccccttttaaatttagaagcaaaaatagccagcagattattagcaagccaaatccagcagcatattaaaggactaaacacccagctgagtgagatttaccccaggaatgtaagggtagttcaacatataaaaatgaatcaatgtaatacaccattttaatagaacaaaggggaggctgggtgcagtgggtcacgcctataatctcagcaatttggaaggccaaggcaggcagatcatttgagatcaggagtttgagaccagcctgaccaacatgatgaaaccctgtctctggtaaaaatataaaaaaattagccaagcatggtagcacacacctgtaatcttagccactcacaaggctgaggcaggagaatctcatgaacccaggaggtagaggttgcagtgagccaagattgtgccactgcactacagcctgggcaatagagcaagactccgtatcaaaaaaaaaaaaaaaaaaaaaagaacaaaggggaaaaaacactatcatctcaattggtgcagaaaaagcatttgacaaaatcaaatacattcttatggtaaaaacactaaaaaaaaaaaaaaacaaactgtcaatagaagggaatgtctccaatctgacaaaggatgtttatgaaaaacccacagataacattacactcagtaatgaattactgaaacctgaattcttatccctgagatctggaataagacaaggatgcctgctttcaccacttatattcagcatggttttggaagttctagccagagcaatcaggcaagaaaaagatataaaagacatccacactggaaaggaagaagtgaaactatctccattctcaggtgatgtggtcctaaagaatccacaaaataactattagagctaataaatgaaatcagcaaagttgcagaatatgaaaccaacacacaataatccattgtctacattatcagttgtattaatctgtttgcattgctttagaagaacacctgagactgggtagtttataaagaaaagagatttggctcatggttctgcaggctgtacatgaagtacatgtactgacatctgcttctggtgagggcctcaggaaatttccagtcatgatggaaggtgaagggggagacagtgtatcacatggcaagacagggagcaaaagagagagggaagtggtgccaagttcttttaaacaaccagatctggcatgaactcagagtgagaactcactcattaccacgaggacagcagcaagccattcatgagggatcctccctaagacccaaacacctcctccaggtcccacttccagcattggggatcacattccagcatgagagttgaagggaaaaaaacatccagaccatattagcatttaataatttgaaaatgaaatgaagaaaacaattatagttattataatagcattaaaaagaataaaatacttgggagcaaatttaaccaaaatagtgcaaggcttacacactgaaaactacaaaacatttttgaaagaagtgaatgactacctaaataaatgggacaacatctgtgttcatgcatttgaagactttatattgttaggatggcaataccacccaaaacaatctacaattcagtacaatcctgtcaaaattccaagggcatttttaaaaagaaatgcaagtcctaagttcctatggaaatggaagggactccaaatagccaaaactatcctggagggaaaaaagaacagagttgaagaactcacattttcttactacaaagcaacagtaaccaagacagtgtggtacttgcatgagaatagatatatagatcaatggactaaaattcagagtccagaagtaaacctgtttacatgaaaatatgttcagcatcatcaattattagggaaatgcaaatcagaaccataatgagataccactttacagccactggcatggctataatacaaaacaaggggggaaatagtgaagatatggggaaaatgggaactgaattgctggtgggaacataaaattacacctgctatagaaaatgttttgatggttcctcagaaagttacacacagaattaccatatgactcagcaactgcacttctaaatatatatccaaaagaattgaggccagacgtggtggttcacacctgtaatcccagcactgtgggaggctgaggtgggcagatcatctgaggtcaggagttcaagaccagcctggccaacgtggtgaaaccacatctctactaaaaatacaaaaattagccggacgtgatagtgcacaccagtagtcccagctactcgggaggctgaggcaggagaatcgcttgaacccaggaggtggatgttgcaatgagccgagatcacaccactgcactccaacctgggtgacagaacaagactccatctcaaaaaaacaaaacaaacaaacaaacaaagaattgaatgaggtattctaatgattgcttgtacaagaacattcaaagcagcactgtttagaacagccagaaggaggaaacaacccaaatgtccatcaacatatcaatggataaacaaatgtggtctagccacgcaatggaatagtattcagccatgaagagaaatgaggtactgatacaaagcacatgaacctcaaaacattatgctagaaggcagagaaagcatttgacaaaatttgcatcctttcatgattgaaaataaaaaacctctcaacaattaggtataaaaggaatgttcctgaacacaataaaggccgtatatgacaagcccacagctaacgtcattctcagtggtgaaaagttgaaagcttttcctctaagatcaggaacaagacaaggatgcctactcttgccacttctattaaacataggatcagaattcctagccagagcaatcagggaaaaagaagaaataaacacatccaactaggaaaggaagaggtgaaattgtctctgtttgctgatgacatgatcttatacacataaaatccttaaagactccaccaaaaaacttttggaactgataagtgagttcagtaaagttgcaggatacaaaaccaacatacaaaagtcagtagtgttggctaggcatggtggctcacacctgtaatcccagcaccttgagaggccaaggcgggcagatcacctgaggtcgggagttcaagaccagcctggccaacatggtgaaaccccatctctactaaaaatacaaaaaattagccagatgtggtggcgggtgcctgtaatcccagctactcaggaggctgaggcaggagaatctcttgaacccaggaggcggagattgcagtgagccgagatcatgccactgtactccagtctgagcgagactctgtctcgaaaaaaaaaaaaatgtttatatacactaacaataaactatctgaaaaagaaattaagaaagcaattccatttacaaagcatcaaaaaaaatatttaggagtttttaaccaatgagttaaaagatctctatactgagagctataaaacattgatgaaaaaaattgaagccaacacaaataaatggaaagatatcatgtgttcatggattagaagaattcatattgttaaaatgtccatactaaccaaagcaatctgcagattcaatgcaattcctatcaaaatgccaatgtcatttttcacagaaatagaaaagacaatcttaaaaatcatatggaaccacaaaagacccacaaatagccaatacaatcttgagaaaaaaaaaacggaaggcataacactacctgatttcaaaatatatttcaaaaccatagtaatcaaaacagcatgtgtattagtccattttcgcactgttataaagaacttccctgagactgggtaatttacgaaggaaagaggtttaattgactcacagttccatatggccggggaagcctcaggaaacttacaatcatggtggaaggggaagcaagcaccttcttctcaaggtggcaggagcatgagaagagcaaaggaggaacttccaaacacttataaccatcagatctcatgagaactcactcactatcatgagaacagcatagttctcagcatagttcaccccactatcatgagaacacccactatcatgagaacacccactatcatgaggacagcatagttctcagcatagttcgcccccatgatccaaacacctctgtctttcgacagacacgtggggattacaaattgaaatgaaatttgggtggggacacagagccaaaccatatcagcatggtactgccataaaaacagataaatgtaccagtgggacaggatagagagtcataaataaacctacacatttacaggcaattgatttttgacaaaagtgccaagaacacacaatggggaaaggacagtccctccaataaatggtattgggaaaatgggaacattccacatgcagaagaatgaaattggactcttctctcagcccatacacaaaaatcaattcaaaatggagtgaagacttaaacataagaccggaaactgtaaaacttctagaagagaacataggagaaatagttcttgacgttggtctcagaaaggatttttttggatgtgacaccaaaagcacaggcaacaaaagcaaaaacagacaagtgggtctacatcaaatttaaaagcttctgcacagcaaagaaaacaacagagtgaagagacagcccacagactgggagaaaatatttgcaaatcatacatctgatttgatgtatgatatccaattttggctaatatccaaaatatacaggcaactatataactcactaactcactaactaacaggaaacaactcactaacaggaaaacaaatgacctgatataaacataagcaaaggacctgaatagacacttctcaaaagaagacatacagtaggtccttgaataacatcctttcgttgtaacattgatgaggaaaacaaagtcattcccgggccactgtctgtggagtttgcatgttctgcccatgtctgtgtgcattgtgggttttcaccaggtacactggagttcaaagatcagaaaaaaacaaaacactatgctaagtgaaaagagccagacacaaaaggttaattggcatgtctaaatggtcccagtgtgcgtgagtgtgggtgcaggtgtggatggaaatgtaccctgtgatgggaggggtcctgttcatgggttcctgctttgtaccctgagctgccgggataggctccagcaacctaccacccggaactgaaataactcggtaaataattaccttacttgtttatgttaatctttcttaaatgtatcatagcccacaattattttagtgtttaatattagaagtgtttttcatctttatttagaagtttgatgatgtttttgtgaccagaaatatgctgtcggaacttcactcttgttcttatcaattagcctatggtaaaattggttttgttatatgtcatctcgcttaaagttacagtttccaggaagctacgaggacttactgtgaccaaaagatatatttaaaaaaggatcaacctcatgaatcatcagggaaatggaaattaaaaccacagtgagctaccacctcacccttgttagtatggctgttatagataaaaggttggcaaggatgtggagaaaagggaattcttgttcactgttggtggtaatatagattggttcagccattttggaaaacagtatggaggttcctctgaaaactaaaaatagaattacatataatccagcaatctcacttttgggtatgtatccaaaagaaatgaaatcaatgtatcaaagaaatatctacattcctatgcttattgcagcttattcaaaatagccaggacatgaaatgaacctaagtgttcatcaacagatgaatggataaagaaattatggtatatatgcacaatggaatactattcagccttgaaaaaaaggaagttctgttctgtcattttcaacaacatgaatgaacctggaggactttatgctaagtataataattcgggtacagccgggcatggtggcctgtagtcccagcactttgggaggctgaggcaggtggatcatttgaggtcaggagttcaagagcagcctcgcaaacatggtgaaacctcgtctgtactaaaaatacaaaaattagccaggcagtagtggtatgcacctgtaatcccagctactcaggaggctgaggcaggagaattgcttgcacccaggaggcagaggttgtggtgagccaagatcataccactgcactccagtctgggtgacagagagagaccttgtctcaaaaaaaaaaaaaaaaaatcaggtacagaaaggtaaatactgcacgatctcacttacatgtggaatctaaagaagttgaattcataagggtaatgaggggaggaaggggtggtcatactgtgtgaagggagatagtcacactgagggaaggtggtcacactgtgagaagggaggtagtcacattgtgagagaaaaagtgatcacactgtgtgaggggaggtggtcacactgtgagagaaaaagtaatcatactgtgaaagggaggtggtcacgctgagaggggaggtggtcacactgtgtcaggggaggtggtcacactgtgagagaaaaagtaatcacactgtgaggggatgtggtcacactgagaggggaggtggtcagactgtgtcagaggaggtggtcacactgaggggaggtggtcacactgtgagaggggaggtggtcacactgaggggaagtggtcacactgtgagaggggaggtggtcacactgaggggagatggtcacactgcaagaggggaggtgatcacactgaggggaggtggtcacactgtgagagggaaggtggtcacactgtgagagggaaggtggtcacactgtgtgaggggaggtggtcacactgtgaggggaggtggtcacattgtgagagggaagggggtcactgtgagaggggagaaggtcacactaaggggaggtagtcacactgtgaggggaggtgatcacactaaggggaggtggtcacactgtgagaggaggtggtcacactgtgaggggtggtcacactgtgaggggaggtcacactgaggggaggtagtgacactatgagcagagatggtcacactgtgaggggaggtggtcacactgaggggaggtagtgacactgtgagcagagatggtcacactgtgaggggaggtggtcacactgaggggaggtggtcacactgtgaggggaggtggtcacactgaggggaggtggtcacactgtgaggggaggtggtcacactgtgaggggaggtggtcacactgaggggaggtagtgacactgtgagcagagatggtcacactgtgaggggagggggtcacactgtgagggggaaggtggtcacactgtgagaggggagaaggtcacactaaggggaggtagtcacactgtgaggggaggtgatcacactaaggggaggtggtcacactgtgagaggaggtggtcacactgtgaggggaggtcacactgaggggaggtagtgacactatgagcagagatggtcacactgtgaggggaggtggtcacactgaggggaggtagtgacactgtgagcagagatggtcacactgtgaggggaggtggtcacactgaggggaggtagtcacactgtgaggggaggtggtcacactgtgaggggaggtggtcacactgaggggaggtagtgacactgtgagcagagatggtcacactgtaaggggaggtgatcacactgtgaggggacgtcacactgtgaggggaggtggtcacactgtgagaggggaggtgaccacacaggggaggtggtcacactgaggggaggtagtgacactgtgagcagagatggtcacactgtgaggggaggtggtcacactgaggggaggtagtcacactgagaggaggtggtcacactgaggggaagtggtcacactgagggggggtggtcacactgaggggaggtggtcatactgtgagtgaggagctagtcacactgaggggaggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacactgaggggaggtggtcacagtgtgaggggaggtggtcacactgaggggaggtggtcacagtgtgaggggagatggtcacactgaggggaggtggtcacagtgtgaggggaggtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcacactgaggggaggtggtcatagtgtgaggggaggtggtcacactggggaggtggtcacactgtgaggggaggtggtcacactgagaggaggtggtcacactgaggggaagtggtcacactgaggggaggtggtcacactgaggggaggtggtcatagtgtgaggggaggtggtcacactggggaggtggtcacactgtgaggggaggtggtcacactgtgaggggaggtggtcacactgagaggaggtggtcacactgaggggaagtggtcacactgagaggaggtggtcacactgaggggaggtggtcatactgtgagtgaggaggtagtcacactgaggggaagtggtcacactgaggggaggtggtcacactgaggggaggtggtcatactgtgagtgaggaggtagtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacactgaggggaggtggtcacactgaggggaggtggtcatactgtgagtgaggaggtagtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacagtgtgaggggaggtggtcacagtgtgaggggaggtggtcacactgaggggaggtggtcatagtgtgaggggaggtggtcacactgaggggaggtggtcacactgagggaaggtggtcacactgaggggaggtggtcatagtgtgaggggaggtggtcatagtgtgaggggaggtggtcacagtgtgaggggaggtggtcacactgaggagaggtggtcatagtgtgaggggaggtggtcacactgaggggaggtggtcacactgtgaggggaggtgggcacactgtgaggggtggtagtcacactgagaggaggtggtcacactgaggggaggtggtcacactgaggggaagtggtcacactgaggggaatggtcatactgtgaggggaggtggtcacactgaggggaagtggtcacactgaggggaatggtcatactgtgaggggaggtggtcacactgtgaaagaagatgatcacagtatgagaggtcatccttcaagaggcaagtgcccaaaaatctgtttataatctagagcaatatttgcctgaaataaactttaaaagtggttttacgctatttaacccagtgtcagaacagcagcatacaatatgagctcaaaatcttgtataattttagtaaggtaattgtttttggttggtttgatacaattctccagaaaaattaaggaagaaagagccaacctcatacacattgcagaatatatccacgaggccttactggtggcacccaaagttttcagaacctcccagtacttagttgtgagaatcagttgctttttccctatcactgcctttattgctctagtttaaatctgaattcctgcaaccctcactgactgctctttccaatgtgtgcataatctccagcaccccgttgtgtcttgcttagccaagtggcaatgactttatgcctccatatagcttgagtctgttttcctatctataagctcttatcactagtaagttaataatccaacaaaaccctgcaaggaattgccttttctattcaaaatagaaggaattattggaagttgaaataaatgtaccatcagagtccacagactcttgatctagggtgatgttcaagaatcacagtgtttggaaagcagccagctcaaccctgggggatgtgctttctagaagtaccctgctctggagggcagatatgcagtggtgaagcaaatatagcagatgttaactgtggagtccaggtgcaggtgtgcaggtgttcagtggacaattcttcaacttgtctctgaaaatttttataatgaaatgttaggaaaatctctactacactgtacctatgtgcagcataagattctcagcttcaaacaactttattctttctgagccctacctttttaaatatatcaataaaatttgacttgattgtgaatttattctaaggttttaaaatcccacttcttgggaattataagcaagaaaacttttcatataggacctttcaagtaaaaaggtttaatcactccttttttttatttttaaatttttttatttttaaaacagaggcagggcgtggtggctcatgcctgtaatcccagcactttgggaggccgaggtgggcagatcacctgaggtcgggagttcaagaccagcctgaccaacatggagagaccctgtccctactaaatatacaaaattagccaggcatggtgggccatgcctgtagtcccagctacttgggaggctgaggcaggagaatagtttgaacctggtaggcggaggttgcagtgagccgagatcatgccattgcactccagcctgggcaacaacagcgaaattccgtctcaaaaagcaaaaaacaaaacaacaacaacaacaaaacaagtatgatctacagatgatttttatctgaaaatgaagggcttgaaatgactaacctggatgactcttgaggacattatgctaagtgatataagccagtcacaaaaaaaagtactacagggttccactcatatgagatgcctgcgtagtcacattcatagagacagaggtggtttccagggcctggaggatgggagggtacggagctggtgtttaatggagacagcgtttcagctgacgaagatgagaaagtcctggagatggacagtggtgagggttacacagcaatgtgaatgtacttcatgccactgaactgtacacctaaaaattattaaaataagacatgttgtgtatactttgccacaattaaaaataaattttcaaaagctagaaaaaaaatgaccatccttgcagagctgactactgttgttttcattctcatgaaactgccgttacaactgtgcagggtccaattaatttctgtatctggcctcttactgtgttttacaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcattcctttccttccctgacttatgcctgtagttttctatcatcccagtaggtggcacacggccgtgtgcctctcttctggggcaggctcgctttacaaatcccaggcatgttcctgtgcagaataatccatttcagcaataaaatgagatcatagtgtgtaaaacttg

SEQ ID NO: 2010 - DNA, 21680 bp, Homo sapiens
attaaacttttactatcgaaaggatttactttggtggagttgagggtgggagagaaatgaatctttatgttctcctgttagagaatagcttttttccttccagctttcacactggcacatgcttattacaattctaccttgggaacatgacagaatttttttcttatgcattcatgcaacataaacagataattctaggaagactgtgattaagtcacttgcattctgacctattattttcatctctccctgactctgggtgagccaaaggctattaagatgatgttctcctgctcactcactaggcagacctctactcgagaagtgatctgacaccgcagtagctgatgctcgtccagtgactaaagcagtcaggctgaaaacagattttatctcaacaacagtcctagtttcttctgtcctcaaacactgttatttattttcaagataaaatttagtaacaacattacgaagtagcttttattcccttgggtgaataagatgtgcacatttaataataaatttgcttactaaaggtccttttaggggaaaacaaccttaaaaatacagttctagtccttgggcagtgaacaaagaaaaaatgtgcttgagaaacacagtccaggttaaaggaaaactctcagatcggttaatgcagttgaatttttgcttgagaatgtgagcaacgtatcagcaaatacattcattcttgtgctactcttcattatttagcatagagctaccttaggtgtttctacacatgctctaaaccaagagtaagtttaacatgtcagcagtgaggagtagacattttctactatagcacactgggagatgtttactggtactctaggtagaaatgactccattgtccactaagtttgggaaataaataatatggcaacattgctactggagatacataatgtacagaagcctaactataaagagatttgattaacgagacttaagtcttagtccagaatttcccaaatttatgtgaacatgggacatcatttttcatagcacacacgtgaacaagccattattctttaaacaaggtattacaaactcaaccactctggagaactgatgagcgcctaactgaaattattagactaaattcttagtaaacaatgttttctgaaccttgttcagaaatataatcactgcaaattattttccaagtgttgttctaaaaaacaatataactggacactagtaagaaagtaaggtaaattattaatccactcgcattcaattctacaaggaatgaaaccatttttaaaagtggcttagaacaaacaatttactgagcacttactatgcacccaccaggtatattccttttataatgtaatcttcaaaatgagctgtcaaactattggcccattttgtgaatgaggaaaatgaaaattaagttatataatcatgagtggcagagctgggaaatgaactcaagtctgtgactctgaagacatgaaaaagttacacatttcagatgaatgcataaactatctttatgggtatgacatgaaaagtaactgtagaatgttaccttaattacatttcctaatgcatgatgtggacagacattagaaaagtttggactcagttggaaaaacaaatccagcagttaaaaaagtcctttacttgcaatccctacccctagctaacccaagagcatttaaaaaataacttaaaaagtagccatcaaagataccaatcaatttcttactggtgaaatatataagaacttccaggagtcacaagagttccaaacaattaatttataaaaataacaaaacatttgtctatgaaaaaaagatcaggattcactctcatcgacgtcctcatctggatggtgctcagcatcctccttttcctgctgctgtttcttccacagtttggccatggccaggagtttgaggttaggttggttggcagcatcttctggaaagatgtaatcaaagtattcttcccagcctgcatcagactacagaaataaaaaatgaaaagataagcaaacgtgggtgatatactcacatatcagagtgaagaatttttactggaaatccggatgattacctccattttacaaaataacatcaaagtctactacagaaagaacaagggctgggtctgaaagactgggagtgagtaagcagcaactgtagctcagtgagaactaaactggtagaaaaacattctaaaaatctaagcacagctcctctatagccaaccaagatgttcagtgtctccaactacattgtgcagtcttacacttaagaaaacgtttaacgatctttacataatattcacccagtagcaaaagccatacatctgtgcattattattccaactccctaccttcccatcctcacctcctatcagtcactgatttcacttcccaaatattgttctaacaggccctgtggccctgttctagttccagcttccatgtcttgctcagcttataaaaactgcttcctgatgggtcttctttctccaatctaagccccttgagtctgccaggatgagaggctagcaatctggtcacgtcattttatgcaaaacagccttcactgactcccaccaaactccttcttaccgcctacaagccttctctggataggctcctatctgaaagttcagttccatcttcctccacacttacttcctattaaatgctctaaaaatatcacacttcatgaagttcccagactcaaccatcaccaaaacacctttgccaaccccttcccgttctccacctctgactggaccatatgttctaccccgtgtttccataacagccagattgcaaccatctcctactccaggtggtctgcttccattctaagattgtacatatgccacttaaaagtccacatttcgacgtcagaagtgtttctactcatgtgacgtgagatgaacagtcccagggcagagttcttaccccatcatcagtctggacctttcttctcttcttgactttctctggcatgagtttgtctactctctccttatctgaagctgttccaaattcttcttcaaaacttcgccaagattccagcagcataagtctctcttccttttcttcacagtttcgcatggttttgttagcttcttcataaatttgtctgcatttagtcaaacttccttcttttcctgaagacaactcaaactgagcaaagctgatccatacctttaaaaaaagttattattgaaccaaattaaccatatcactcagaagataataatgtagtaataataaagcgaattcccagttaatgacatcggaaagtaatgtgtgcatcactaatgtttcacagatgaaaacaatgaatatatgcttcaatataaacactgaaaatatttgattctacattctacaattaaatgtctgacatagtcttaaactcttgaaaagagtttaacttggctgggtgcagtggctcacgcctgtaatcccagcacttcgggaggctgaggtgggcagatcacgaggtcaagagatcgagaccatcctggccaacaggtgaaaccctgtctctattaaaaatagaaaaattagcctgggcattatggtgcgcgtctctagtcccagctactctggaggctgaggcaggagaattgcttgaacctgggaggcggaggttgcagtgagccgagataacgccactgcactccagcctagagacacagcaagactccgtctcaaaaaaaaaaaaaatagtttaactttttttcaatcttgtgatacccaagctactcacatgcagcataaacaatgacctggtataaacttaacattccaaacattccaaagtcctctgagactcacgtttctcttgaaaagcaaggaagtcattaaaaaaaaaaaaaaaacaaaaacccaaacacttaaaatacagaaatatatcattttcttctggactgctgattcaagcaaaatgaaagatcatctacaaagcaaggataccttgacatgctgcgtccgttgaagcaaccgccggtaaaggtttcgtgttctttctgtttcttcctgctcaatttcaaaatcaatatatgatttccaaagcacctaaggaagaaaagtaaatgggtcagtcttgacatttacaaagcagcatgcccccatccaaagcacagctgaagtatcactctaacctacatctaggaacataggatttttactgaacaactaaagaacacatgtggataagataaataacattggtatctataagctggccaaaacttggctagaattccagattacagaaaaagggccttggattcagtcttagagattctctttggaagtttttcaaatgcttgacttatcaagagctgagaaacttgccaagcatctcccaggtactccatattctagccacacgcaattgagcgtccagagagaaaacaggcccaggttagccagtatgcatgttcttacctctactgtacattccttgttattatgagagttcagtgcaacaagcattcactgaacaggtgcgcactggctcggtgcagcctggcagggaataaggatgaataaaccgtggcatggacacctgaaagctggcagtctggtggaggagccgaggacaactgatgaactcagtgatacccaaagccctgccttaattaatgcaatcagggggccaaaccattaaatgcagggtcatgttagtgcatgagattaacaaaacggctgggtgagttctacgactcatgtgagattcaaatctttcctagctgtggtttggtgctaccttgtgggtcaagcttaactactgaaggcaggcgaggactttcaggacagtgacaacagaagttgcaaggacatcctggtttagagaatacagggatgtgcagttcctacctccatccccctcgttctccgggtgggccagcctgctggcttcttccttgcctggcctcttccccagcccctttaggctttcctgctgcagaaggggcgtcacccacccccatgatatcccagttcatcctgggcatcatcctggatgtctactgctctggtatctaatgagagggctacttcccctgtcccccacagccacctttccacgtacaagcctaatctgagtagaagagactaagttagttagatcatcgttatactctaaaatacacccacatttagatggtcatctaaagtaagactaaacacgtatctcaaacaaaattatatttgacttgagatgctcacctctggcatgtctaaacgtggctgactgatggctaattcatagattgcccgtgctctgtcaatatcaccaaggattgtctctaattcagcgaatttaatccatgaggtacaattttcaggtccaaattccaggaacttttcataaagcttccggcatctgtcaaattctcgaagctgtagctccaattctatgtaaactttaaataatttgttctttggacatttgcctatggaagttccctggaaaataaaataaccagaccactgtgatactgtagtggatttaatctgtgcagttattgcactgccctagaggctgttctctgctgaggaagaatcttgcaaagtcaacatggcctaccattctttccctctgtggtatcacaatgtttactggttcttgacaaaaggctgaaggaaactcctctaattcactcagcaagaggcagtgttccagaattgtttgggcaactaaataaaataagatttgaaagtttctcaggatctcctagggaatagggatgtcaaatgcataaaacctcctataaataaaaaggacaaggcatggtggctcatgcctgtaatcccagcattctgagaggccaacatgggaggatcatttccgcccaggaggcagaggttgcagtgagccaagatcgcgctactgcattccagcttggggaacagagcgagaccctgtctcaaaaaaaaaccaaacaaacaaaaaaaaaaaaaagaaaaaaaaagtggaacaattaaaagtgcatttaacacaccaaaaagtttgcacaggatcagattactaattccagtctgtggaaagatttagtaactggtagctatagaagtttccaatattgaaacagaatgttaatttgccccaggtaataagaataatttacgcattattagtcagtgtttttacagaggacgcatgttttctaacatgtcccaggctataaaggtataatacttctgtcactctttaaagtaggaactgtacaacttccaagcaccaagattttaatttctttctcatagaacttgatgagacatcttgatcctttctttacttaccaatgctcttctggctaatgacagattcttctgtcgtatttcaaactgtgcatacagtatccacattttggcaaatgtgaactagaaaacaaaagcacaaaaatatctagcttaaaagcctcatccaaattaaattgaattaaaattaatttaaattaaccaaagccattggtaattcgatttctctaaaacttcagagtaagaggaatgtactctgcttatttacaagcaaagaccacattcatttcacaaaagttagaaacccacataccatgatccagatactatattgtactgcatggcatggtaacctctcctgagaaccatgatccagatactgtactgtactgtatggcacggtagcctctgctcagaacagactttgttttgtaggcatgcttgtatatgggcagaatgtcctacctctattctgaaaagtaactcagtcaacacttctacagaaggaaacacgttttgtttctcgtgctgggaaacaaggcggaggtaacatctcaaccatctacacaaggggcacattcatctgtgcatgcacacactcactgttaccaacaaacccgcctgtgtgtcccccgcacacgttgtgtgctctctgcatggatgtctttctccttccactcagactattcacattacctagccttctctgaatttatattatttgtttgtcaatgcaggttgtcctccaacctagtctgtgagctgttttcagaggcaaggagcatatctcagtcttatttatgttgtccatggtgggacagggaagcattttatcaatcaatattatttcactgaattacttcacaagtaacagaagaggattctgacctgtttgaaatggaacactttagagcaaacatacctttttgtgaggaattagttccaaagaggcttgatacacctgtcttgtcctctcaggatcctgtattaggataagaaattttcacaaaatattgaagtctgctgctaacactcattttactagttactaattttactgatattggtaaaaatgtacacccccaaaacagcatgtttcacaagttgttacttgcaaaccctgatttatgatctaaagtatgaacggccatgaaacttcagtttaagaatcaccaacaagatagccaccaaacttctaagcccttctttgtagaaagccgttttgcctgatggcagaaagaaacaaagatgtttcatagtctcagatcaaacccagaaggttaatacaaatgatttctgaaaatgccacttgatttttgctaaaagcaaaaatgcataatctagccagaattactcctattaatgagcaaatccaggaaactatatttcactaaattaagggctggttcactgttctctttcaagctccaagtgatatcttgttgtgcctcaagtaaaaatcaaaccaaagttaaaaaagcccctcacgtgtggccacaacaagcacagagggtttaaaatgttgcagagcgaatatataactgtatggatgaacagaagcctataaaaatttaaaactaaatttccttctttcaagaattacaaacatccacaataggtgagctgtgaatacagaagacaggaaaccattatcagctgacacataattctgttttttcacctttgcctccaattcttcatagagtgcatagttgatccaaagataaatgtagcgcttccagtgcctcttctcctgaatgggtgggacattggcaatggccctttcatagacttctctcacggcttcagcttctgcgtcactttctaccaagcgcaagtaatcaaaccatgcatcataattgtgtggattcgcctagaaagacaaccagtttaataaataaaaaacaaaaccaagagctgcacttgccaggttaagcaagctgaaaaaaggcatcaggctgactttctatattttagcaccttttcttctaaatgttacatgttctttcattttaaaaacaccatccctgagactgcataaatagaaaagaaacaggaatacagaggatagattactggccaggtgtcccacagcaaggactccttcatctatagccatcactctcacgacagtcaataattagatgcctattcttgccaatgcatttgcttaaatatgtgactatgtatcattatgtctgtaacaacagaatcgtatcatgctcacaattgttaaacttgcctttccaattaatagcaattcatctttaacatatcttgctaacctaccaccacatttaataacagacttagtcctttgcttggaggtatcttaattaacttgactaaggaagagtatttttaaatacacaacagaatactgaaggaaaatgacactctctttgaattgaaatcaaaatagtacattacagaaaaagagatgccgatggaaccctgtctagcatacatcttttgttcaggcagttaagctcaaaggtgatgtgcaaaacaggtttttggaccaatctctgactcttccaccttcttccaacaatgagctcgaatggattccacatttcttttgctccagttctacatacagtcaacaatcaacaaaacgacttacaacatgtaagtggcagagcaaatccaagtgttgtttgcttgccttttctatcagccttgtttattcctacttgtctgaaatagctgccaattggatcacgggcacatcatcacgagagtaatcactagtagtgctacttgctattattcattttagtgttgctagtattgatgagcacatcttgggttatctgcagagttgaccatccacaccagtgctcaccttcacttcttcttcgtactggaatctccgtttgctcacaatgatatcttcaataccccgcctatcaccaaacttcttctcaaagatggtataatttttaaagagttcttgggcatcttgttttgaaattctgtccagggcatacttgtaaatcactcgtaccctttcaaactaaatgcagacaggatgattaccttctataacacaatattctcatgccagtcacaactaggagagtaaatataacaaaatattacttataagttagattttgaggcctcataatatccagagtaagatgcttttctccctcttgttgaaggttatctctgtcaggatggaccggtactctgctttgagctccatatttaatactgtctacctaacactgccaactggatgtctactgcacatctcaaacaggtccaaaactgagcttctgtttcctccccactcaaactgggactctccccatcttcccaattttagtaggcaaggcctaacctacagtcacttgctcaagccaaaaccttcaggtgatcctcaattcctcttttttcctcatactccatattcactcttgcaacatgccctaccatttcaatctcttccacacagccatttgcttctccccagcccccagccatcaaactccactgttcacctggcccacttcaaaagtctccccactggtctcccctggttccacttttgccatctaccctcatacattctccatgaattagccagaggctctccttaaaatataaatcatatccaatcactgtcccgcttaaaacctttcaatgcttcccactggcccgaacagaatctgaactccctagcatggtccgtgcaagaccttatataggttgagtatctcttgtctgaagcatttggtatcagaagtgttttggatttgggatgtttccccagtttgggaatatttgcattatacttactggttcagcatccctaatccaaaaacccgaagtctgaaatgttccaatgaacatttccttcgagtgtcatgtcagcactcaacaagtttcacattttgagttttggattttcagactgggaatgctcaaacctgtatttggatggatctcaattctgtattatttgaactccctttttttttaagaaatggggtcctgctctgtcacccaggctagagtgcaatggcacgaacatagctcattgtagtctcaaactcctaggctcaagtgatactcctgcctcagcttcccaagtagctgggactgtaggtgtgcaccactatgcccactcaatttttttttttagagacagggtctcactatgttgcccaggctggtctcaaactcctggcctcaagtgatccttctgcctcatcttctcaatatttgagctattttcataggtacaagggaaaaaaagaactctcttatttgtagggcaatctctgtttccattctaaatgttttctgttctagggctttaagctttttgtttcccatatttattatcggttaagtcctttacttaggatgccaaaagactagttctcagtttacgggcattcagactaaaaggcttaattttcaaacaaagcacaataaaattaagacagttataatacaatctataatcagctcccatctgtagcttagtcacatatatatgctgttctctgtgagaagctgtgtttttgtattttgaaaacatctttccagggatatgtcagtaagaaaaaatggaaatgaactcaccatgcacaaaatgtaatctttgctaagctgttttacagtataatgaagttaggtatacttacctctttctgattttcttcaaacttggcaaaggcaacataaaggtgctcatccatatgttcatctccaaagaattccacagctctctcatacactttccgtgcatgggcaaaataagcatgtttttcttcaaagcgggcatacttgatccagttcttaacatcagggtgcacgaggacaagtgcaagggaattaaggaaatcccaggcaaaacagcatggcttaaaaaaatagtaagtaagtaaacaccaaaaccataccaaagcctggaaactccaaaaattcaaactacaactctaggggaacaaaacacatacaaaagtgtagaattaaacagtggcttctgtgagagcagggccacgcctgttcatctctattttcctccagtgcttagttaagattttagtggtgggtataaactcgagttggaagcaaagaaaaatctcaacccaggttaccaaccatgtgatcttggataagtcactgaacttagacgtctaagtctcagctgtttcatttgtaaacagggaaaaataatgccagcctcactggattactgccagctttaaatgagaaaatgtatgtaaagcccttagcacagtttctagccaaaagaacatggcaccgtaagcggtcaataatggtctggtcattaaatagcaccaattatattaaaatatgaatacttgaactaataattaagaaaaaaacatgctataaaaagaaaactgttaactagagtcaaagcagaaagttttgaattgtcattttaatctatcttccttgaataaatcattaatttccaaagtagtaatatattccaatatggcaaagaagagcatcagttctgaagctgctctactaggttcacattctatttccatcagcacctgtgagaacccagtcaagctacttaatctctcatgcctcagctccctcatctgtaggacagagaagttcctacactgcaaggatgttatgaggattaaacaacaatatctgtaaagtacttagaatactgcctggcacgtagcaagtgctataaaagctttcgtcaaactaataatattaaaattagtagacataattaagatcttaacattgtcacctcaacagagaagagtaaaaaaataaaaagatcttaatactgcataataaagttgactctcattatttctggtagttatgttctatttagtcaatgcgaacacttaattattgagtactgaaccactgctcctaggagaaacgtgtatatatacaatctcacattcatcatcatcttaaatcctaaaaagaactcatcctggcagattctatcttcattattttgtaagaaaagtggttcagaaatgttaagtgactggactgaggctgccccactgacagggattcaaactccccgactggccccagagccacagctccttgcactacatggcactggcccttcctgtctccaagctctaggcatggttatatgaggttaagaccagaaggcaagcctcaccttgttggacttcatgctctgtgcatgtccacaaatgactgtgaaagtgccacaattactgattttgggggttacaaataaattttagcaaatacgtgattttgcaaacatggaatctgcaaatagtgaggaatgactgtacttcagtttctaaaagtgctttcatgtgtatcatttaatcttcgcaacagcccaacaaaggtgtttttattcttgtttttaagaagaggacaccaactctcaaaggagttaaatgactctctggagccacacagctagtaaacagtaaaccttggatgaactccagtaaggtagtaatgaccaacacaaaccttagaaaaacaggactggcaatggcagccaggaccttagtacagttagtcctccagccatgggttccatatctgtggattcaaccaacctgagataaagtattcgtgagaaaaaagtgcttctgtattgaacatgtcgtttttttgcttattattccttaaaatatacagaataacaattatttatataacatttacattgcattaggtataagtaatctagagattatttgaattatatgggaggctatgcataggttacatgcaaatactacatcattttatatgagggacttaagcatcaccgattttggtatccccttgagttcctggaaacaatcccccaggaatatcattttccacaaggaaacattagcttttagcattacaataaaataaacccaaactctcactagaaaagactagttacccagaatacaaattttcattctgaccaatctctttccctacaaaacatagggaagctgataaactggcattcttgactttgagcctgacattaatgactgtgtgtcctgatcatgagacatctctacaggagcagcagcagcatccaggacaatcatggcaccatacagatctcgtccaaaggatatatcgctcataaatggtgcgggcccgatccacctctttgtatctcagctcaaagttgatgtaggagtgccaggcttgctcctcaggctgccactccatccagcgctcaaacacctgccgggcaccggcaacgtttcccaacatttcctccatgtacgtgtacttgtacctgtaacaaaatcacccgaaaatatctgctgtggtttagttcttccattgttgaatgggaagaagattgaagattttacctttcttaaaggttaaatcaaacatgttttgtcatttgtatgtaaatctgaaaaaggatgaaccattggaaaaaaagatttttttttcttaaaagttgcctagttcaacaagaagcttatgaataaaagattgcaatcaaaattttagttttgattacatagctatagaacattacgattatgacttaatagactatgggacataacagcatttatgtctgaagaaaaagtaggatatcaaattaaactatcatcatgtaaataaaataaatacagaagatgtggaactttgctagtctataaaaggctgttttgttagatcagaaacttaccagaactgattaactcgaggcagcgttgttatggcccggtcccagatatttcgagcatggttgacttggcgattcttcatttccatttctgcgtatttcagccagagtgtaatatttcggtagtctacatctaaagcacgctcgtatatggatcgagcccttaagaagcaagatttgcagggcatcaaaaatagagcattcaacacatgtagcagttatttcaaactatctggaatgcactgatgttttattaggtgtctaccatgagccaagttctgggcataaaaaaatgaaaagatataatgctctcaagtaccttacaaagtcttataaaaagacatgcatgcaattataatgcaatgtgatttatgttatagtcaagatctgcacgggaaacagagaggaagaaatgaaaatgtttggtggaaaaggctaagtagtaggtaattgtagaaatgagaacttgaggaacgttccgatttaccaggaaactaagtttggtgaggagggggtgctcattccaggcaaggagaacagtcaagcctcacgataaggagacatgatatattcagggagtggcacatacacaggcacagtgggggaaggaggtatgcggggagaatgcagaaagctagaccacaggaagggccagattgcaatttttattttttttggccattggttttattttttttggccattgtttagctgaaatttgtaaaaatctcaatatatacaaagcaaatgaaattgtgcttctttagctacaactgacaagatctatctctaaagcctcttctgccaccctccccaggactattctaccccagtactcctgaggccctcaagggaaccctagggttccatggaaccaaagttgaaaatttctacccgaggcacaatcttttacctgtgctttaactttttcttcttttctttttggtatctgttaatctatgaatcattatatacaaaactacactctcagtaattttacctttgaatctcctttaggctttcttcccattgtgcgtattttatccagttactaatcacagtcctgttttttcttatattatcttcaaaagtctggaagaaggcaaaaagggtcaagtcaaaagacaaatgactaaaaatgacagcacccttggtctattttaagtcttgtactaaaatggttattcattttgttcatatttaagagaaattacatcctggaatccttgaggaataagaaacccactacagaaggttacagtcaactaactgatactttaaaatggtctatgcttgtccctaataaaaaatgtttttgactattacctttaagtcctctggtaattctcagaatttcatatataacagcattagtgctttaaaacagtcccacattctagagtgaagaggtcaaatcagatcccaaagtcttctcatggtccttttgcagacctcaattccttttcctttctttctttctttctttttttttttttgagacaaagtcttgctctgtcgcccaggctggagtgcagtggcacgatctcggctcactgcagcctctgcctcccgagttgctgtgattctcatgtctcagcctcccgaatagctgggattacaggcacctgccaccacgcctggctaatttttgtattttagtagagatggggtttcaccatgttggctaggctggtctcaaactcctgacctcaggtgatctgcccgcctcggcctcccaaagtgttgggattacaggcgcgagccactgtgcccagccagatctcaattcttaacacagaaggtggtatagacagaagtacacagtgcagccttactaagcataccctccttcttgttgtcagttgttccatctgctaaacttccgctcactttgattcagcatcaaaaattatgcagattcaatttctttacactttaaccagacaactcatggcatattttatatagttcagaaaaatgctgttatctggtaaccagaagtacattattcatgcgtctggaaacacttaacctcatcttgccctacagaatccaaccaatgaggagcttttcaaactgaccgatacagtcttaacaattagtggactgaaagataccacactgactgaccttccttttccttagtttataatcatttaattcttcttcatctgtgatcttctgttgaggtggaggtggaagaagctcaagttctctttctttagcctctcttaagagttgttcagcagttatctgtacctcagccggggctttgtttttcaccttttaagaaagaagacatttctatttttagtagttgctcttcacacaaggcttaagaaacaaacatacattttttaggatatgaactttgttagtattatcacaagatgccctttttgtatgacatgttcccattcctccatgagactgaaaagaaaaaaaaaataccgttttctctcttattcatagtatctactgcaaagccataggtaaaagtctcaagagaaaaaggtggcaaaaataatagcaagttttcccttttagatgagtataataataaactttgaggccgtctaggtaaaattctgaccagaggttttgttttatcaaaatgtgtagcacatcttattaacagcattacaacctgcatttacagaattcttcaacttatttaatgccccggtgtataactgggtttggttttacatggcacttcaagtcaaaggcaatttcagtaagttctcatcattagactgtaagcttcttgaggtcttagaagcttacagtctaacgtagcttagagctgtgctgtccaacacagtagctatgagtcacatgtggtgagtacaaattgaggtggactgtaagtgtaaaatacacattggttttgaagatgaagtataaaaaagaataaactacctcattacattttttataccgattacatgttgaaatgataatattttggatacattagctcaaataaaatatatattatcaaaattaatttcacttttttgctttgtttttactttttaatgtagatatgagaaaatttaaaatttcatatgtggtgtgcattatatttccattggaccagtgatgcccaataaaagtttatgtagctgaattataaaaaatgttacttaatgccacatgtggagtaatgatgataatggtgatagctcatatttaataagcactaagtgccagacacagtgttacttgctctatatgcattactcctgcgagtcagacaaatagttatgtaaaggtccagttcaagagagtcatccgggctcaagaaagactggagggagggtatctgtaaaggcttcaaagtctgccacatattaagcacttggtaagtattagctatcaaaggaaataccagatagtaagtctactgtttaattaacttatgatactatactactcctaccgtctactctcgccctccgctgtcagctgggctaactcctattcagccttcaagtctcagcttaaaggtcatttcctcagcaaaatttactttcaggaccccttcatacgacccccttattcacgcccatggcatattctactttgcctctcggtaacatctagcaaggtcgtctttatacagaaactcgtgttttgagtactgcttgtggccagcgtacgagcgtagcttcccagcgcccagtgcagtgcctggctcagtaaatcttcaccgaaccaccccactccactccccagcaaaaccaccccagaacgaaggccacgccaacgcgggtcgtgctccgcgatgacaagagcccgcgccccaccaccagctgcccttcctctccatctctcagggtgagccttctccccggcgggaacactctctcccaacccgggcaccctcagggctgagggatgcccctttcctaggccacctcctacaaggcccctcgcgatcgcctaccttggccactttgggaatccgctgcttcccggccgcggtggaggccgccatgtctgcagcagtcgacctctggacacctgtccccggcacggacgctagaaatcggctctgagagctcaccgaaaccacaaagctttcagaaaacaaacaggatctcggaaccggaagcggaacttgcaggactgacctttgacctctcgcttgagccgtgacggaggcggcaccgtttccatggtgaccaggctgcgcgtcctccttgcggcagcgcgtggagtgcggcgtcctggagctgcggatgaggtgggtaacgccgtgctgactagcagcgacgcaaggactgcggtgcagggcgtccagggcgcatccccaggtcagcctccggaactgggatgaccaggcgaggacgagtggctctgtcgagccgtggcgccctgcaagggagtaagaacggagctccaatctggatgctcgagggcgggggaagaagggagagcgaggaaactaccattcccagcatgcgacggggcgagctgccgcccttttaggctgcaatgcctcgagcattgcattctagtagtctctgggtccacgccccctcgtttctggtttcgggacagttgtgcccaaataattctaaggtgcccaaataattaactctaaggcttggaattaaaaataacagaaggtactttgaagccagatattaggaaaaaatataaatagagtaactggaaaacaactcagtcttgtgataagaaacatgtttaaattctgtgtgtgccttaattactctagttaaattttcttagcctcaatgtcctcaactataaaacaaggctaataacatctgtttcactaggattaaagacaaatgctcagtagatgttagctgttataatacttaacctgccctcaaaaactgaaaagcaaaggttaagagaattttttttaatagacatttttagagaagttttaggttcacaacaaaattaagtggaagacacagagatttcctccctccacagcttcctgctatcaattattgtacctcttccctcctctaacagcctccaactcttaaaaatatcctccaccagagcagtacatttgttacaatcttgaacctacattgacacatcattatcacccaaagttcatagtttatattagggttcactcttggtgtacattctatgaggttggacaaatgtataatgacatgacttggcagctcatttgttaggataatttccacagttgcaaagctcttttggtgtttggggaaaatatatatttatgtatgtagtaatatcacgtctaccaatgcagatattactttcaacaaaagatttatgcagatttctagaactgcagtcagttataaccaacatcaatgtatttgccataactctttattaaccatattatttagatattttatctcacttttcaaaatttaaatagagaagattttatatcactttcataaagccacctaacaaaataaataaatattaaaaagatgtttctttgaagtgattttccttaaatgtgttactgtaaacaattgatttaccaaatgaatcattggtttaatcatctgttgcctttgctcaaaagtacaaacatgctagaatactttgcttctgatcaccatccttctctcttacatttctgttgtctggcaattcagttcatctctgtgtgtgttttttttgtttgtttttttttttttttttttttaggaaaaatgtattatccttcttactttttgccatcaatgcttttgtagatataccttcatgtttaccttcttatttcccagcatttaatcttgtattccacttctttctgattttattcttctcagaatataccatctcctagttctttctacaagattctttgaattctttcagtctttgtatgaaattgtctttattttatcttcattttaaagtgattgtttaggtttatcagtctaggttaatggttattttttccttttatatttttaaaacactattctagtagttagaaaactatgggccgtagactaaattcagcccattgactattttgtatggactgtgaatgagctagggatatatatatatatatatacacacacacatacatacacatatacacacacacattttacattaaactttatatgtagtttacattttaaacattttttaaaaattacatggcacatgaaaattatacataagtcaactttcagtgtatgtaagtaaaattttgtgggaatacattcatgctcatttgtgccgatattgtctctggttgttactgtgctacaatggcagagttgactagttgtgtagacaacatgtggctcataaagcttaatgtatttattctctggccttttacagaagtttgctaacccccgtgctactggcttctaatgttgctcatgagaaatattctgtcagtctaattattttttatagacagtctgtcttttgtcaggttcctttaaagttttctgtttgtctttagggttttgtagttttactatatatttggagtttatttgtattttttgctctgaactgaaggttcatgtctttcatccatgctaaaagtaattagccattattttcaaatgtttcatttattccttttggaattcccataagacagatgtttttcattctgtcttacatgtgtctttactgaattctgtattttctgtttctatgtgcttctttctagataatttgttcataagtatcttccagtttattttctttattcttctgtttttaacccatcctcttagtttaaattttaataaccacgtatttcattttttaagtttctgttcttttttaaataatgacctgttctcttctcatgacttttgtttctctttctatatttctttattataaacatacttagtttgtagtctgtttcagagtctatcatctaaagttcttggtgactcccataatacacagattgtgtggactagaatgccatacccactttagtctagaatttggacttctcagcagtatttttgctttattttctacctagagctttgtgtagagaaagcttgtcactttcttgggctggtgagtttaatttttctagccccctcacttaccgaggggcccatccaaagtcccaggtagatgcatggtttaatttttaattctctgtttggagtgaggtccattctatccccaaaacctgtgtcagatcggctcacatcattgccacctggttggagaatttccctcgctcgctttctttcttcttttcttgttttctttttaccaaagtcagttatctaattaattatacttccttattttattcagaatttttatatacttgtagcattagtttatgatatgtttcacaaacaagatgtctcattccaattttgctttcaatttaaaaccagaacaaggaatgacaatatttatggttagcttcgataggagtctagacattattaatttctccttcattgttttccctgttttgagctcactggctagtatataataaaatggctttccctatgaaggaaagaagggagggaaagagagaagagagacttacagaaattgagacaatgagagagaaattgaaatcattttgtgacctactgtttttgtcaacagcatttcccaaagtgtccttctggaacgttaggttctccactgttgccgtcattagagattctcttcccaaagagtgtcggaaag

SEQ ID NO: 2011 - DNA, 269658 bp, Homo sapiens
tgaataatctgtgctttaatggaaaaatgaaacattaatttgtttagtttctcatacaacatgtttactaaacatttcagtgtcaataatttcttaagattgtaacatttaaccttgtattggagctaataccaattctagccatgggagtatgttttggactttttgaacaattttaagtaaaatgaatgtcactgtctttaaattgtacttggagcaaagacaaagaaacatcagctcattctttccaactaatagaacatttaatgatgcaatttttattacattattttaaggctattatcataatgttaaatattcttatttttttttgcttccgtctgttactaaagctcaatacatcattctgaacattattaattttcacttaacttagatttaagtattgaatttttaacttgggctccaggaaaaatcctgaaaaagaaagatcagcatctagcatccttttcctattctttcaccacaaattctcaatttgatatgacttaacatgaaatctgtattgggaagtatagatttctaagataactttttgtaactaaaaaataatttcctgtgcatcacaagggggattaaaaatcaccaaagtactgaaggaacacgtgctttgattattattcccacctgtttcttttttattataaagtggcaatttgtaccatcattagaaatgtacattaatgtataaagttttgcattcaaatctctttatttttgattacctatgactaaagaccacaaatcaaataaaaactcatataatatatccttatttcagaagcatatgtatatatacacatatatatttgtagaacaatccactgttttaaatgtaattttgacttaaaaaatgctatttacaattttatgacagagaaataacctcagccttttatggtattaaaatgagcagggaatttttatgtttgtgtctcatcttgtgcagatgaaattaagcaatatcatggaaaaccttctcaagagcaaggccttgtagactaaggtatgagggtgaaatcgatttgctatttctgggtctatgtttttaaaaaattactggcaacgtagtcatacttacttcttcaccaagaaatcagtgctcccaaattaggaattccaaacttttcaatatgcaacctttaagtctttccttgtccttactcttgtcttaatactctcatctcccactagtggcaccgcaggactaccaatctagatattagattgttgctattttattaaacagaagagtcttagttcttttaaacaagctttctgaattagaatgaggcccataaagcatcacattgcattacattgatatctctttattgcgccaatccataatggctaaaaatgtgctattaaattgtatgtaaatttcaaagccaaaacgattactatgagaataggatggcttgctgccctccaatttgcggaagcacaaaagtctctgaattagcaaatggaacttcagctccatttgtttctatactttattctgcgagcttaaaaatcaagtaaggtgtattgaccagaaagctattttgtgagactctcaaaagttttgttttcattcttaagctcgttgattttgaaacttattccaataagaactcagaataaacatatcttaatttatatctgcgtagccaattgcaaagcattactaaaagccatattttttcctgggaaaaatcccaatgcaactccaaaaaaaaaaaaaaaaaaaaaaaaaagcttattttacttaaaaaggaaaagtgacgaatgaattgaagacccagaaatcagaacaatgaaaatcaaagaattattatacttgaaataagcctgaaaaacaaagtacttaaactcaaccatatttttggatgaagttggatattatatgtttacacatggtaatatttttaaaaactcagtgaatactggcatattctattaaagttttcatgtacttgagaagtaagcaggagttaagcaaacattcaccctttgctctaagctacattttttgtcaggtttatgtgtaaaagaaatcaggtttccaattaattctctgaactaaactggaaataagacaaagctaatttccaaaacattttactgcagtgaacatttgcttaacataatacggagaaaaacaatatacaaattgtgtggttagaattttttcttaactgctatcaggaaggagacaaatgtgagtctagatgataaatgatgaatagccactgaaaatggaggaattttgttagtgattcatatctctatttttttcataacaaacttaattaaatatattttgtcatgaaatcataattgtaattgatttttatgatttgcatcaattgtgttatttatgaaaccatcgttttactgatgagtgtgtatgtgtatcatcactacaaaagctcaagtcatttcatgctaaaagagccagtgtcccatagtgttgaagtttcttttttatttttttcaaataaaataagctttgtgcttgggatttttttctttttttttttggttctggtagtgacaggtgtatttataatcaagttgaatcaagagtgacaagaagaaatacagctagagttatatttttgccccaggggtattcttttcctagaagagcaagtccatttttagaaaatttaaatgtctttatttgttactttccaaatattttggttaaacaaatatctcttgcaaatgtatcttcaaaatctttgcctacatgcatacaatttgttcttcccaactgcttagggaaattccttcatttcattttctgctaacctctagataacagaaataggatacctggtgaaggatatggtccactattgaagaataatgattgtgtaaagtgagggaaactatattgaccttgaaatacggcaaccaatggcaaggtttgaggtgagggcctagagcttctgcaaagtgtatatattttagggagtcatatttggaacaatacatgctggacagtagagatataggagaagttacatgctatgtcttctcattgataatatccataaatctgcatacattttttaacattctgttttgtgtttttttttctttaaatttggatgtctctacaccactcctgatttgtaggactaaatagatctatttattccaatgcaaattgtgtaacatttatttcttccttgatttttaaaaatactttagtattcttaactatgtatgtgccttctcttacactgagttcttttttgctcctttcagctgctcacacaatcctgtctgttggagtcatagctgctaattccatattatttctctacacaccttgaaaatttagtgtattactggtacccttctgtgttctaggaaacaaatgaattgcaaactggacttgtaacaggatcatacatagagcaacaaattagctactggctttgtaagatagtaagttaggaatttcacagtcatgtctccaaatttcatggcagagtttaaaaaacaatataagactgtggtaaggtacaaacgcaaatgcaatttgcgttgactaatttcctaggacttatttccttatgtaaaacccctgttctttctttcctgccacaagacagggtacaaagctttctaaaacatgctctcaggtgtccacacctgagacattgctttgtggatactctcaaaggtgtccacaaagcaaaaaaatcagaccaaatgctaagagcaagtaacttatacctcaccacctggacatggcactggcaaaagtcacttcagcattagaacagtaatgtttttgctaaattactaaaaaaaaaaaaaaaagaaagaaagaagaactccggaaataatatctttgataaaaatgttatactctaggataatttgaaatcatttttgtgaaagaattaaactcattaaggctattcgatgccatacaagattttccttttacataaaacaatcttaaattacatctcaaaaataatttcttacacttttcttgatgataaatggttcctggctatatattttataggtattaacatagtttataatttggaaatgttcaatttcatggttacaaaaaaaatcctgcaaacagaatgtaatggtgtgtcaattccagatgcccaaataaaatacaaaatcaagcaaaaccacacatcgcagcattatcatgagtttaagctattgagtatataacatcagtttgtgagttcaattctccaaatcctttcctttaaagtaataagtttatttcatctttattaatgtcttcattacaattagccttctactaataacaatacagtttaatttaatatttatggagttctgatttattttttcctttgcttttaagtgtgctaatctttgtgcacgtgaattttctaccacattgcaacaagcaagctttggttcaattttcttgtcctacacaaaggaagattttgagtgcagaatcttagccactaggtcttgcgttgtcattttattttcctctccttgggtggatttactggaaggaaatgggtaaatgggaaggaagggaaggggaagggatgagagagggaagaaggggagagttctcagctatgttgaatcttgattcacaactttgcctccattcatggttggtgttccagaacttttccttgaacgcccttgtttttctccaatttcatgtagcgatggttctctgtacatacacactgaaaggcaaaataacaaaaattacttatgacagtggacataaatttccttcaataagcttttcaaatttgattttacaatattcttcactctcatcacaagctcttcttctcattataaaaaaacagttttaacttgataatcagtgaatacacttaattttctttcagttctttcagtcacaaccttttaaacttttcttgaactgcagacatttaagtaagttgtttctgttctctcatagataaggcttgaatctttacagtttcctaacctagaaaagaggattttcatccagagtcagaggagacatgggaaatatttcgctttttggtccttagtctgcagtctaattcgggtaggtaaaaaaatattcatttacatgttgctaatctttaccctaccataggaaatataatgtatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaaaattgcatatttatgaagattaaatgccttgcatagagcaagtaccaaaaaatgtttatgaaaattaaggagctgatttctttgtgagcattttgaataacagatcttcagagaatatagaaataaattgttttggctgaaagtattctaaatccaaaactagactaaaacagaatttagaatacaagtgagagtctcctgagactggttcagtgatgaggagacagatttcttccaacatattctattacagaacttcttaaatgttaccgtacatgggaatcacctaggaatattgttaaaatgcagattatgaatcagaaggattgtagtgagcttgagagtctccattttaaatagatctcaggtgatgttgatgctgataaaacccagactacactctgagtagcagaaaatatatgaataaaatatgtgtgttaaggctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatccttagggaatatcttgccagaatcttgaagttccctaagtctaatggtgcttacctctctttctattataaaaaaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaaagtgtatatttttatcactttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgagcggtattgcaaattgacatctgaaaatatacagtgtttcaaaaagaccaaaagtcaccagtgccacagcaagatgtaaaatttgctctttttctcatacaactcattttctaatttcccaatctttgcactaaatggagtaataaaattaacggttttgaaaacctagttcatgtcccagttagaaaacgacaagtaaaaggtaggttttccagttcactgatgaaaactgcccccctcctcaataaatcaaataggtatttgaatttctatacttctgttaaccaaaataaaaagatgttcagagaaagcaaactaaagttattctagaaactgcatgcaaatacaaatacggagagcaaaaccttggtcaaagcaatagattaaatgtaatttcttgagcattaattttcattgttatttacaggacctaggattcagtaatatatctaagaagctgacaaatcaaggggaataagtctcaatcaaatttctgaattacaatataatttaaagaccataatccaattagaaagcaaagaaagaataaagtacctcccttcagtaatataactgccttactaccatccatagttgcattaacgcttaatgactgctattctgaatgtacatggtaaataatgaaacaaaattaaggaaggaaacaaggcgtaagtgttctctaaagtgcattatatgtgcaaaacgtaaacgaaaatcaccatgatgtatatagcagcctcaatatcatttcagagtattcaaagcaattttaaattgattaactaaattttacaattataacccagtgaatatagtaggtgagaaattatcacccccattttttttaaatataaaagaaattaagccacttccataaagtcagagagtgagtagtggcagggccaggatgaatatttagggtttcaaggtcctagttaagagttttgaataaaatcagaaataccataatttatccaacaaacaatgtaaaatgactgacatatcagtgtttgaattcttatgtctgtatgttaatcaagatttaagttggccttaacttcactaaatattcctaaagtcattcagaaatggtaataaaagaaaacatatggctgttataaacaaaatcaaaaaagaaagtaacaagagttggtgagtatgtggagaaattgaaaccctattcatttctacttaaatgtaaaatggctcagccaccgtggaaaatgaaatggtgattcctcaaaaaattaaatacggatgtaccatatgatccagcaattccaactgtaggtgtacactcaaaataaatgaaagcagggaccccagcatctatctgtacatccatgtccatagaaggattattcactgtagccaaaagatggaagcaccaaaatgtccattgacaaatgaatgggtaaatataatgtggcctatacatataatgaaatattattcagcctaaaaaacaaaattctgacacatactacaacatgaatgaaccttgaagaaattctgctaggtgaaataagccagttacaaggagccaaatattgattccacttatgtgagatacccagagtagtcaagttcacagaggcaaaaaatagaactgtacttgccaggggctggggaagaatggggatttcttatttaatgagtacagagtttcagttgggggagatgaaaaagttctggagttggatgatggtgatgtttgcacaacaatgtcaatgtacttaacggcaatgaaacatatacttaaaaatgattaaaatggtaaattttgtattatcatattttaccacaattaaaaagcaaacaaacaaacaacttgtcctgaattgtcctgagtataaggtataagaagtgactattaaagccagaggtgttccatttgcataggaagagccagcaattccccaataataaaaaacattagttttagaactgtattaaggaagagggagttgagatataactgaggaggtacagggcgaggaaaaggatagagaaatctgatgaaaatattctaggactgtgctgcctagtatagcatccatttagccatatgtggccactgagcacgtacaatgtagctagtcctaattcagatgagacataagtgcaaaaataaacactacaggactgggtaaaatagggaggtgatgacgaataagaaggataaggctaatttgtgtcagagcttgctgaattccaggccagaaaatttaaaccgtgaacatcatatatatcaggctcaatatgatagcaagtgaagagttaatatacttagttaattaagtgatatgatagcaaatgaagagttaacgtccatccgacatgagtgtataaagaaaaatctattaattcctttatgtagaaaaatgtctaggtttacgtgatatggatacaactagtcagtatagtcaagaaaaatcattcaaactgaatctcactgagtgaactctgtaaggaatgactggcagcatttgaaccttttttttattattatactttaagttttagggtacatgtgcacattgtgcaggttagatacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtctgcatgtgtctttatagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacgtcctctccagcacctgttgtctcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatttattaaatggggaatcctttccccattgcttggttttctcaggtttgtcaaagatcagatagttgtaggtatgcggcattatttctgagggctctattctgttccattgatctatatctctgttttggtaccagtaccatgctgttttggttactgtagccttgtagtatagtttgaagtcaggtagtgtgatgcctccagctttgctcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgacattgattcttcctagccatgagcatggaatgttcttccatttgtttgtatcctcttttatttccttgagcagtggtttgtagttctccttgaagaggtccttcacaccccttgtaagttggattcctaggtattttattctctttgaagcaattgtgaatgggagttcactcatgatttggctctctgtttgtctgttgttggtgtataagaatgcttgtgatttttgtacattgattttgtatcctgggactttgctgaagttgcttatcagcttaaggagattttgggctgagacaatggggttttctagacatacaatcatgtcgtctgcaaacagggacaatttgacttcctcttttcctaattgaataccctttatttccttcccctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctcctcgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttatgtctttgttcttgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaatgggtgtggtgtggtgctgaaaaaaatgtatattctgttgaattggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgtgagtctaagtctctttgtaggtcactcaggacttgctttatgaatctgggtgctcctgtattgggtgcatatatatttaggacagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgtcttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgatacccttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcattttagagtttccagtttttctgttctgttttttccccatttttgtggttttatctacttttggtctttgatgatggtgatatacagatgggttttcggtgtggatgtcctttctgtttgttagttttccttctaacagacaggaccctcagctgcaggtctgttggagtaccctgctgtgagaggtgtcagtgtgcccctgctgggcggtgcctcccagttaggctgctcgggggtcaggggtcagggacccacttgaggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcacggtgcgcgcacccactgacctgcgcccactgtctggcactccctagtgagatgaacccggtacctcagatggaaatgcagaaatcaccggtcttctgcattgctcacgctgggagctgtagaccggagctgttcctattcggccgtctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaattgaaaggtgaggttcatttgggcgatctaaaacatgttcttttgttttgggggggagcttaagaagcctaaacaaacaaaaaataaattaagaattactaatgtcattgcttctggccttttggctatgaacaagtatggagaattactaataccacatagaaaatgggaatcacatgtactttatagtaaaatttattcatgatcttatataaatatcagcactagaatttggagttctgctattaatttctaatcacatactattaagcatttaggggaaacctttagcaagtatgtccagagaactgtctaggctctgaccttcaatagctacatgaattctacaactcttaaactgtggttctcaaattattcttatcctatgccagattaagtttctctcttcctaataatcagatccttattattaaccagaaagattcctagtcccttgatttgtagtagctcgaagtgcaatgtatttcaagagggactttttccatctctttctgttataatgcgcaatattatttcaccaggaatagatttgccatgctttaggaggtgctagaattttttttaaatctcttttttttcttcaaaaattattttcctgtttcctctgtgttatgcactggaggccacttcagctatgagaacaaaatttgatattttagttcttatgataagcagtaatttctagactggaaataacatgaaaacaaaacaaagaaacagaaactccctatctttcttgtcttcccagttccccaatcctgttccacaaaaactcagattcagtggcacttctcatatgaaattggaagcaaatcctctaatttagacaatatgggatgttactagttaactatgtctcactcaggaccttggggcaacacttgtgatatagattttattttcagcaggtatgatgttatagatagtacttagtataaaactgatttaaactttgtttctctctgattgcacttgatactatttttccaacacagtttcagtacccaaatttcaaggatgttcagtgtcctaaagatgcaaggcctgcaagataaataaacaatgttatttccctttcatctggcctgcaagataaataaacaatgttatttccctttcatctggcttttctgggttgtccttgatcaagccgcttgccctctttctattcatttgtcaagtacatagagtaggaaaagaaatatttgcttccctcaccccaggatatttctgagataaaatatcattgctcctctaatgcatgtatcatcataatagttttggacaaatggtaaaatacgatcatgttttgaagaggaagcatttctttttggttcttctgtactctttcttcaaatcaaagcacactcttatttcacttcttttcttcttatttttcctctattctgacttacatttcaattttcttccttcttcttaatgtttctttctattcatgcttttgacttttctagagctatcgtagattgaaacggagagatttaacccagctttctgagtgaaaataaggtagagatttggtgcgagagtgttcctccttattttcagacacaaggacaagcaggtttctaataacacagctcacagtatgtactactttaaagcacagtatttactagaaaccagtttaacccttgaatgtcagcagaatgcacttgtgagatagacagtagttaccaggtgacccagcacagtgaaggttttgattttaacagctgtctgagcatgcactgaccatgtagccatagaaagccctgcagttctggtaacacaaatacaatgcaacacttggtcagaacaggaccataatatattgactctgtgatgatatatggtatttgttctatttatttaattcttgcttcattttaaagtgaaaaatttacacttttagaaaagagaaatgtgaaatatatatcactgagctttgaagtattgtcaaaaacaatccattttctctttgtaggattaggtatggattttttccagggcaagctttctatttaatatttttctattacattcttttcatgggtgcctgtgttgcaaatgcagttaccagaatatgcaggctttccttgccatcgtgatggctcagattcccctatttacaacttctaacattcaacaataacttctattttagttataaatttcttctgaaaaaattacaatgaaacaaagactttcttaaaagtatgaaaaaagtaaaatcttgggcattgctgttatttataaagcacacagctataataaaccgggtgccaagtaccatcctatgagtactctcctattaagcattagtcatcctcataataatatctaacgttaactgagcacttactatatgcctgcacattatacatacaaacagttttttaaatgaccataaaaatagatacttttagtggcctgttttgcagctgagtaaactgaagaacaaagagggtaacctgtccaaagtaatatagcaatacagggcagtcagctttaaaatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttcccttttctctttctttctttctttctctttctttctttctttctttctttctttctttctttctttctttctttcttttctttctctctctttctttttctttctttctctttctttttcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttccttctttctttctctctgttttttccctccctccctccctcccttccttccctccctccctctctctctctctttctccttccttccctccttccttccttctccctctctccttcttattcttcctctttattttccaagacaataaactgtctgactttgcatttcacttagaaaggagaattagatgagaaatgttttcatggcaaaaattaccaacctatggacatctgcccccacgtgttctgactcctgcttgttacaatgcttgcactgtgcagttcttacctaaatctagagcgccatggtgcactcagtcccagcccttctactcagtgttctttggtgtccctctctcctgtgatcccaatgtctgcttatcccagattgttcccatcagtatatgaatgtatgaaatagctttaaaaacaaagaaccctaccatgtaactgtcatgtttctcaccagctccctcctcatttctctacttcctttttatagcagcagttctcaaaagaactttaatattcaatattaccttcttcttttctttgcctccagttatcatttaattctttccattcagacttatttctcactgtttcaccaaaatcactcatgtcaagtcactactgaccacgagttacaaaagcaaagatcaattctcatttagcagcttgctagacactccagcagtgttggatacagttaattatttcctcctttttgacaagatgttttcacttggcttcttgaacatcaatcaaaatagcctagtctttctgcaaatcactggctactctattttattctcctttgcaggagcctccttttccaataaatgttagtgttccccaggagtaagtcagcaattacattcattttcttagcagtgtgaagaaactagggaagtattctccccatttcttgtcacaactatagtgatggaggtcaaggtggtattactaatattctataatgtgagaaagttccacacaatagaataatttttccaaacaagatagtctccccatttgaaaagtagtcatagaacctagggcagtggttgtcaagcggtggtgaatttgccttcagtgaatctttcgtaatgtctgagacatgtttgtttgtcaccactagagaggatgatttgctattggtatcctgaacatagaggctatagatgttgctacatatcctccaatgcacagggaagtgccccacaacaaggaattatagaacccaaagtcccaaaatgtcagtagtgtctgagttgtaataaccagtactaggggattacaagtgattttaaaatgtcatatttaagtagtgtgtgtgtgtgtgtgtgtgtgtgtgtgtgtgtgtacacatttcagcacacagacccattattcgcccagttcatcatgcctaacacctaaaagtcatccctgatttctgtctttatctaacaacctacatccaatccattagcatgctctatcaggtctaccttcaaaataaattcaaagtcattctctctacctctagttataaaaccctagagtccaatctaatactatcttgcttaagatcctggatgatttcactgcaattctgctcaaaatctataatgaatccccatcacattaaccataaaatctaaagtcctgaaggtggttacaagccctcaatttatagtctttcctttctctctaagttcatctcctaccttccattcctttaatcaatccattctagtcacattggctttcttgctcattattaggcatcctcggagtctataaaagcctttggaatctctcagctttgcctgcaaaaaccttgtgccacatctttgcatggtttactactaaatttcattcagattactgttcaaacatcatttacgtcatcttctctaaaaaatttaccttcatcatcctttttaaaatagtcccatatttttttcttggaactaatctctagtgatgttttaaaatgcttgcttatttttaattgcgtattttttacccatttctagacataaatgctatcaagtcaaaattgtctttccttgagtactaactgtgtccccattagtacagtgaaagacgcttagtagatgtttcatagttatgttccaaatgaatattcctatctactatgctacagtgactaactgaagaagtctttggttggagtaaagctgatttttctttcacctttaaagtcagtgaatctttactttatctaaggtcctaaacttgggctgagttccctgaaactgaccaatataaaggtaaaatagatgactttgacacaaatggagcaaggaatactatacggtagacaatatttatcaagctcctttagttaagtgatatttgaataatcaaataataagcctcatcttcacagaaataagaaaaatcaatgaaacagaaaataaaccaagaaagctgacgaccacccttacctttccttgtatatatggtgcattatagagtctagaaaggaaagagattctaaggatcattgcatcagacagttccctaaacttagtgattgtcaaggcatgacccctaaccaccaccaccaacagcaggaacgttaagaaatgcaaattatttggccagctcaaacgtacagaattaaaaattcaggagatggggcctagcaatctatgctttagtgggctctctaggtaattctgatgcacactcaacttgtagagttgctgtccttaattcttccatgagaaatacccggatgttctaagaatacacatttgtatctatgtcttgcctctgcagattctaattcataagaagttacacacaaatacacacacacacacaactgattaagtaactaaattgaataactttaaggaatgacaacgcctatttacacacacacacacacacacacacacacacatcacatcacatttgtagtaggaaaagcatgacatctgaagttaccaggtaacaattctagttttgcttctttctagctgtatacacctaagtgagttaacctctagaaatgacatctttctcgtgtttaaaatagggatagtaaatcttaaccttcatacttccaaggatttagtggctattaaatgatactttggttcagaaagcatgttgaaaggacaatatgccattcaaatggaatataaggtagtatagctgctactaattatcactttatattgttgctgtattcttgacagatcctttgaaatttgagagtgctagcagtaatttttaagtgtcaatgtcactctgtagtggagagttgaacaacctgtgtgtgggaacactggagttgttctgacaaattctgttttccaaataaaaacaatttaacttctgtttttaataaaactaaaacattaaactctataaagaacctccatcgactactagttaccatcaaagacaaatgaaatatgattaatcattttattactacaaatttaattgaattttccttggtcctctgtaatttccaagaagctgaaaggttagactgctgtgttagttaatgcaccattgaagatacttaattgtcttaatagcagatcatagaagggtgtgggaaatttacctaaagcaatttcacacctgaattaatgttacatgggatccttttggaactctgggagaattctaagtgctagtttggaagaaatgtattgccttagaaatgcattcactgtgctatacatatttactataatgagataacaactataacgttgtgaacaaaagcgtctgtatgttcgtttagaaagaaagaaaaagcaatatttgcaatgagggacaaagagagagaaagaggaagaatgtgtggggaagaggtaagagggttgtattaaagactacattcagaaaccagaaaaaactggtttgaataagttacaatggtttgcaggaggaaagtatcacaggctggcagaaacccaaaacacaaaagaaagagttgcagctattatcctttctgtaattaaaacaattactggcagagaggttcttttttgctccatctttctgcttttgtctttcagtatggttgggtccaaaagagaaccaaggcatttatttctatttccagtttattgaaataaaaatatcaaatttggcattagtgtccaccagttggagttttaaaacatcaggactcctgatttgctctgttctttggtgtcttattatgtagttttgaagggattgttattttccttccagattccattttcattgcctttaatttctcatgcaatgccacatctcacagcatttttccaatacaaaacacagtaagacaatgtccattttctaagacaaaatgaaaaaggcatttcatgtttgatctgacagaattctcttgaaaaatccaacttttttttacaatgtctaattttcatattattcctttgaagcaggtggaatttataatagactttatcttcagagatgactgaggtagaaggagataaattattttctcaaaattacttagcaaggctgctctgcctatggagtagccattcttctgtttcttgacttctccaatacacttgctttcattcaaacaaaaattgcttagcaaatcattgccaaattttgacccaaagaattagacacttctgtattcttggttacttgatttctattaggttgctctaagaggtgtcaatttaataaaataattggcattacctctactgacttcatataggaatttaaccctggactaaaacatacctgtcttgatagtagtagggaatgtaaaaatgtaacatatatagtatacttaatttcatgtcagagggacaatttatattacattagattcagtccaatatattgatcacaataatatgaataaatttaaatcatccatggccagatttgaccaaaaggagcttagaaacaccaaattcagaacactgcatctcaaactcaatgccatcagaaatcccctggacagcgttttaaacctatagagtcctaggtcatacataggtttcaaacatcagatcactttggagatttgctctgagaatctgttagcttctaggaacactacagatggttctggtactgatgtttgggaaatgacagtttacattctgctgagtcttaaatcagattctatgagcttaaagcaccaattctaacaaagaaaatggaaaccatgtatatggccaagtgtgtgtgagtgtgtgtgtgtgtgtgtgtgtgtgttagtactgtctccccactaccaaataaattgggagaaataaatcaatattcctttattccaagtttaatacttctgtatggatggctctcaaatgattcttagttatcttatttggaaatatatttatttctccaggtctcagctcttgaagcttaaatctttgcaaagtacacagactttttttttcagaagggaagaaccagatcctaaatactcagccacctgcagtagctgagcaatgtgcttcttgaaggaggagggaggagaaaaggaggagactatattttgttctttgtcaaagagtatttgactgctatatctgatgctaaagggggaggtcaccactaaaacactttacatctggggaagttacttatctgtgctttgaacaatactctgaaagggcagaattgagaatcaggaagcctgtgctattgtccaaaattccaggggaggggacccatgtaagtagaggtttatatgcaatgtacatagtaatgtgcttaaacatcaaggccatctatcagaataggtgaccctgaaacccctcatcaacgctcctgttctctaaacacaggatgagacgtgaaagagtgaagggaaatgggctggtgggtaattattatcatgttatcagtgtaggacttaaccatcctcaaactggcagagcttaattttgggaatcgtgacattcaaaagacaacaccagcaggactgggataaaggcagacatatgtgaaaaacaaataagcaggaaaaaacaaaagaacaaaagcaaaacccaaagccaaaaaaaaccctactttggcttttcctccctaagaggacaattcccttcacaaaggaagggctcatttaccgtgcagtgctggactctgttaggatgttaacagtattaccattggacttacagggttacaaagatgcctttaaacattacaaacaaaatagtcaataatttttttggttaacccattagcagcaagttagctaatctcttatgctatcattttctaatcgttttctaaaagtgtcatctagttatgtgctttatacctgccctatggaaaaatattatcgaaaactttatttatttatttattcacttatttttgggacagaatctttctctgttgaccaggctggagtgtagtggtgcaatctcagctcctggcaaactccgactccctgggttgaaagtgattctcctgcctcagcctcccaagtagcggggattacaggtgtgtaccaccacacctggctaattttcatattttttagtagtgatgacgtttcatcatgtcggccaggctggtcttgaactcctggcctcaagtgattcacctgcctcgacttcccaaattgctgggaatacaggtatgagccactgcgtctgtcctaaaatctatttaaatgtaagttatggctaggatgcctttcatcctatcccttcattaaaaaaaaaaatcacaaataatggaaatagctcataaagctgtaatttattttttcaataattcaataaagaaaatatgtttagaccagttttacatgtaaattctaggctaggttctatgaaggaacatggttttacagtgaagggcttataacgactgccacacaatgtcattgccaaagaactttagaaatcatctggtccaatttttttttttttttttgctgagtggaaataaaccttgttagaattcaccagaaaagaagtgatgcattgttaattctttcttgcctagcttgaacatggcattccattaactgttttatctgattgtttaccaatgtgtttctcatcatatcatgtattcctgtctcaattttgcatgatttaaaactagtttactattcaaattgcatcatagtataaggtttctgctttgctatcactgacttttctgagtatttgcatattcacaggcttacttcagattgaagggcaacatagtacagaggttacgtgacatcagggttcctggactgcaaccccagttctgtatttatctagccctgtggtcttggactggttacttagttactttaaattacgtttcctcatctataaaatgaggataaaaatacagaactattgtgaggcttaacagagataacatacgcaacctggctagcaaatagtaaattgataaactgcatacagaagtagtaagactagtaatagcagtaatggtggcagcaaaaataatttgagtatcccagcagcgaggagaaaggtttcaatgtccagtggattaatgcctgacacaacctcaagtgtacatatctttgatagtaatggtaacctgttaaaatcatttaaggatataatgtataactgcatggagaatcataaggtaattgttcacattttctgtattataaggacatcaaagcacataggaggcagaagagaaccaaccaatttcatgtgtttcatgtcagttacaagagtgtgatgatctccattaatctgcaagaacttttatttctaaggggtagggatatattgcagatttttaaaaagagaagcaattaggagacatttattcaagatcatttactaggtcccactatattgaagttacatctacatctttctcagacctcagactgtagcctgtcttaccagttttaaatggggtttaagaacttgattgttcaagtcagaatgctttggtttcatttctggctttgccaattgctagctgcatgatttaggacaaattactcaatatctctgtgtttcatttttcacatttgtaaatgcggataatactggaacctacttcgtacaaatggaatggaaagtaagagacagtaattgagacgtgcttagaatagcacctgcacagagtaagcatttataaaactgttagctaagattgttcaataaagttagttccctaagacaaaagataaagacatttatagggaatgagaaggtgtttggcctaaaaccaattaagttttttttttcatttttggaagtaattatcatcatattctatatgcttcacacctagagagacaaaaatccttggaagtgaatcaaagtattagtgaatctgatttagaatgcattttttttcccagaacaaaaagaaaatcattctaaaggatcagtcaataacataaagtaaaaacacgataatctaccaaaagatgtcaatcagaaaattaggaaatcagagatattctaaaattaagaggatggaagcctgaagcagagtttttagtgtctcaatacccattgtgccataacccctagtcacagaacatttatttggtatatggctatcaaaaaaaaaaaaaaaaaaaagactacattcttagcttctttacacctaagtgtgactacctgactaggttgtggccagtgcgataagtagcatatggcagttaccatggacaacttggaaagaaaactggccctggcttttccttctgtcttcttcacctctcctctgccctctggctggaataagatgctggttggatcatgggcagaagggcagatccagggccagcatgtgtggttgtgttccgggtgcagtgcacagttgtaaataagccgtagcaaaacactgggagagaggtagtaaaagctggatgcagccaaggccctaccaattggaaaagcacagtaccagctaggatagctggtctctagatttgttttgtgagagaataaaaaactttatatgattaagctgctgttaatatgagtttgtgttgtgtgaagacaaccttaattctaatccatataggaatgtccagttgtacacgtacatgctcatccagacccaagaggaaacttgattaaccaaagtacagatagcagctaaaattaggagggtaggttataggtatatatatatatatatatatatatatatatatatataaaatttttttttttttttttttttgagaaagaatcttgctttatcacccaggctggagtgcagtggcgtgatctcagctcactgcaatctccacctccttgattctcctgcctcagtctcctgagtagctgggattaccggcacgtgccaccacgcccggttaatttttgtatttttagtagagacggggtttcaccatgttggtcaggctgatctcaaactcctgacctcgtgatccgcccacctcggtctcccaaagtcctgggattacaggcgtgagccaccaagcctggcctaggtgtatttttaagtggggtcatgagggtgaagttgaatataaagggcattatccgtaaagggaataaacacaacacgtggatttcttttcttcatactttcctaaattttccaaaattgttaatgaccttgtactacttttataacaagaagaaaatcaatgtaaatgaacaaataaaaatgatgcaataattaagagcataattcatcaaacatttcatttttgagaatccatatatttccctgtgaaaatattacttacttctcaggtaccctttgcttaaccctaagaagcaggcactttcctgcctttattcacactgcacctggaatgtttttgtctgcctaatccctacctctcatctcaaattgcaggaacctggcctagccctgaaggtaagtttaaatattagcttctcaatgatatcttactttttgggaaaataatagcctttttctctgagtcccaatataaatcctatatattgcatcacttaacattttacttttgctctgagtaaacatatgtcacacctctaagaatatcataaagttctctggcgcatatattcttctttgtctttatagttttctattcattaattcattcacatgttcacttttcagacaactgattatcaaatatctctctatgatatgccaactattatagaagacaaagggagatatgaagaaaaataaaacatgttctgttcattcaaagagtgagctaaccatgaataagaggagacagagtggcattgggcaaatttaatgtcataatttctatgggagagaaatgtatgcaatgacaagctgaccgaatgtttagttctacttgaagaaagtcaagaaggccatcatggaagtattgactcttgaattatttttttccaaagactaatagacattttccaggcagatgagataaatggataaaaactaaaggagcaggggtgatgaacaaaatgagcccaataagaatgaaaataggccaggcatggtggctcacgcttgtaatcccagcactttgggaggccgaggtgggcagataacctgaggtcaggagtttgagaccagcctggccaacatggcgaaatcctgtctctactaaaaatacaaaaattagccgggtgtggtggtgtgtgcctgtaatcccagctacccaggaggctgaagaaggagaatcgctggaacccagggggcagaggctgcagtgagccgagattgcaccaccgcactccagcctgggtgacagagcaagactccatctcaaataaataaataaataaagtgaaaatatactgcaggaaagaaaagttcatttcatgtgctgaatacacagcatgtgaagagggtcctgagaggggctaggggctttgaatatcacatttcatccagtgcttggaacattggaagatagtattgacttaaatgtttgcagtcaccgtgctatgtactatgcaccaggcattgtgtacactgattgactgaccatgccatatgagatattcaggggacagcaagcttgactaagccacagagttgcaatgcactgcctcaattttctcatttcctcagacgaggatgctgagccaatgtttaaagtgattataatgtgactttcagaggagaaacaagcttactcagcctgtagtagaaagcttggctgaattcaggaaatgtggttacccaaatgatatgctctcatcctagctaaggaatttctgagggaacatagcctagctgccaaaaatcggtttcctcagaaaaaaaaaaacaaaaaagtttattctaatggtcagtttgaaataaatgaacagagaattaaatgattacgagagaaaaggttataggctcacctgagaaggatacagtgcaatacggtaaatataaaagtatcatttgtttttcaagggtgtatcttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgcctcaaaagaaaaaaaaaaaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgagtcccagaaaccaagctcggcctgattcttgctggcggtacagtgtggaagaatagatcacatagtagttttcaaacacagattccttgaatttgcattctggagtgaaaacatcctgtaggaaaaaaaaaaaaagacacaaaaaagagaaatgatttaaaggtgaatcagcaaatgcttaaatccaataagcttgaaatccatgtcctctgttaagaacaaatgaaaggcaatgacacatagtttctattagcctttggttacaaagattcatcatacaaaatcaaaaaacatgattgcctttctagccaaccttcagcccagagataataacttgctcaggcttgaagctacgttaaaatcattcaggactgtggccaagtctgcgctccgatcctagcaatatgttttgtaaactaaagtgattggccattcctcatttactcacccttaacatgtaaataaggaactaaaatttatcctggaaatcaaaatcaaatataaccacagcaaacacaggcacacaaggtgcttttgaagagactattctgtatatacaaatgtattacacagccacagcttggtcaggaaaatcaccacttttcctaaagtcagtaacttcctctctaatttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacattatagacgaagaaaaatgagactaagaaaactggagtaggctggggtgtggtagcttacctctgtaatgccagcacttcgggaggttgaggtaagcagatcatttgaggtcaggagttcaagaccagcctggccaacatggtgaaaccccgtctctactaaaaatgcaaaaattagctgggtgtggtggcagatgcctgtatttccagctactcgggaggctgaggtgggaggatgacttgaaccagggaggtggatgttgcagtgagcagagattacaccccacactccagcttgggtgacacagtgaaatggatctcaacccccccttcaaaaaaaagtccaagaaaacaccccccaaagaaaattggagtagaaaggtggttgtagatagtaagataatatgaatagcaataaattaatattatgtttatattaatactgaaatatgatttcttagagtactttgagttttaagtaaatgaactactagcttaagaatcaaagaaacaaatgaccatgagatactacttcacatccactataaaggctatagtttaaaaatggacatgacaaagtgtttatgaggatgtggaaaaactgcaactcacatacattgctggtggaaatgtaaaattatgcagaagctgtggaaaataggttggcagtgcctcaaaaggttaaacatacagttgccacacaatccaaaaattccacttttaggtatagttctaagattaatgaaaacatatgtccacacaaaaacttgtgcacaaatgttcatagtgacatcattcataatgtggaaacaacccaaacatctatcaagtgatgaatggataaatacagtgtgatagttctacagaatgcaactgtaataccattcaattataaaaaagaatgaaatactgatttatgtggcaacaaggatgaacctcatacacattatgttaagtgcaaggagccagatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaaagtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttattatttttttttctcgatctagtccaatactagcaaacagtattaaccctagatgctatgctaaggaactctggaaagttcaagcaatacattcaatgtataagatttcagactttataaagaagttaggaaaaaaataattcctgttttgtgtaagtacatatcgtcatatatgtagatggtgataaaaccttcttccttatgaatgtacatcacagaaacatgtaaatttgaagatagatataaagctgcttagtgatgatagtacaatttggcacctttatctaacaaggtaactaaagctcatgacagcgaaataattgtccccagtgtcataggaagctagcggcagatccagaccctgtgttgaacaacgggctcctcgctgctggttcagtacttcttccaatgccacacattgctttcctactgcatacgcaatcctgcttttgatgccaagcttgatttgggcaagccttactcatattatagaaaccatatcagtgatgtataattactacattgtcatttatacatgagaaaaacaacactctcatttaataaataacgattcttaggtttctgtttcatactcatttaaaattccctcccggaacagcaaaaatcagagatattgcacagaagctggagtcctggggtcctgagccaggaaccgcattaggtaggaaccgggctttgaactactaaattgacaaatgggggatttcttgcacagcatccaggtcctaatcagcaatgaaaagccaagtggagttttccattcagtataattccaacagggctatgcagagtcagaatctgaaaatgaggcagctattaatacctgaccagggcaagacatttccggctggaaacatggcaggagtttgctgcaggcacttgtgtggacacaggcaggctaccctataaactggacgggaaatcttaatggcactgaaccagcttggatagtcattctaagtagaacctttacaatatatgtgcagtttcagtttcaatatggagttgggcatcaaagaatttacattgtatttgctattatgcctcttttttttttgtaatgagaaatcagagccctacacgtggagtaaaaaaaaaaaaaaaatcagggttttccttctggctccacacatattagctgtggattttaggtaagtgattacaattctctaaatttcacattttcaactgtaaattgagttattttaaggaaaatcatgcatatggacacatgttttaaatgtttagaatttaacaacctccaactcattattcacttttcacatagcaggaaaaatgcaatgaatcctataataaggcactcaattctggtttttgtcacatgtttatatctgctccaacatctaggaccttgtgccataagagtagttaaggcaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatcccaggccaccttgatccagtgcatataatagaaagcagagtaaataatcagtataataaggatgattttgtttctttcgtaagactaaccagtagtcatgttgtatctcatgagtgtttctttttcctatagtcttgagccctcagttcaatgtaggcatcagagaaaacttatagaaatctgctgaaatagaaacacccccgtgttctattctatgtcatgtgtgtagatatgtgaaatgataggtctatttttcacaattattactttaaaacctgcccattcttcaacttccactcactttgacttcagcagaaaatgaatattttgatagtgttccgaaattatttttgaatgctccctcttttatcagcatttgcagaactgagtttttgttctatcatggtataagccaatatttgaccaattctttttcacattccaaatacctgtccaccctagccttgcctcaaaagttaaaatctccaactcattttaatccagatgatgaatgaatgctggaatcctacgtaagcccaacatgatcactcaggaccccttctagtctctccccatcccatgggattccaacctcctctccctagaatgctccctgaccccagcttcatagtttcatactctaccttgattcctctccaacactgaatttcttcctgtttcttctccctgcacatagacaactgtcacacagtttctggcttcttagggtctaccactgcccaggaaaagtcctttcctctctagtcagcctctaactgtgtcagctttggcctttcccaccgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaacttggacatgctatttaattttgttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgtatggtaagtttaataacaaataacaaccattcatttataggttgcaagcaaattttgttcaagatgtaaatataacattgtggatcacataagttattcaagaaaaaatattttccattctgtctccaactaacacattccccttcttattttctattccacaccgttatattatacaacgcccatgcttacatgtttgatttactaataatgtttgtaaaactgtgtaagttaaaagtaaccacttacaaggtcctacagaataattatgtcaagacatcaaatgaacagaatagaaaaacagaattgtccaggacacatggagaaataaacagtaagtattttctggaaaatcatttgaattatctaaatttctgatttgtcattcactgacaattttctccctgacctttggcacgccagttaacctctctgagcctcaacttcctccactgtacactgaagatacgtttactatacagactaggagcattgtaatgatcaaattatttaacagatatgaaagctctttgataactacaaaggcctataaaattatttgagattatttcttttcacagacaactttgatattgtaactttaaaggcttctacattttagtatgacatctgctcagaataaagttcttgaaaggtaaagaatgttatgtgattcactcagaaccgcttttgctcccatgagctttacttgccaaatgcatgctttccaactcaagtaggaatacagcacttggtagcactgtatagttaatataattacacgataccataaccataattcatcttcactctgctctttgcagatccctgtttcctccttactgctctggctgagataacccatgggtgaatgtacagtcaatgagtgaatgctcgttgtactcagccactggtctccttgctgttactgaaacacaataagcatgtcccatttcaaatccttcacaatcaatattccttgttcttgaaaatgtcttcagtaacatattaacatggtttgatctcttatttcattcaggttactgcttaaatgtaactacctcagagaaagctcccttgactaccttacataatttagcactacggccactttctaaccctttaccttgcttttgttttccttcataacttgaccctttctggcattataacacatatgaatttgtttaagcttcttgaaagtagctaccatgattgctatattctcttcgtattctcaacagttctgggaattaaacaacaaatcgactccaacaaaataatttggtgaaaatacatcataaaatctgaattttttcttcctgtatatctctaagttgtgatcaaatgggaaaggcctctttctttcttaggctctcagtttctctaaatgtaaaaaagaaatgccaaattacacaatctcaaatgtcacttttgtcttactttatagctatattattcatattaaatacataatgtattaaaattaaagagcctatataaaatgttgtttcttcaaaaatagagctttcctaccaaagaaatggtggtaatatattattatttaataagcaaacaaagaaaaattaatcagagaaatagactttgctattgtgttagtaattatgactaatgactctccatatggtatgtagaaattattgaattttcaagcatatgccagataaaaaagggcctctgattttggttctatctttcccacttaaaaccccaaatctaaactcttttttttttccagagggagtctcgctctgtcacccaggctggagtgcagtggcacgatctcggctcactgcaacctccacctccctggttcaagcaattcccctgcctcagcctcctgagtagctgagattacaggcgcctgccaccatgccttaatttttttgtatttttagtagagacagggtttcaccctgttggccagacgggtctctaactcctgacctcagacaatccgtccaccttggcctcccaaagtgctgggattacaggcataagccactgcgccaggtctaaactctttttaatgtatataaccaccttctctgtttgctgtgccaccttgtggattcagttttgtgtaagaaagaaaggaatcaaaaacaactggggaatcttccaacacaatttatatccaacaactccagagacagagtcctttcggttattctcactggatatttggctgtgaagcttctgatttgctaacttcattaatggcctttagatggagagaacttgaaaatccttgctataatagctgctactttgctaactctgttgtcacgcataatgatattaaatcaagcaagagaaatattgttttccatcctgacaagaggcaaagaaaatgccaaattacattatctcaagtgaatttttttgaaaaaaaaattgggattgctttgactagaacaagtctaattttataacttaaaaaaaacaactctgcagatacggaaacctttgtctacacacttttgaaataatttttactggaaaactactgagctgattcctctaaaaataaaggttctttgttaacacattctttgcaacatctgacaaggaaacaaggtaaatttataccatcataaaataatgcaacctgtgacgtactggaaatgtaatgttggaggtagatggacacaactactcaatactcaaacccttgatttttgaccttgagcaagttacttaatttctctgaaactcagtttcacatctgtaagttaaggttaattatatcatcactgtaaggttgattttttttttttttttgagacagtcttgctctgtcactcaggctggagtacagcggcacaatctttgctcactgcaacctccgcctcccgggttcaagtgattctcatgcctcagcctcccaagttgcttggattacaggtgtgtgccaccacaccgggctaatttttatatttttagtagagacagggtttcattatattgtccaggttggtctcgaactcctgacctcaagggatctgcctgctttggcctcccggggtgctgggaatacaaccatgagccattgcatccggccaggttgtgattattagactagacaatgaaggtgtgtcaagcatgtagtacctgacttattactcactctccttactcctggttacaatttcaggggaaaactgatatcacaaatgagaatgcagtagcctgagcagcgggcagagaaaagtcactgtagttgtggatccacataacgtgtcatgaggatctcttacctgtgagaggttaattaagattatcttgcttaaggctcaacttggtcatctatatatagagaacacagagatatcagatcacttttctttctctggtagaggaatttggtgccatcaattggagataagtgatgtggtaatttcaggttcttgtcacctcctaatgaggcattataccacaataccactggactcagcctctagccagaagactgtaagtatagaagtgaggtgggagaaagccagtgggtgaggggtatattatattacaattcactattatcatcaaaataacttccaggagcttcaatgttttagagacgacatatctagagcagatattggaggggcagcacaattctccattgaaaatgcctttggttcttaccaagtgaacctgtgcacaatacgtaatcatgtgtcccactatgactgaacaggaaaatcatggcaagatatgtgcttctagtgcctcagcctctgtcttcctttcttgggataaggatgaaagtagggatgttgtcaaatgcacatatttcaatttcaacattcttctgctttttggaaagtcacatttcatacactaaaaggtacgagaaattatcaactaaggctaaaaaatatattttttacatgaaatttcctaacttttaaaacttctgtatcaactcccatgaagtcaaactaactgatatcaaacttaactttccgatgtaagcaattataaaactggacaaagtatatgaggtagaagtttccaggcacttgtcaactggaactgtgggtgtttgatctttgagagaaggcagatacacaggaggtaagcactgtgtatttgcttggctctgtgttggttttcttgctttcttcaagggacagcactgtggttttgtgaagctgaagaggcagaaactgtagttcgagattgctaaggtgacttgaatttgtggagcaaggtgccagtgaaaaagggctggatggaatgaggggcaggagactgtacggagatctcctgtggatcctgggtttacagagagaaaagcacatgctcaggatgagactcttcaaggcccagcatagaatggctgctccaggattgagagctgaatggagatggctgtggctgtgtagggctaggatatgataaacttccgggcaagtcagaaagcaggggcctcactaagcaaagagggcattcaatgaagacctcagaaaggccacaggttcaagttaatgaccacaccctaagtgagcacgtcctcatcccccagattaaagacagaaccaaaacagtcaagacaagacctacacgcacacacacagacacacacacacagacacacacacacacacacacagcatgacaagatcaagaggatttattagttattaatccaaatgccagaacaaaacacacacctgtatcagcagataatgtaatacactctacaatgttttttataaatgtctaacatacaatatcacaaaacatggatgcaagcagcacgatgtaactcatggtcagttacgcagatagtagaaaagatcacaaggtcgcctagatgttaaaattaagagaagtaatttgttttttttttttttttttgacacagggtttcactcctgttgcccagactggagtgcagtagcgggatcactgttcgctgcaacctccactgccccagctcaagcaattctcctgcctcagcctcccaagtagctgggactacaggcatgcaccaccacaccctgccaatttttgtatttttagtagagacagggttttgctgtgttccccaggctggtttcgaactcctgggatcaacccacagtgctgggattacagacatgggccaccatgctcagccaacagataagaactttaaaacagccactataaatatgttctagagaaaacatatctcaatgaaaaaaaagaacataatgaataaacaataaacagcagaaaaaatataaatgatttttaaaacccaataaaaatttaagaactgaaaggaaccatatttgagggaaaatattactggatataattaattataggctggatactggcacatataaacaactcggtatttgtgtgtattatgtatgattggaaaatatcttgaagcttacacaagctggtaatagtgttggctcctgggaagggatttggttggctagggagcagagatataagaaatagactttttttttttctacatgtattattacttcaagtaatgaatttaggggaaaaattctgggtcaagtacaattaatgtactagttaaatatagactacagacctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgtttacttaccccatcgtctatgtcctgcttagaccaccagaactacactggacctcagtacaagggatatatattaaagcaaacaaactcatcattctttgaactctactcgcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactataatggtcaatgaaggagaaacgtggactgggacgcagcatgtggtgcagtattgctgagatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgtgtttttgaaaaaaatctttgctgcaatgcttcttgctgtgatggtgtgtcctcagaatgagaatgcaaagtaaacacctgcaccaccaaagaagaatgaagacagagaggcctggttcactttatgctttatttctaaagtcccaggaatatcatttacctgtatcatgttttggatatactaccatttggacaaagagatcacaagtacacttgtttaatttcataaaaggtactaaaaagaaagttcataagctctgtcctcatcatagaatccttgaaatctaaaattgcaaatatgtagtttgactcttcactttacagatgaagaaagcaaggctgagcaggggaaggaattaacccgatcaagaccatggcgctaaataacagcagaataaggattagaacctgctctccagtccaggggtctgccctctctttgccacagtgggtgctttgcttatgatttatgcgctttcgtagattaagaatgattagctaaaatagacttttataatccaggcatggtggctcacacctgtaatgccagcactttgcgaggtcgaggtgggcagatcacttaaccccaggagtctgagaccagcctgggtaacatgacaaaactgtgcctctacaaaaacatacaaaaattacccaggcatggtgacaggtgcctgtagttgcagctactcaggagactgaggtgggaggatagcttgggcctgggaggcacgggttacagtaagccaagattttgccactgtatgccagcctgagcaacagagaccctgtcccccaaaaataaaataaaataggcttttacttttaattcagcatattttccattaatcaaatgactgaccaatgtgcttcggttaatataatagttgttttcactttgcttaccgattagagtgaattctctgcttttagacattttggctgcaggtaggaagttatttgctcttgattccataaagcagacactagtaatgtaagagctggcaaagggcaaaaaagggtgattctttttatatgaacaggataaaaccagagtaagcttgaccgatggtctgaattagagatggtgaatggagaaaatactgtatttttcaaagtagaattgccatgtgtgggcaaagggaacaatgggtgaaaggtcaggggaaggccaatccaactctgaaaatcaatagccgtactgctacctaatgatgctatcaatgcacattttgagttcatttgtgattcagaacttatgatttgatcctaaagtaattttctctagcaaactgaaagttggcaagtgccttcctcaaagcatctttgcagaccctacaaaaatggtaaagaaatgaaatcgttctccaaacgtgttttatctaccaattttcccatttacagtgttggattacaaatccataaaaagaattcagatatatgtggataatttacattctctatctttaccaccagattgctaaatcacctcatatatgtgcctccatctcattagggtacttgatatatatcttatcacttctcacagatttcattacaatttatagttatttcatttgttgttactactgctgtgctttcacatgtggcaattcctcccacctatatctgcaaatccaaatctctcctggtcttaaagatctagttcaaattcaactcccttcacaaaattgcctctgatcctgtcatctaaaattatctctttctcttctgactcccgtcatagctatttatctgtggctgtcttaacataatgatcactttgtattacatatcatgtgtatttgcaatgatgacatactatatagaactcacttgagaccccggcctctgtcttatttctcactgaaataagatacttgcacagtagctggcatctgacacccagtagctcctccataactgtttgtaaatgagctaatgaatggaggagtctagcctgttccatgtcgggagtagtttgatgaaatagcccttgtaacggcttatgaagcctattacagatagcttccagcagtagactttctacaaatcaacatagctaacaaaattcagaacttaactcaactgtttacattttctttttttttcatgaattttttttttaattgaaaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattagccaggcatggtggtgggtgcctgtaatcccagctactcgggaggctgaggcagagaaatgcttgaacccaggaggcggaggtggcaatgagccaagatcgcaccactgcacttcagcctgggcgacagagcgaggctccgtctaaaaaaaaaaaaaaagttacagcgaataattaatggatcagtagcctaaaaaataaccatttaatttttcagaaaatattcactcattggtgaaagagagagaaaaaacattaaaaaaatataaactgaagcatacaatctcaagaagcctataatatgagagaataaacacaggtatgattcaacctcctcttcacattctatgttagtttacaaaagatagtgattttatgttgagtgtaagagatactatttttttttcttgaactgagaaccaattgtgtagaaattcaaatatatgttaacttgataaatgtcattaacatgtatgaaccaaagcaaacagatggtattctgggacctggagagtataaggaaaatgcgaatacttcttttctgatgttaatactttgagaattacatgtgaatcacttaagagtaaatccattgttttgatacattctaaaatgtcagggttcctgttcagttcatgactacgtggtgccaccatcttgcataaagccttagacaaatgctgtttgataaatacttagtgacatgtacatgatttattcttatatatgtggttgtgcacatagtaagcctactagaaagaaggctatctacttcctttctatagactcattctattaaagttatttttcaggaatatcgaatgaataaacaatttcttcttcagatcatcaactacaaaaaccatcagttcattttctcttacatttgtgtgtgcgtgtgtgtgtgtatactgctactttatttgaaaggagaataattttgattcatttcctgttttgattttcatgctcttgcaaaaaaataaaataaagaactgcgttggcagtttcaagaacaactgaaaaatctattgtttagtatgagtcatgtctcctcttgaccttaaattcttttatctgcctaaacttcagttttgaagtttgaggttcaattgttgataagcagttagtatttgattttggttccccctgaaatgtaccaacacactcaaacatagtctgctcttttcagatattttgcagcttggcatttttaattctcttctccttagtagaaatctgtattagtacagatgaagctgaaaggaagcttggaattcttctaattggaatttcatcattttataaaaggaagccaacctcactactgtttctgttctcttaacttgaagccaagtagcagaggggtcacagcatctcatcagtttagcttgtattcaacatgaatagaatctgaccattttccctaatagaatcagcatgcaaatttctagcattcaattttgaaaagctgtatttaaaactactgtgtgggagagcagaacaatatgtgaaggagatattatgctagagtcgacgagttttagtttctgacatatatagtctttttttgagcaaaggcaaaatttatatagtatatcttataatttatcataaacaggtcagtaaaaccataagcatatttttgcctgcattctcaacttccacatatatttttaatgtaaaacagctataaatgagccagtccaggtagaaagagaaggttaatgtgaagttgaccaaacagcatttgctatttaattacacgatagacactaaaataattatgtaattcatgtagtcttttagctaacacttaaatcctgtccatgttctaactggttaatgataaagagattaataaacagtttttgcagtcaaagaatttgccatactgtgaggtataagattaagtgataatgcttccttcttgaataagaatcaggaccaaggagagcttcctgaagaggctgctttggattgacccttgaagaatgtgtaggaacttggaagcaaatgaagagagataaacgaaaggagagagagaaataaatagaacagatggaaagaaaaaagaaaaaagagaaaactaagaaaagaaagtgaaggaaggtgaagaaaggaaagaaaaaggaagggaagggaaaaggaagaaagaatagtaagttttcctcgacatggggggtcaactgtggttaccatatcacggaaataaacagtagcagatctatgtattaggaaatgagaacggaaagacaagtgaggtttagaaagtggagacattcctattctagtcccaggagtttcagagacattccagtgaaacagagagccaggaaagtttcctaaggagagtagtggcctcatgtatttattcatcaatgtattattttattaatccaacatcaatttataatattctaataatttcataatcatgtgattctaagaatgaaatctagaattcaaagaggtactagtgagacagcttgaactaaaagactgtccaatggcaggaattctaagcataggacctccatactctttgctccacaaaactcagcacatttcaaattatgttattctgtcctctttacaggttaatggggattacagattgaaactacgcacgtgtttttgtgtttccattttcaggttgctttcctgaggtggtacttaacctccaattagagaatgccgccactaggtggcggggtggtgacttggttccaagaggctacagttggtgggaccaagaaagggagggttatgggtcccatgattcttatatctatttcattttttctttcaaaaactgcagtggacagttgagaaataagcttcgataataagtttttagaaacaactaagtgtgtcatgtgatacctggatgacaatacattgtctgagaaatacagtaagacaaatgaaaactctgggctttgatgcaagacactgagtttcaattttgcctgtgccatttattagttgaatgaaaagcagaaagttccttcatttctatgagcgttggactcatttaaaacttgaatcatcatacttatttcacaagtctgttagaagacaaagccatgtggtgcaatgtgctttgaaaagaacgtgggtaaccacctagatatgatccacaaatatgcctgatccaatcccaagaggtttttcaagttcacaacatttcacatagaaatgtaatctctaatttcttatgaaaaagtctgaagttcaggtaacacttcatcttcattcctctgtctaagaattagctggagttacgtgacccaggctcccctccctacacatgagtgtgctaacacagatttaggggaaacttgcctgggactccggcacatcaatgtcaaagaactacttgacatttcatgccagccgcagcttgtaggcttcctcagcctcggtttcatggtatctccagtcctgtttaagccatctaaaaggggcttttttgatttcctttgatttatttattctcctttcttcctttacttcccatacttggaggaatccaatggagaaagacaatattaattagataatctttaagggagtcataccctctcctgtgacataggcatgcttctcagttccaaaataacagagaaatttgacctctccaaacagaaattagctggcgactgaatgcatttatgttagattaaaaaatgtaaagttgacgcacctctctcctctctttgccgtctgttacaaactaaactgtgccttctctcaccccaaaatttttttgttgaagccctatcctcccggtacttcagaatgtgactgtacttggaaataggacctttagatgaagtgaaatgagctgttagagtgggctctttccaagctgactagtgtctttatcagaagaggaaatttggatatgcacagaaacaccaggcatggtgtgcacagaaaacagccacatgaagaggcaacaagagagtagctatctggaagccacagagagaggtctgagggggaaccaaccctgccactttgaccttgaacttccaagatcaccataaccacgagaaaatttatttctgttgttgaaaccattccgtctctggtactctgttatggcagccttagcaaactaatataccgaccaaagaggattctggtttggctacccagtccctccctttcctctttcctttgagcaggatgttttaaggacttttgtgtttgacactcaggagcaaggggggatggtgggggagactatgtgaaacatagaaggtcaaggtggaattgtccactttttaatggatcaggacaaattgaaaaaagcatggaagcacttaaggtatggcacatagtttatgagagctaaggaaaagtttttttaaagttataagaaatataaaaaattattttgaaattatgttgcatagactttgcatttttatataacttctctaggatcaaacacagtggtcaaagctttatagttattatataacaatacatcttcccataacaagcatacaaacaaaaacaccttttataaattgcaactagtatgaagttttatgtttcaaaaattccttatgtttcaaaaactattttaaagggcaaatgattaattcattgaaaatattttaaagcatccacattttagaagaaaatttaatgaattatttaacagagctacaatattctttttatataaaccaactatacattgataattaaaatctgacaatctgtaagcccaatactctttttttttttttttttttttttttgagactgagtctcgctctgtcgcccaggctggagtgcagtggcgggatctcggctcactgcaaactccgcctcccgggttcacgccattctcctgcctcagcctcccgagtagctgggactacaggtgcccgccaccgcgcccggctaattttttgtatttttagtagagacggggtttcaccgttttagccgggatggtctccatctcctgacctcgtgatccgcccacctcggcctcccaaagtgctgggattacaggcgtgagccaccgcgcccggccccaatactctttttgaattattctttataaatctcaataggtcaacatctccccatgaaaagaatcagaatacaaatgatgtgataatgctcgtgaaatggtctttcaaattataaagtatcacgtatgtgcaacggattattatttatgacccttatctgaagaatgatgacttcttcaaaagaatattcattatttctgtcgatttctttaggctatcctaagagtgagcctaaaagaaaacaataatagatcttgtataattagacaagatattgtaaggacacctctgtaatttttcttgaaggtacatctttcccatcagtacttttagtattggtgactaccctgacataatatggagaagtattttcataagtaaaataatgaagttctacaaaactatgaggacaatagaaagatcagtggtggccagggatcccaggggaaaagtcaggtgaatccatgaaaaatagaaaatttttagggcagtgaagctactctgtgtgatactataatggctgatacatgtcattatagatttgtccacactcgcagaatgtaaaaaaccaagagtgaaccctattgtaaactattgactttggttgataatgatatgtcagtgcagggtcatacattgtaactaatgtgccactaatgcagaagatgctgataatgtggaggctatgcatgtgtgtttcagggagtatatgggatatctttgtaactttttctccatttttctgtgagcctaaaactgctctaaaaatagtctttaaggccaggcacagtggctcacgcctataatcccagcactttgggaggctgaggtgggaggatcatgaggtcaagagatggagaccatcctggccaacatggtgaaaccccgtctctactaaaaataacaaaaaattagccgggcatggtggcaggcgcctgtagtcccagctactcaggaggctgaggcaggagaatggcacgaacccgggaggtggagcttgcagtgagcagagatcacgccactgtactccagcctgggagacagagcgagactccgtctcaaaaaaaaaaaaaagcctttaaaaaactaataacaaagccctaaacaaatagcagggataaagaaagatacacagagtaggggaaaggttccccagaaaataagagaattacactgaataatttttaagttcattttatgtgtttgtcacataggcatgggataacatcgtgtgcctttcaacacactaagcatacaacagtggtaaaatctggtgctctggcataaaccttcaggacaaactctagagaaatcattcttcaatctcattggatccaaaaactttaacatgctaaatgaagatctgtcataattagagctggaagtcttgctctcctaactttcacttaatggagaaataataaaattattactagcttcatacttttcttacaagttgatcaaaatggaactatttagctgttgattatggactttttggtagaaagggaaattatctttctctcattgtctcttaggcttacaaaaatttataagtattttattttattcaaattatatatacacatttacacatatacttttcatagaagaaaatttgtaagattttttgttcaaatcatatatgtacatataattatatatgataaatatataattatattacatataataaatatataatataaatatataattacatgttatatataaattatatatatacacacacagtggggcaggaaacaagacagatcttcgcacttgaaacaggtttttaatataactagtaataacttttttcttctctccacacttttattatgcattctttccctgtggaattatagaatcacagtattttcaaacttaaaagggagaacatttgatttttacaaagaaataggtcctgagtgagacaatgaaaaataaaagaagtgtctttaattctatattgttgcattaagtctgccttcaacaggtatttatgaatacctgcagttattttttattcatataatacatcagcgcatacatagcatatcattgtgtaaatacagcattgagatgtttgttattttaagtaggaagcattttgcatcatgaactgtcaataaaaatgaaattaatgacaatatataatcatgtaagcagcagtgtcaagaatacttttagcacctatactgagtgaaatattgttgctgtaattgtctttttgggaggtaggaagaacatagagcaggacaagattcgatccaggtagaacagaagttgggtatcagtggtctgggttctcaagctcacttctttcagagaccaaaaaaagtttcataaatgccatgtgtattcttaaatattctaaatattttaactctgcccatgatatggtttgacttacttcctggtctcgcttgccttgctctagatctgttctggattgtcaatgttcctattaaaatatgactccaataaaggaatacatactttagatataatctgatctgaggtgacaagagaacaacttcaactcttatgccttggatatgatactgccacgatcaccccatcactgtcttggactccaacactggactgcacagaatactcagaagggtgctcattttcttctacaggtaataaaggactcactcctcagcagtgatccaagtttcttttccttttaagtaggttctcataatcagcttcctttatcagcagccctaacattataatcatcaaatttatttgacattctcttaccaaacatacctcttctcttgaagattaatgattagagttactttggttaaaaatcaagtatcatttccagaatacactctatagtctcaccctatgtcatcttccattttcaacatcactggtcaataacatgactctatacctatcttggaatgattccccagtccttactgaaacacttttaaatactagaaagcagccactgtcttcttttttttttaaggatatttttattccaaatgcattataatttgtatatgtaccatcagcgtgattctcaggaatacttctggcctgtcctacaaagcaattacagtcggctcatcttcgtgtacttgagtttgactgtgaataaatagctttctcaacttttctttctaccaaatatacatactgggccagcagggatgtgtagtatgtagaaaaaataaaagcaatatttttctagctaaaacaacgtcacttctccaactcatacagccctgtatttctggtcctaacataatgttcaaaaataaatctgagcggttttaaatgtaggcacatattttataaaatgcatagctttctattccttcaagcagctgatttatataaagcagaaatccattcacataggtcagaaatttgtaaaatgtatgacaagagatttagctcattatgcttatcttgtggtctgcccaaattgttaaagcttgtgcctcaaagtatgctgagcctctttggcacactgacccagtgattagtattttctcacccagtgcaaggataatgcatacctcagaggatcaggtggtaactaaaatcattgaatcaggctgagtgagagctatgaaactctggagattctcatttctccacttacaaaatgaaactgtggcttagagtctaattgacactgataataccatagagctatacattcatattactctggatgaaattttcattcacagcactaaacatctgggtatttccacatggacttattttcatatatatttagatgtttgacaacctaaaaataaaatagtatatacctggtggaatttttctttctgtccatgactatcatatggatggattcagagtgtgtcaagtttttcctgataggatactcatagaaatgtaactttattaacagtttaaaaaccaatactatctttgaaacattgtggagtctattcactctacctaactataataagactttttaaatgtacgcttttttagtaaggaatttgatcatttttataacatatttttcagatttctcaccaataaaaaattaaaatacagtgcaaccaatattaaatgttaaggcttaatttaactaatttatatagcaaggatttacaagatacctgctttgggtcagatatcgtgcaaagggttgtggtaaaagaagcatgctgactgactttgtcctcaagtggtttacagtttaatggagaaaagcatctccaccaagtattctgtctcccattgtggttgtcttggagccagaactaggatgcagattggcagtcctatacgtagcccggagggcccaccaattgcttacctctttcaacaaaggcatcgtgaactctcattttgaagtgggaacaaaacaaattttttttatatgtaatgtatcattggccttttgtgttatttttcatgaggattttatttcaactaaagtcgttaccatttaaatgatcaaagagaaaagtcagagtccatgatttttgttacacgtttataatgacagatacagttatacgtatttatcgtgtacaacatgatgttttgaaatacagtcatgcacctcaaaacatttaggtcaaaaacagagcacatgtgcaaatggtggtcccataagcttgtaacactgaagtttttactgtaccttttctatgtttagatacaaaaacacttaccgttatttacaattgcctacattattccataaatggacaggtttgtagcctagcggcaataggctgtgccacatagtgtaggtgtatagtaagctataccgtctagttttctgtaagtatactctacgatagtcacacaatgaacttgcaataatgacaaatttctcacaatgtatccccattgtaagcaatgtataactatatgtatatacatatacacatttcacaatgtgtgtgtgtatatatatgtatgtatgtgtatatatgtatgtatgtatgtatgtgtgtatacacacacacacgcacacacacacacattgtgaaatggttaaatatacctaagtaacaaatgtattacctcatctagttatcacttttgtggtaagaccacttaacatccactttgcatttttcaagagtacaatatgtcttctttaactacagtcaccatgctatagaagagatctcttgaacttaactcctcccatctaactgtattacatacactttgaggaacatttctccattcccccttcccccaaccaccccagcctttggtaaccactattctattctctacttctatgagtttagagtttatagattctacatgagtgcgataatgtggtatttgtttttctgtgtctagcttatgtcacataatataatatcctccagtttcatccatgatttcaaagagattggcactcccatgtttattgcagcactattcacaataaacaagataatggaatcaacccaagtgttcctcaatggacggatgaaaaaagagtccatcaactttaaaagacacaaaagactgttccaaatattaccttaaaaattgagatttaaaaactaatctgggtaaatagcacattttttaattccttgggcaaagtttttaaatgggagtgttagaacacaacaaaatgtaatgctctgaaatgtaaaagatcattataaacaatagagaggtgagatgccacttttcattttttagccaatacttagagcttattagataagcatatctgatgggacagtagagctttttaattgcctgggagacaaaaaaaaaatcccatctatgccataaagctgtttagcaacatgtttggctgtaaagaatgtgaaatgtagataaaattaataactaaaatattctagggtgtaaatttctaactttccgtcaaaaataacactctaaatgtgaaccatcaaggtagacgtgacagcattttgtagcattctttccaccatttaaatctatttagtttttgtgtgtgacaatttgacagtcttgagcatacaaatgaagacacagggtaaaattatagattcagttttcagagaccatatttgcaaagacaagtatttttttttttcagcaagaaatcaactaagcagtagttacagaaaataacttaataagacagtgaacagaaaaccagtatctacttaacagactcaggaaagagatcggttatgagatgcttggggtttctgtttttgttagataagatgtgcagttaccagaaatctaaggaaaggtaagagccccctcaaagatttcccttagaattaattatctaaaaattataatggattactgttcctattgattgcttagatttggcccaccacaatctctgattcggcagtacatgtgcaattttctataagtctttctggaaaatcctagtataaaaatgtatttttagtgatgtttgttttacactctgtattcttctcggtgcctacatgaaactctatagacagttactgtgaacttcaagatcaggcaatcagtttcaaacacgtatcgtgtgtccttctgtactcatttttaaagatgtttaatattcagtgtgaggtttttatattggggataaaacgaagtctgcgttatatgaaatttaattttgaaggtaacgacatttgaactgcagtgttgtgttgttatatctccttttttgtctagcttttataaaatgatctagattaagtaccataaagatcataaggaccttataagtccctctgcatttgaaacagtgaagggaaatgtgttgctttcacatttccatcctatccaaggggcctctacagtgcctgaactcaccaatgaggtaacagatgaagggagaatagtgatggcctttacaaagccctcctgggggccggatgtggtggctcacgcctataatcccagcattttgggaggccgaggcgggaagatcacctgaggtcgggagtttgagaccagcctgaccaacatgaagaaaccccgtctcttttaaaaaaatacaaagttagccgggcgtggtggtacatgcctgtaatcccagctacttgggaggctgaggcaggagaatcacttgaacccaggggacggaggttgcagtgagctgagatcatgccattgcactccagcctggggaacaaaagcgaaattcctcctcaaaaaaaaaaaaaaaaaaaaaaaaagtcctccgggggtcccgagtgccaaactacaaagccaactttttttttttaacttcttctctcacaatatcagcaaatttgctgtcaacaaacttcttaactttatagttttgtacaaattttgaataaaagaaagaccccaaaggatccagaacggtgcatccattctaaaggcagagagctgagtattttgtattctgataaaaagatatgaaaagcaaatgaatcacataaataggattaggagagaatgttcaacttttttatgaccaaaatgttttcaggcacttgaaaattagaagcaaatgttcactgatggcgattagggaattaatggcctttaaaactgacaagatttttttcattgctttagttaatatctattttctaacctttaacctgagtaaaaaagaatctgtacattagattgagcataaaaaccactgagcaaatgaaaaaaaaagctaaaatcagtaataatgctcactaaatttgtaaatgttgaaatgctgctttacctttcatgacctcacttattcagccatgaaaaaagggtgagagaaggaaggcagcaagataatttctatatctgttctctaggtataagtgcctatgagtctaaaatagactgctgaggatattagaaagatttcatgaaaattaagatttggggaatataaaaaagcttacaaatctgatgttctccaaattcctgaaatttgtaattaccaatatcatgacccaactggttagaaatatgtaaataactaaggaatgttttgaaaagtcctaattattacagtgaagaggtaaataaggtcaacatgctagtgtccaccatcaaaaggaaatttcatgttgtttactcagcttctctggacactaccagagacacagctcttagtggcttttaaggtagtttcttcatcactgggcaatagttcattaacagactatcccaaacttatataatcttttcattctggaaaattttacacatgtgttgtttaggttaatcaggagaaacaaagactaatcagaataatctttagtagtaagctaatttagctcttctcagcaccgtttcaaggaagatatgtgcaagatgtgtgaacaaatgggaaagagctgaagtcagtaacaatgctaactaaagttgcaaatgctgacatgttacttcgtctctcttggcctcacttattcataaaatggggcaaggggagaaaagggatgagataatctcagatctgttctatgtctaagagcctatgagcctaaaacagaatgctaacaaaattgaaaaggaaaactaagtagtaagtgtactgagttgtgctcctgttcagtctttttctattcaacctccctaacgtttcactcaaggatagcatttcatgtaagacatacatcataacagttcagatcagatgtcctccgtatttgagatttcttactttcttgagagggaaggagatgattaggacaaagaaacagcattgtctgcaaataccaagtagcttagtgaagccagctaacaaatggaggccaaatgtatatgtggccttctttcacaagcaggccaataaatgtagaaacctcacctaacctgcatttggtttgagagccagtgcatgaagtttaggaataaaggataattatttggccatctgagaaaagctaaatcttgtaagtgggtattaaaagatgcaataaatgatattccttgccaatctgaaaaggcaaaaaataaaaaggtagtctagctgtttatgagatctaactcctccctcctcctcccactctgaaaacagtgaagatgaaagtgattgtatcatacgccactcttacgccaggaaagctcaagaataaaaccatcacagttcagatggactaaagggtattttctaggtttatgaccagaatgattcatatatcaaaggccaatcatatacatgtacttgctcagggattttcaagtcgatttcttagagatgaaacgtactgctccctggctccaggaaacagagcaatgctaaagaggtaaatcaaaacagcaatagaaaggccgggtgcagtggctcactcctgtaatcccagcgctttgggaggccgaggtgggtggattgtctgagctcaggagtttgtgaccagcctgggcaacatggtgaaatcccatctctaataaaatacaaaaaaaaaaaaaaataattagccgggtgtggctgcgtgctcctgtagtcccagctactccggaggctgagtcaggagaattgcttgaacccaggaggcagaagttgcagtgagccgagattgtgccactgcactccagcatgggtgacagagcaagagtccatcttaaaaaaaaaaggcaatagaaattattcatgtttgggaacatgaagatattaaaatcataataaaatgagaatgccaatcaaacaggaataaaaacacttgctgtgtactgtttctccttctccagtttaaaccagaaaaacactagatccaagagataacatgtaatacattaagaaagaaactttcacgtaggaagccaaatatcctcccacattgtttcccccatatgtgtacactaattactggagcatcttcacatgccagcgattatcaaagcctcacaagtgtagactgcagtgtcagtgagtgcttggtaagacagaccaaactccgtcagtaccttgccatgtgatcctggacaagacatacttgtcctctcatggtcattaaaatgggagagggaatggggacaagatgctatctcgactctttacagcaccatagatttagtttctctagcaaggcctatgctccttaagtttatggatgtcacaaagtggttctgtattttatattatttgtcagaagattagtaataggctcccattagaaccagaagaaccaggcttttgtgtgaaaaaaaaaaaatgagtgagtaggctacctcagtactttaagagatggtaaaagtatcctgctttgacagccaggtgaaaaagctaataaaagcacagaaagttttcataaaggggtacagcttcagatgtctccagataatccctctgttaattgtgaagggtcatctgtagggggccactggtatatatctctttactaagttagctggttaacactggatccttagggaatgagatgatgtatgaatatggaaggagtcaaggtgctaagctgtactttatgttctaaatgtgtaatttcctctgctttcttgattgatctctttagcattgtcctgttttctaaagtcaaattttgacacatattggatggacaacagatttcattatatgtgtgggggaatggaaatggaacacaacaactgaaatggaaatattcagaaaggggcaggcaagggcaaagctttatcaagaaggtgtgagtggacacctactctacaggtctttaaaattcatttttatgcatttaattaacacttgccattttacaaaatacaatgtcaatgtgagttatttgacattatcctcaccacatctccatgcagtaagcccagagactacagtttagagaactgatatagctccaatcaggccacacatcttgtaacccgcagagcttgaataggaacccagtcttatattcatccctctctgtataccaccaccatcagcccataactgtggaaactctattagcctaggaactcattaaaatcatgtttacacttttactaacttaaaatcatatttatttaactagatgtctcattagcttattgaagtcattactgcctgtcagtcagagaaagcaaacgaatgaatattcttcataatagaagagcaagcaggactgtaattaatgactttgctaataacagccccgtgtttgtgcacattgattttcagatatggaatatacacataaacctctggggaacaatgttcttctatttaccaagaacaaatctactaatagttattaacaatacattctttaaaaggctttatttctaataatctcttacatatggatgtttcttcaatgtgaattaccaaattgactttgaacaatttatgctgccaaatttttccatttatctcattcagatgacaaaagtaaatacaccaaagattatttctatgcaaaaatgtcttaagtggagtggtatttgagatgggaccctgaaaaaaaaagtaaggtatccaacagaaagttccaatgcagaaggaatgcaagatgaaggaaacagcaaaagaaacagacagattgaggaagtggcacagttcccaagaacagagattggcccggtagctctaatgaaagcattagaggaaagatctaaacagagttttgatgtcaggctttggaaggtcatgagtactttgtctacatgatagcaaaatccaaatatttaaagccacagataactgcccaagatttttgtctccatttgtgtttggtcttaggcacagatttattatgtgcctgttctaattaatgtaggcaaaaacactgttttttaattgaaataagcactttctgttttcatacaacactgaagcaaatgctaagctggaagcttttatttttgtttttgacaacggtttctttaattgtaagggaaaatcaagaaaatatttaattttgtctcatatccgaatagtagaggaaaggccatattgttggaatgcagtgatgggagctctattattctccctatgtgaatttgcagcattagcatctctgaactacgggttctatcaccagaaagttgaggataccagtaattaccactttacttgcttagaggaatacaaattataatgtatatgacaaggctttgcaacttaaaaagtgctataacacagtgagcagctctctacgtgaagctgataaagactgaaaaaaataaggttaagaacttgtgattattttatatttattttctatatttctagtgcttgctcctgatatcaatgaagaaaagtgggaaatacagcctgctaaacagtgcttgatggtaaaaatacaatgctaaagcatttcattggctcagctacttttattttcaaaaacttcagtctatatataatattaggaggaaaagactagtcaaagtattgtttagattttttttaaaaatgtacttaaaagcattaaatatttgtgtgtgtgtgtgtgtgtgtgtgtgtacatgcacactaggtaaaaataatgttcttctgtagtttagaggactgatagaactaatttggtattttctttccttataagttgtagatttcatatgcatttgtcttataacctgttttttaccttgacctagcttaatgatccttctaaacaagatattctctagttaaaaggaattagaattatgtgaaattgacttgggaggtaaaactttattttcattcatttgcacatatccttattgaaaagtataaacaaagttaagatttggaaggccatgctaaactcttctgtaaatatcacatgtctatatgtctaaggatttggatacatgttgcatttgaagtagcttaggtgtctctaataaatgagtcagcttacaagcttacactcttttttctttacttttttttttttttttttgaagatagggtcttactctgacaccccaggctggagtgcaacggcacaatcatggctcactgcagccttgacttcctgggctcaagtgatcctcccatctgagacttccaagtagttcagattatagattatagattacagacttccaagtagttcagattattagctgtcacgcccacctaatttttaaaatttttttgtagagacagggttctcactatgttgcccaggctggtcttgaacttttggccttaaaaaatcctcctgctttatacttccaaagtgctagaattataggcatgcatcaccatgcccagcaatttactttctttactatgatttcaattttagacatgtcaggggcctccctgaataactgcactttttagaaataaaggccagtggttcattggccaaaaagaatttgtcgttaaaaaaaaagcaaatctgtccgatttattaattatgattgtgtgatttgatccaaccaatgatagatggcaaatttcacttttcaatttgtctaggtattagatgaaggtcacccaaaaactgagttggaaaaaaaacttgaaaaggaatccatctaatccatgtcttttagccccacacacggcagatctgagcaaaaagatgaaagaaaattccattttctttatcacagagcaaataagagtctcaacatgcaaagctgtacagcagaactttctctaatgatggaaatggtatacctctgcactgtctaatacagtagacacataccacatgtgactactgagcagtcaaaatgtggttattatgactgaggaactaaattttaaatagccatatttgtttagtgtctactatattagagagtgccactaaatattttagtcacactttactgaagcaagaattgtaaagtgccacaatccaggcagataaatatgctgcattttaataacctgtgaagtcaggttgttgccttttatgcaggtcccataatatcaggagttcactttcagatttgcacttggagccaggagtggtggctcaggtttgtaatcccagcactttgggagatcaaggtgggtgaatcacttgaggtcaggagtttgagaccagcctggccaacgtggcaaaaccccatctctaccaaaaatacaaaaatgagctgggcgtggtagcatgcacctgtagcctcagctacttaggaggttgaggcaggagaatttcctgaacctgggaggcagatgttgtggtgagccaagatcgcaccaagactgtactccagcctgggcgatagagtgagactccatctcaaaaagagaaaaaaaaagaaagtaagaaagaaagaaagaaagaaaaaatttgcactccttggaagaagtatgcacagctctgcttcattatctctgcatttctcttccttagacttggtcactattgattttctactctcctaagtttggactgctcattcctcctaatataaatgctgtctaagcatgtgttgtggaagaagtatcctctgttatcttttgggaggacaaattatgacagccattagaaaaaaaaagattaatctaatttagaaaatctcttagtgtaataggtctttaagtagatttttgtgtggtcccagaattgtagctaaatccaagattaaaatattcaaccttatccaccccacattctaaataagcttcctagaattagagacatctaccctttatagcactttctaagagattaaagaaataccgccaactaccataccatatcctacccccatgttaatataagaaaaggatgagagatgagagagggttttcttggacctaggtctttgagagacgcagcgttcctgaggacaatcaattcccttccctccttgtggattagttaggggaagggagaatatccctcctgcctgaagctaagtgaaggaagctccaagaatattatgcataaaacttaagtgcccagcaagaagagactagcatcttatccttagactgggtgcttgataaacagtagtcctgttggtgtaggcagagtagggagtgcttaagaagttcttgtaaaaatgtgacttgtgccacctcatgttttcggcctttgagaacatagaaaatggtgcccacttctgatgaagagatttggaaatcaggctccctgctataattgattatgggatcatagaggaggccttgaagtggtgtgataagcgtggaagaagatgagaatgccagctattccactccagtctttacatccctgcagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggtcacaggaagttgaagatgactccaagaaaaccatgcatattgctaatatggagacaattacatcacctgaagctttagcagcagacagaaccaggccaatccagagcaatgccatagacatcactccactatcttcatgtgcctttataaggagatctctgcctttccatccttttccctttccctgaaaaactgaaggctctaggcccagaagcagcaacggaaggggaaatctcagagaaccctcttctctttcactctacccaacaaaggatcatagatcatagctctagtctccaaaagggaagatcaatagcctgaaatcagatatgagattaaagttttttgctaaattagaccaagtggttggagaataatagaatctactcagtacgttgttaagcaggaaagctggatttgacaaagtacagttaaaagtaatgacaggaagaacaaaacaaagcgtaataggttcatatttatatccaccaagttgagactgctcaattacaaaagaaatattaatgcacttctgtgtttttggtttttagtccagtttaacagcactcaatctacattagtaaatgaatatttctaaaccatatcacacattttgaaacaaaacccactcatattttcgggcactttttcaaaaaagaaaaaatatattttcgacaagatagggtggatgatggggaccctacctataagttttatttcttcaaaagttgccttgctgtcattgaaacaaatggtgagcaaaacgaagttaacagtttaacattttattaaaagggtgtctgtatccaactctaaagcactgccctgactctcaaccctcctggagggccccctggaagctgcccctgaagcttccttcacactgacctcaatagtgggaaatcttattctctgggggtgaatgtaaactttagagttaggcagaacataatttcacacattttttcatgtattagacatcagtcgtggtgctaagtcttgaggaggaaagatattatattgggaaaaaaataactaggctttggcatcagaaaatgggatcaaatcaaagctataggctttattggcagtctagtcctgagaaagccccttagcatttgaatatccatccattcatcagtgaaacgaaaataatacttcataattgtattgaaagtccttaatgatatattatttgtagagcatatagtttctgggatttagtaaacatccaaatgttatcaaccttcaacataaaaagattatgatgtcatgcctcctaaacttaaaggccagttgtggagacatataattacaataaaatgtaatgagttctctcagatgtgagcagattgctatgacaataaagaggcagatgactaactttccttggaatgctggaacagtgatatttgagctgaagcttttgcagaaggagggattcttcaggtacaaaagttgttggacacggagcgatcccggcatagccaaaggcaaatgcagagaagtatgaaatgttcagtgtatttggagagtggggagaagtgaagtgtggctagagcatatggcatgtagggggaataccaggaagtgttgctggaaaagcagtcagggccaaaatgtgaagggtcatcgatactttgctaaagggcttggcatttatccagcagaggatgaagatctgcaacggggatccagcagaggtttttagcagggcagtgaaatgagtggatttgtttttcaggaaatatttccttggcatcagagtggctgatgaattagagttgagagaaactggtgtcaagacttacagcaacagcctcctacctgggctccctgccaccatttcagacacgctgaagtggaggtgcctgcaggacactcagtgtaaaccacactcacaaagctaagcagaggaaaatcctacttagggccagataaattacagggtaattatttccactgcagaaacattctctgcttcataaaaggattcattttaggatcccagagttcctctaaatagcaagtttcttagtgcatttaggcatccctttacagctcattagctacttgatagaggcggagaaagtcaagaaaatcctaaagatgtactttcaagtgttcttattaaaaatcttcatggatgaaaataaaatgtttgaagttatcatttttcaatgaaaaaggaaatttgatttataaaagcacttcgatgtgatttatagaaactagaataagaagaatgtctgttacgatattccatagaatgcatttcacaaatttcagccaccataactcaaaacactgtagggagtgtgacaatatgagtagtcagattaatagaaatagctagaaatacagctgtttagccactgaataagaacctctattgtctttaagcctgaatctcatacatagttttatgttaagtgcttctctctgtccacagtttctcatcagatgaactatgtcctttgctacataaattaaagaacatgttgtaatttggatattttatatatatacaccaaattataaaagaaaaactattttaatctcattatattgaattttcttgtgaatagatatttcacgagaatacattattaatatcaacggagtcacttccagaatgcaaataaatgtagaataatttcaattttaaaacaaaaaacactgttgggaaccctctttgaggaatgctttcagagcattctttgacctatctttactgggagcaactcctttgtagtgaatttactttttcaaaatagacaaatttcaatttgagccaaatgcttctcagttgccacgtgagaggtatctaacttagctactgtctataagtgtctcactcggcataaagtgtagtattagtgttccttgtagtaccttcagttgaactagttcagagaattccttgttgataaaagcatgtggcagaaactgacaactgtctttcagtattcattcttttctaatgtgtttgataacaacacacgtttttatacttggctacattacttaaaaagttagacaatatttaccattcttccttgtagctatatgtagtcatctgactaaattaaggctaatatgatataaatgaatatatattatgggactttcagaaaagctgatttaaatgagttgatttggcttagaggaaaacattttctcccctacttcttccagctattgccactaccaccaccaccatcatcatcattttcatcatcatcatgaaatgtggatgtaatggctagaattccagcagccatcttgaatcaagaggtgatgaaaattatcaatgaggatgggaaaacagaaaaatagaaagctgggttcctagtgtcctctgggaatcctgtgctagctatggactgtagacattcagatccctttttataatagaacaagcttctgccttgtttaaaccacttttagtttgtttaaagtgaaaattaatcttagctgacacaggttatatcaaaagagaatgtattcttgtctacataaattatcaggataaacatgcacaagatgaattaaggtgaagtgttttgtcattctgaattttctagcttcacaaataatgatgatgcaaataagaatatcccctcacatcagtacaggattttagagataggatacaggattttagagataggaatttttatatctgtgaccacatttaatctttgaagtaactctgtaataaagcagaaggacttccatttcccatacaaacagatgatgaaattaaggttgagctatctgcctcaggtcaaacaacagcagttggtacagccagaaaccaaacgttcttgacttaaaatgtattgctttcctattgataacttgcaggttctacacgtgaacattagtcacatgttgtataccattcactacctgactcacttacgtgctcctttgattaaagataaaaaaaatagctttcatagtttttcactgggcttctgtttttgccatggtgcagtaacagtgactagatttaacttcccactttaaacaaccaaaaattataccatatatgaaacaatgattttcagatgttgggaaacatgcagtgtacaactgtgatccttgagagaaaaaaacatagtgagcattgccccagaaggaaatgtctagacagcggcacagaaagaaagaacacaaacagccaaggagattcactgagctgaggaaacagaaactggatttcagggagccaggggaggcaaggtggctagaagttgggtgtcagtgtatcagattaaaagaagtcagtaatttagacgaatactgacctgcatatgtgtgagaggaaactacccaaggctatgggagaaaaaaaatacacaagaaaaaagccagataattcttggagctcacacagagccaagagtagttcatgtccccacaaaggtggacagacctggtaatatatggggctttggctggagctctaagaagggtataactagtttaataaaattctaggaaagtcaacatagagtacacagaaaagagatggaagaatagaaagttacacagtaacctaggattttatgaacttgaacataaatgacaattgcagcacttctgtttgacctcggtatttgtcatagaattaaattaaatttctacatatcggatatagcaaggaatagagataaaagtctttaccatcgcggagcttatattctaacgagagtagaagagagagacagtcatgtaataaatattatattggaggaaatgagtgctattagaatataaatgggggtaaggtgttgtgagaaagaatgtggcaattttaagaagttcataaattcatcaaggtagatgagaccaaagacagtgatgaggccagggtggctggaggcaacgagaagaacaacaggagagaagtcagagatgtattgatgggttagatcctgtaagccattgtgaaaacaggagagattgcaaggtttaaagcagaggtatgacataatgtctcatatctcgaaaggatactcttcctgttgtttggattaggctccaagggtgcaatggtggattcccaccactaaggaggatattacagtattccagaggagaaggactgaaagcttggatttgaggggcactctggacaaggtgagaaatggtcagattatgcatataattgaaaaaacagagccatgacaatgttcaaatattatatgtgggatataaaagaagagaagaatccaggatgcttttgagagttgtggtggtttttaagcaactaaaagggtagagttgccattaacgacaaaggagaacactttggatggagcatagtagaagagaagatcaatcctggacatgaaaaaatcaatggcggtttagtgtgtgataccacaatattgtgatttatttgtttatttttttgagacggaccctcgctcttgtggccgaggctggagtgcagcggcgcaatctcggctcactgcaagctccgcctcccaggttcaagcagttctcctgcctcagcctaccgtgtagctgggattacaggtgccccccaccacgcctagctaaatttttgtatttttagtagagacggggtttcatcatgttggccaggctggtcatgaacccctgacctcaggtgacccacctgcctcaacctcccaaagtgctgggattacaggtgtgagccaccgtgactggcctttattttttgtaaacataaaaatattgtaaaatattgttattttaacaatacattttaaagaaggtattagatctgctgcatggtcatttttaaatgctttaaaaaagacataatacaaaatagctttccctttcaaataacataataaatcctacataattgcatattttagaagaaataggaaaacacgaaagtttagactcttgctacaaagtgaagtctctcccacattaaacacaggaatgttaaacagcctatagcgttctcccaaatagcccattgtgcaacttgaacaacatgtatttgcaatttaacttctgttttgcctaacttctttttcaaatgcatcctctctgtgttgcaacactgtcacttatacagacgtgcacagcagggcctacctttaaatactgaaatctctgagaagttgattgctcttccaatcacttatctggctgcaaaccgctgagttgttgccatgattaacagttattctttcatagacaataaaaacaggaaggttatatagtgaagatttaaagctagaaacaaatatattgataatgaatacgaacactgtcattttgcagctatgaaaactgaggacagtgtagggaagagatttcccataaaacgtcaactctgatttagttcaggcagttagtttcaggaaaaaaaaatgtattaaatgtgttatgtaaaacggtgtggggagaagaatggttaagtttaaataacttgttatttagaagatggtaggtgaaaagaaatacatatatatttgctgctgtctgtctgccccctatactccactgtgtgaaaatgcagtaaactgggctaataacttatagcacaatttgcacagtcaaaatgaaggtttctgctagataccattaaactcaaaggtcacatttaatataaaccttttatcctgcctggactcaaagcagtttcaggatttgtcatttaacagtcataaataatgtgcctcattttgtggcatcctggagactgagaatctctcatattttcttctcaacattaaaattcacaaaaatggggggggggttaaaaaaagaaataaaaagataacttggtaatttctgttgataatttcaaaagctggtccttgagctttggtggagacaatctcgttagcatcagtgatgtgtaatacaataaagagaaacacacaaaaatcaaacaccctgtctggagtggcagctgctcttgtcagagctatctgtctcgtgccagtcccagaagtgcaatggtaccaatggtctttgtcccatgttcttcctgcagcaaaacttgtcaggttatgatgtgccaatctttatcaatgtctacagttctgcacaagaaggttcctcacagaacgtgcttacgcttctgggcaagaaaacgctgtgtgctgtcactcttccttcccccttgtaagcacaattgtcccagcaagcgagcgccagagcagctgaaggcgaaggagagcatctgcctatttctaagtcttggttatctgaaagcgtctccaattcttttttttttcccttttttttggaagctgcttttgtagtcagtagggagctctggatgaatcagaataggaattacccttttaagagggaacaccttctacttgtttgaaactctaaatccaataacactatttccagacatgaattaagctctttaaattgataaatgctcatatcattttattttctcatttataaatatgcatctcatttcattcgcacagccatttccagagtaagtattatttttccactatagtgatgatgatacagttttcaaataagtcaagtgacttatctgagatcgcccagcttagaaggggcaagactaagtcttagatccagtctagctctcattttacttcattttaactgcctcatttcaggaagttacagtttctatcactataggagtttatcctccagagagttgaagaaccataagaactgtctctctccgtggctcaacagatagattgaacacagctcacactactcacaggcctgtgattcagccaaattgttccttatttcatgtagctgtggtgactctcaatagattggatcttcgtggcccatttattccaatgcagctttcagtttcactgaccgttgtggaagctgtgggcatttgactgtgagtgagctctgattccagggttggggaacttcctggagtaccagggcatgaaagacccaagtcaagaaaagggaggggcttttttttaaaaaactgttacttttctccctgtgtgtccatgtaatttacaaatattataacgctcgttactagaatgccaaactgaattaggtcatttctcaatctagaagatgcttttccttcgacagagacgggaactgtaacatttaccaagaaactatatgattgtgtgtcacgttttacatttactaattcatttttgtttattcttcacaataaccacgtgagatcagtgttatactcattttactgcttaggaaattcagagccagaaaaggcaagatattttctcaatatttcatgtttaataaatgagagaacccagaaccaaagctagaaataataacagtgaatctctgagtaagcacagtaacatttcttccatgaatcttggtgtgttttacttttttatttgcaaatgttctcctgggggaggtaatggtactgtcaaatatttttgctaacagaagatgtggaatgagaagagacaagtgacacataggtcaccatcatcagatgctccaaataggtctatatgtgtgttacagtagaaaaaaggagctctaactacaaactggcttccagatcagtcacattttcctgtgttccacatagtttcagttgttatgatgaagcaacttacccacgagcagaaataagcatggagaaggcaaattggtaattgacatgttaaaagttgttaaaaatgccaactcataagcattgttagtccaaggccaacagctgtcttaaatatcaacattaggatgaagctaaatagcacacacatctttgatcacataagaatgtttggagaagaatgattttaggaacttgcattatgtaaagaataatatttgtcaacttaaatgtagttacatgaaaacaattgttttaggtactctcacatgtaacccagttgcctccttaggaatgaatttattccacagctgctgggagaactgctggaagaaattcttcatgctttcagctccccccagatctgcttaagagagctgccttacaatgactaatcgacatggaggtataggggccaatcctcttcagcctaaatcagaggatgcttacgttgtcatcggctcttcccgaactctctacaggagtgaatggctgtgttctcccatcaaagcttcatccttactcacaattccctctgctgaatcctgtttccttgtcttccctttcctggctttccctcgaaggtgttgatatcattttcattctcaaataacccccacctgcccattagactctgcactaatctctgtctcagagtctgtttttctgagccaatgaagaagggagagaggagaaatacttggtactcatcacccagcaatttaaagaagtctttcttaccctcacaccactactgctggttgctaaaccttagcactataattgatggacctcacatggcaattattcattggagcaatggtgcttcttcagttaagatttttacttactacacattatctgtagcattgggcccaaatgtaagtgcttggctaatggttatatgggtcttaaaggccaaaaagccataaattcaatactactttaaggctgacagcttctccacaacactcctgccgactctgtacctattatctcctagcaggtcttctgttaggaagttctcattgtctctccaaatagctcagagccatctctgtacagattagactgctctctcttatttcctccaaaacctttttcccctgtagaagaaattctgccaatcttttactggtggtagacatataaaacaaagccatttctttgatataattcttcaatgacataaaaacaactttctagtttccctaaaagtctcatctaacgtccagctttttattattctttcctcacaggaattaattttaagactcctccttcttcactttgctgccctcctctctatgcatcccactatcttatctgtattaaaatgttgaatatagtcatgattaattcattgtacaagcacgtgagtttctattatgtacaaggcaccttgctagaccctaggaatatagttcacaaggagctcagataacacagtaaatttaggaaaatttactttcctctgaaaccaatttccagaccattgttacaaagacaatgtagtgtattgttatattcaatgacagaaaaacaccatctcctcccatttacatttctccaagtgactatttcttttattttttctcctcgcacaaagaagtattattaaattattgttaaccagaattttatgaattggacattgtcacacatccagccatttgttatctaccccctggtaatggaggttattccctgccacccagatcttgttttactatccattgtctttaacaacaaaatggaaattatttttccagctcttagtctgaaatcaaaacaagatcactcttgcatggaaagtaaatgaatttgcacatcgttccatcaaatgaaatacatatcataaaatttgtatgtgctaaaaaacttggtttccctttatataaaattttttataacgtgtaataaacaatacctttaaaatgctacataatcagaaacttctataaaagatttataaaaagaaaattattgacatttggtaggatttggtaggcaatagcagggtagaaaacaatctctaaatagttctctcattcctttttcattttatctcagaaatcaagtttaattcacaaaattgtggagctgaaaataatctttaaaactaccattttcaggtgagaaaactgaggcccagagaaatgcaatatctgtttaatctacagagagtgtggagcaaacacgggcttaaactctggtttccaactcttatcactttatttcacaacaattttttctttgtactggtaagcatcttaataattgaatattaaggatgtgagaagatgaattaatcgaatcaggaaacttgatgtttctaatgtgtttgttttatttataatctgtgcagcaaggaaagcatgtttactgagtggcacttgctatacatacagtatgcaagagcacagtggttaagaacatttgctttcagccagataaacctggcttcacatccccacccagccgataactagctttctggcactgtgcaagtcaattaaccacacaaggccttagtttcctcatccctaaaagagggataatgaaggtacctctttcataagcttgttttgaggataaaacgagttaatccatgcagtgcacataaaactgcccaacaccttaagcgctatatgagcgtctgctgttgtttttgttgttgttactatttttaaactgaataagtactttttccatattcttctcaggttcagtttgaatctccactcttttcactttgtaccagccggtaaccaaattcaagctgaagcaaagaggtctaatccaggggaagaagtgggcacaagagtttgactctattactgtgggtaaatgctctttattagagagcaaagaggaacgtagacaacaaaataaaaacacatggagctgtaaaacacctgcaggcaggtctcaatggctgccaagtctctttgccatcatgtcaataatggttttatgaataacttagaattaagctttagtattttattaggaaaaatatataaaatcaaatttgaagatgtttctctgaattgctttgctttaaatagttttgtaacggtacacatgcatttagttcttttaaaatcctaatttaaaaggatcaagggctcatcactgccatcagtaattcatgatatatgacatactaattaattcttgtcacttttctttttttcttttcttttcttttcttttttttttagatggaatttcgctcttgttgccaagactggagtgcaatggcatgatctcggctcaccgcaacctctgcctcctgggttcaagcaattctcctgcctcatcctcccgagtagctgggattacagacgtgtgccaccatgcccagctaagttttgtatttttagtagagatgtggtttctccatgttggtcaggctggcctcgaactcccaacctcaggtggcccacgtcggcctcccaaaatgctgggattacaagcgtcagccaccacgcctggcccttcttgtcacttttctacgtcaggaaatcacgttctattaatggatctaaaaagtgaaatttataaagataaatggagaactttaaatttgagttcatcttgtggcagggcatttgtggcatgtgggaaataagtaaggagatactggcatcttttggggccagttgatctggattatatgtgatatggcttagatctgtgtccccacctaaatctcatgtctaattgttatccccaatgttggaggaagggtttgttgggaggtgatggatcatgcgggtgcgtttctcatgaatggttaaatactatccctttggtgctgttctcatgatagtgagtgagttctcatgtgatctggttgtttaaaattgtgtggcacctccccgtctctctcttcctcctgctctggctatcacctgcttccccttcctatgtcaaccataattgtgagtttcctgaggcctccccagaaggagaagcctatacagcctgcaaaactgtgaggcaattaaagctctttttctttataaattacccagtctcaggtacttctttacagcagtgcaagaatggactaatccaatatgattcacaattgcatacacaacaaagtactttgactaaaaatgagccaaggcggaaaagaggaagagcattttaaaataaccattttatttggacaatatcaaacttcataatttccatttgattgctagatttgctccacatttaaaaagttacaaatacatacctagctctatgaccacaacacaaatgtatcttccaggtcctgaccctgcctttcggctgcctattgtgacccctagctagatgttgccctagttgtgtagctgggttggcaaacttggaagtccacatctttgtttatttggtaaatgcaatgttataaaaattagaaacatttacttataaatatctatttttattttttttaattatttttaaattgagatggagtcttgctctgtcacccaggctggagtgcagtggtgcaatcttggctcactgcaacctccaactcctagattcaagcaattctcccccatcagcctcccaagtagctaggactacaggcacttgccaccatacccgactgatttttttatttttagtagagatgggttttcgccatgttggccaggctggtctcgaactcctgacctcaagtgatccacccaccttggcctcccaaagtgctgggattacagatgtgagccactgcgccaggtcattttaatttttaaatatcagaagaactgactagtggtttttggcctggctgcctagtgggatcacctgagatacttaaacacgaaaaacccccagaaatattttaatataatagatgtggtttgaacccaggtattggtatgcttcctttaagctcctcagatgattctcatgtgcctcatgctacagtgagctgggctacagtagcataaattcccaaagtggttgactaacagcaccaacatcacctgggaatatgtgagaaatgcaaattatcaggccatatcaagacctacacgatcagaaattctggggtgagactcaggaatctgtgtttgaacaagtgttccataaatgtgcatgtgattctgactcacactcacatttgagaaccactgcactatgtagaccctgcacatctctattagttattgcttatagttattgttttcactcagttaactgacttacctatagctgtgtttgtatttgaagatcctctaactgagttcattctcattttcccagacctaatttttcttttgaaattcctctttctgattatgacaaaaagacaccaaccaagcttcaggcattgttttcttttccagtgctaattcaaccctcttaatattacaatcatttttttttccttatagtcctactgccattgttccagtccaggccctcattacttcttatcttgacaattgaatctgtttctggcttccctgcctctagtacctactcactccagttcctcatatatactgttgacagttttgtcttcctgaatgcaagccaagtcataaactcattcagtttagaattcttcagtgacttgccattgaatatattcagtctactccacctagcatcaaagaccctccatgacctggctcctccttgcatttctacacttctccttcaccattctacttccctattaactttaaactctaaataatttactattgcctaaactttcctactccatattgacttttaactttatgtttcaacttatgctttcattccacttggattgaccaaactttgtcttctgttaccatctcctccaaattctcctcacactataattgtcccaaacaccatttccttctgaagccttccttgatccatcaaatcttaagtagttttgatccactctgtactaccttaggtttttattccgcctctcatacatcactcgacatactgagataacatgcacacacagacaacatattagttgtcagttacgaactatcatccatctagttggttaaccaaaaaaataataactgacttctataagataagaactgtgctaagctctatatgactggtaaatattggttcattgaaaagaagccttagaaatttgggggtataaatatgttttttaaaagtttctttgaaggatttttgaacaaatggaaacatgatgttaaatattccaatagtctactgaagatgataatctgtgaatcctctcctttccatcttcaaggcaattcctctattattactctctttattagatgaaatgagacacaaataaatcctccaaatattgtatcttaaaagcatcttgcaccaaccatctgaatgacaaagaggtgagttaatgtatttgtgtgactccatgagaggatggtttaaagggaagagtactggtaacaagataagactgggtctcagccaaacatggcagcttgcctacctttggtgctgcttggattttactcaaaacacacaattctccaatttcctctttgctagagttgggtgaccttttctgtttgacaaagcctcacaaggctaacccacacacacattcatacatgattggtatttctttttattttaagtgttcttcatgttccggagccttctcaccttaaagccacaaattctgcacattctcttaggctcttatatgcaagccattaatctgacagatcagccaatggaaaaatggtaactaggttaaaatgctatgcatacgtagtactaattagaatttaataaggccttactcaaatgagagacactattatacctgtaagcaccatgacagcgcagggatgtgatcagtatctttatactaaggtacgttaataaacaccagtggtgctggagggaggaagagatagccatcatgaataaccaactgcttggacctttagaacatcataaatagtcctttaaatatctacattttggacgaagtgacttaggaaggcttaaagctggggcaaatcaagagaacaatatgcatgggtaatataaagaaagaaatatagttcaagtcttggacatctaaaagtaaaatgtaattcaggtcaacaaagatttactgaagtataaaatatagaagaaaatatcacgaaaatatttaagatacaatcctgtctctagttatgactggcagtgtaaaggtagaatataacaagtataaaatgatcatgatataaataccaccaaggttatatggtgtgaggattcgaagaagcaaaatataaacaaaaacaaacaaaaaatagattagcaaaagaaatagagaaacatttgatagagatttgccttataattcaaattacatttttaccaggaaaggtgtggtatgaagaggaagccacaggaacagagaacatgacaggtgtgacatgtattcagatactatccataaatcaaatctagagagaatacaagtaaatggggcaagaagtgggagacgagactgtaaaacttggtggggtcatcctgataaggccatgaacatgggaatgagtacttagtgctgagtaggtgaaaagagatggatgaaagccaggtttcttattctcttaggttcaacaaagaacgctgaaatacagcattcttaacagccgactctattgaagagactctattgaagagactcaaataaggttcttcggctgtaacatgtccttagaatgtccagaggaaaatcagtttccatatcagacacctttacttctattctgaaaaattctgtaaactcccgaacatgattattggattccagattaattttttcattgttaaaatgttagcatctggaaactcaaaaggaaagaataataattagtatttttcttgcacatcagatttcaccttgctctagtgtggtgttctttaggaagctcagttggcagataccaattgaattgtgaaaatatgtctctcctccacactcaaagataataagagtgtctgggaaacaggctgtatcaatacatgatacttttattgtgtgtgaaaaagggaaaaattccaaattaatcttaagaatatactgactgatatctatcaagttaacccgatacaacaggctggggaatggtaaatctattccatcaaaaaatatggccatgagtttcaccaaaccgagtgctcatcctggctctttgtaaatgcaggatgaaactcagcacactttcattacttattctgcaaaaacaactgttcattagaattctgagaaatgagtgttgaattaagactcagtgtctccatcaggatgcagttgagaaactcccccacgtttcatgtccttcctcttcagttgcacgtattccgcactgcacctctgcccatactttacccaaggttagatataacttagtaaagtgaatttaaaattattaatattttcaaagcaaataaaatcacatgaaagggatcttgcaaatgcctaaattaaaactcttttcttttagctatgtaccttcaacacattttacttactagaggcgcctgaacactgaatattacaggttacctaggaaacttacagtgactacacttaaaaacaacacaaagccctctaactgaagcagaataccattttagaaaagtctattttgggaatggcaaaaagaaatggttaacaagtaaatatcagtgcatagctactgtcacatttgagtttttcttcctcacattattcttcaatttctttttatgtctgccactgagttgttcctgaaataaaataaaagctaaagatataataatgaataaagggcaattatttctattatcagctataatccagatcatgagatcttactccgtggctcctcagataatatggaaataatgttatgcctttttagcattcattaatgatggtgaccatacatccagtttgtctggtatatttccagtttatgcctatggttctggcaaaattattcacggtatctcatttcacttgaaaattatccaggctcggatgataaattatgtttgccgtaactgtctattacaggtatatgcagaatgtattgagaaatataaaactgtactaggatagtcagtgcccttggggagctataaatgtataatctaattgaaaaaatataaatggtaacatattctttaaaatattcactactaaacaatataatgatattattatatcattcactatgactaaattgacaaaaatacttgtttccgcaaactctcctgcctaatgtaataaattacaccaagaaggcacttccccatagcccataaaaagaagaaagacaaagtgtatagagtgagttgtgataattctgcaagcctcagcagctttgttagcagcaaaatcaaggtcaccttggctactgcccaaatctaatactaccactgagagattgcctcagggtagggattttgtaagatacctggagagttgttgcagtgttttctgaaatccaattacaaaatccattattactactagacaaactgatacagcatttctatatttgcaaggtgcagagcactcacagctcagcaaaacggtgctggagaacgctttctgtattatgatgatagtggtgatgatgatgatgataatgacatacaattccatttatttaaatactttctactccagtccttcgaaaacaaacgtgaaggatttcctacacaaaactggaagaagataacatttctttttccttttctctagccaatccttgttttatatagtaaataaaaattataccaatatggcttgataaagtgaaaagacattttagtgttcaaatctcaattctgcatctcttagatctgccattttattatagaaaaatctgttctgggactaggaaaagaaatggttaacaagtaaatatcagttcatagctactttttttttaatttgggcttttcttcctcaacttattcttaaatttcttcttaggtctgccattgagtcactcttaaaagaaaaactctccaaggctcaatgttttcatttttataatgaggattatcatagtcctacctcagaaaattagttagaataaaaggaaagaaaaagtgtgaagtgtctggcatgatgtcaataaaactcgaaactgaatgttctcaactgtacataatcctcagagtagttcgagttgccattgccactgagattcttgcagtgacctcttcttacgctagtaggttacagcagtagttttaaaagtccagtatgtaaatgaatcagctgaactacttgttaaaatagaaattcctgataccatacccggaattctgacgtaatacatgtgagagaggccccaggacttagcatttcttaccagcacctgccttgcccatccttactacaggccacatttacacaaacacaagtcagagaaaatgaagacttgccacaacttcaaggctgaaatttcacattaaaaaaagtatcattagccacttaacatctccccctggatattctgccagcaagtctgtatcccaagctgaatttaacttaaaccttgaaattattgttgcttctcttaatgacccttcaatctcaaaacctcagtatgctcatcctcctgctcactagccatcatcgctctgcactcaatattttgcatatttctcctctattccatcgtcattctctgccccaccatcccttgcctgacttttataatcatctcgtctttgatttttccatctccattctctccctcatgctaatcaatcctactcttgctaccacacatacattcttaatgcataattataatcttaaaactccttataagcctccaatgaggatgtaaaaacactgaaatcatcatatgttgttgatgggaatatataaatgtgcagccacattggaaaacagtttggtaattcctaaagttaaacaggttaccacattaccaacacttctactcctactttatatatatataagataattaaaaacatgtatctacacaaaatgtataaacaaatgttaatattcatagcagcataattcataacagtgaaaaagtaaaaacaactgaaatgtccatcaactaattaatgaataaaatgtgatctcttcctacaatggaatattttcggtcataaaaaggacacgtggacacatgttataacatggatgaaccttgaaaacatgctaagtaaaagaagccagccataaaaggctacatattgtatgattctacttacgtgaaatgtgcaaaatagacaaatccatacagacagatagtaaactgatggctgccaggggctgggggaaggatggaataggaagtgactggtagtgggtatgggatttattttgggggtgatgaaaaccttctgaaattagatactggtgatgaatgcacaaccttctgaatatgttaaaacacactgaagtctccaatagctcctcaccacctgcaaaaaaacaaaaccctaaatttcctgacttggtatatgagacccattcttctatagcctctcttcatgcgtcctatacccaagactaagtgaaccattgctcttttgaagtcctggtatgcttttttccccatggcttagggcattttttgaatatctttgtttcatgcatgattaccataatatgtcacatagtatcggtactctatgcctgaatgcccagtaaaaaagcaaactatttttttcaaaacacagtatcctttaaattttgtatgtagcaatctccatttgaaacatgaacatgctgagatccttaaaataagaataaggcagaattgtgtgtgttgcaaagacaacataaaatgccattactgcagccattaataagtaagcacacatctatgtataatgcacacacaaaacccacatatatacatacacacatactgctatggtctgaagttttgtgtccccctcaaattcttatgcttaaatcctaacccctaaggtgatggtaacaggaagtggaacctttgcaaggtgattaggtcatgagggcagaacactcctgagtgggattagtgtccttagaaaagaggttggagagatctaatgtacaacatggtgaatatacttaactacaacatatcgtatactagaaaaatgccaagagactgaatgttaaatgttatcaccacaaaaatgatagctatgtgaggaatcatatatgtcacttagctagatttactcactccactatacatatatatatacttcaaaacatcatgttgcacttggtaaatatattcaatattgtgtgtcaattaaaaaaaatgaatataatgataaaaagaggtttctcaaaggagcttgtttgccctccttccgtgggaggatgcagcacaaaagggccgtccaagaaccaggaagtgggcccccatcagacattgaatctgctggcaccttaatcttgagctcccagcttccagaactgtgacaaataaatttctgttgtttacaagccaccaagtttatgctattttgttacagcggctcaaacagacttaaacacatacatatacaataaaggaatgatcatatcttataaagtcttactactctgtttcctcatactgctatcagcaaaatcactactttagcagcaatctcagaaagaaaaataaaacccaggaagcacagttcttgtacttatgcacagacatttaagccttaactccgtaccctgtgcctctcaccttggtttatgagatatcctttcctttgcttttatgaggatgccagttcaatctttttccagaagtagaccattaagcagtcaatatccgaaatgtaccctaaatgcttcctcatatttccctttatctgactaatggaatatggaaagcaatgtttaaccagggaaaaaacatttacttctacctggtaaagcttaaattccatttagtgctcagaacttaaagtaaaaaaaaaaaaaaaaaagaaaaaagaaaaaaaatttctatcacaccatagtaagtgagcaagaggtaactagtaagtatatgaaattgaaggaaaaattgactgaaagtcaaaacatagtctaggaagggaaactcactcccaacgaaccatcattgacaaacgcaggtcaattacttcttattgaactctatgatacatagtcatgattttccatttgtgctcaaaacagaagcaacttcagcaaaaaatagaattgacaagcattgaaagagaactgcaaatagttgaagcaaggggaatgtttttcaaaacaaaaaaatgttttgtttcctctttctacttttctgtattttctacaagaggacctattactttaaaagtttgtttgtttagaagaaataaagataagtcatggggggatgaggaaagaggagatgttggtcaaagccaacaaagttttgatcagacaggaggaataagttttagtgatctattgcccaccatggtgacgatagttaacaatgtgttgtttaattcaaaattgttagaacagtggattttaaatgttctcgccaaaaaaaaaagtatatgggtagttaatatacaaatcagcttaatttaattattccacaaatgcatacacatcaaaacattacattgtactccatacatataaaaaattatttgtcaattaaaaaataagtgattatagatgacatgaggcatgcattacccatcacagtggtaaaaatccagcttccctgtgtcctgacctcttattctgttgagcaagcatatcacatttaatcatgacaattgcattacagatattagcgatatataaaaatgtaaataggctaaatgtaactaactttgctcttaccacaacagtgttttatctatgtagcaaagcttccatgtcaacttgtcaaggcgcgtcacctttggacagtatacacagacaagatattaaaaataatggaaaatttatcacaatcaccatgccctcgggtgatttttccctcagaatgagaaatgatgcatttttacagtgttagagataaatacagaatcatcatcactattttaggaaagaaacaatactcagaattgaatgtcatattctcaaggaatccacaagtcatgtttccttagggcatagaaccattaagatgaatataaaagaatatcacttgctccactgatttacattcttgctttagttacaggatttaagaaattattccgtacaacttttaatactgcgtctgaggaaaaacagagggaaactagacactacgagagccaatacatttgcagtcacagagttcaattacgtttttttaaaattaacttattcaatcctcacaataattttccgagttacatatgtagcataatcctcatgttacagttgatcagataatttcaggctatggtagagcttattatattgtgagattcctcacctcatgattggagctcattgagagtaaggacattctatactaaacctaagttgtctaacttctgggacatggctgatgcactataaattttatggatctaagtgaataaaattttaaaaaaaaaaacctgagttcttggagggctatgcacacagaaggaatagatgaaagaattaagatgcgaacccaagaatgtctttccattttaccaagccatactggtaaaatgtttatttatataatggtacaaaacaagcatttgagaaaagcaaagaaaaatgattatcttcctccagtgataggtgggaatccttcacatttgttcctttaactgacttctctcatagggaaagtggaagagctaaaatttagatgcaggtattctggcccctgtgtttctctaaaacctcataacctactattggctaatcaagtgtgtgttgatcattgcagatttttatttttcagaaactctaaaattgttttttagagtactgctaccaggttagaggtcaactatcactattaagtgatacaatacaacattttgaaaattaattacagatcctggagactaagaagatccatgttatgtagtttaaaatgaggtaaatgtatatttctatgagcaatttataaatggctattgtaagtaatttgaatggtcatggaaaataaactagctgaactacatgctattcctatacagctttggaacattatgtaaatgaaagcgatctactcatggaatccgaaaaacaaagctcttgcactatgtttactaattagaggttcatacacctgaaaagcttgaaattgtcacattcactttagttttctcatctgtaaaataaacaacttacttttcatgctttacataattgttgtaaaaatggatgatacattatgtgagaaagatgttgtaaactttaaagtgtaatgcatatgacggagcttattacctaacatctttctacttaagctgtggtcacagcgcaatggcatcaacattcctaggaagtgaactgatccaaagaatctcagaccccattccacacttactgaatcagaatatacattttacccatattgccaatagacttattcacatgtaagttggatggaaagcagtaatttcactactttcaagatccacttttatcattcaatattaaaaatgttttgatatcccaattatgtgatgtgaaacttcagcaaatccatgggcacttatttagacagatacatatatggtgttactgtttcatattctaattaagcattcctctacataactgttttggcatacacatatactcttgatgtatttgttttttgcatcactgaagcaaattttagactgcacatttctggacggcaaggattgccttcaaatacttagttcagtgcctgataaatatgtaaactgccttgagaaacagtgatgacagtatcataatctgacaataattagagaaaaaatgctttggatgcacaactaagagtaggaaattctcagaaacattaattccaactcacctggaaataacaattcacagaatagaaaaaaaccaaaaggttgctaatattcttgagcacccacacttcattttgatgaaatctaatgtcagactaacctagagtttcaggtggaagtaatcattcttttttttaatctctttattttttactgtcatagggtaacagtctccatgtataattttaataggattagaggacaccttgaaatgtaaggaatgatcaatcaaattcatatagtgcatcagcaattgtgatctcccaggttgtggaaatcaagttgaaaaatatagatggtagacatagtcctggaattttcaaaacaagaaatgaaagctttaataaaattaaacactttaagctaatgatgacctacttaagaaaatcatttacctttctaatttttaagcacttgaattagtttagatttatagtctctagacattgctaaatttgattaaatgtgaaaaacttaaagttcacctgtaaaaatgtccttgattaattttatctgttaagggaaaacctataccatcctctctggccttggaaatatctctgacagagttccgaattcttctctgtattttaaatattgttgatatattattgatgcaggtttcagtcatgctgaacaaaccttaaaatgcatggaaaatctgaaaatgcctatttagataggtcacaggcccccctttttttttactaagctaaaatttaaaaatcaggaatcacagaacatcaacaacgagaaaagaggttgaattagaggtgctctgtagaactccaaataaacactttacatttgtattttcatgcatttaaattagggctgttaaaataagagcaggtggatataaaactattaggttggtgcaaaagtaattgcagtttttggccaggtgcagtggctcatgcctgtaatcccagcactgtgggaggcagaggcaggtggactgcttgaggttaggagttcaagaccagcctggacaacatggtgaaaccccatctctactaaaaatacaaaaattagccaggggtgttggtgggtgcctgtaatcccagctacttaggaggctgaggcaggagaatcgcttgaacccaggaagcagaggttgcagtgagccgtgaaggtgccactgcactccagcctgagcaacacagcaagactctgtctccaaaaaaaaaagtaattgcagttttagttactacgttcaataggaaaaaaaaacaatacttttgcaccaacctaatagaaaaccatcgactagattaatcagctcataccatgtgaattactgaccagtaggaaacagagatcaaagtcagtgctgcctgctacttaggagatgcaaaggtaattcctctgatggacttctacgttcatttcattgctcaacgacgtagagataattaattcttaacgaatattcatttgaaataaattctgacaagtgctccataatccttccagaattcagtaataaatcaaatacacctttttttttcttgtaacttcccattgacaatgtcatatcattaaaacccaggctatatgtggtagctctttcccactacagtgaaagacatttcaatgggaaatgagcttgtctattaaaaatatcttcattgttgttttctaccaatctgtatcaacaggtcattttctttcctttctttttaaaatagtaaataaagaaggaatgattatgatacttcttgctctctaggagccacgtcataaatgcttaattaggtatgccaaagttattttttctaatagagtacagaaaactcttaataaaagatcagattcattgatgtatatgcacaatatcaggaaagagttctcataatttgtataattccatagtcaaccctagcaagtgaagattaatcaatggtgggctcccatgcacgtgtatttatttatttatttatttatttatttatttttcttttccactttcttttaggtccagggggtacatgtgcagttttgttactttagtacattgcacatcactggggtttggtgtacacatgattttgttacccagatagtggcatagtacttgataggtagtttttttgactctcgccctcctcctaccctccaccttcaaataggtcccagtgcctactgttccattctttgtatccatatgtactcaatgtttagctctcactgataaatgagaacgtgtgatatttggttttctgttcctctattaacctgcttaggataatggcctgcagcttcatccatgttgctgcaaaggacatgattttgttatttttttatggctgcatagtattccacgacgtacatgtgccatgttttctttatccggtccactgttgatgggcatctaggttgattccatgtctttgctattgtgaataatgctacagtgaacatattactatgtgtatctttttggtaggataatttatattcctttgggtgtacattcactaaagggattgctgggttcaatgatagctctggtttaagttctttgagaaatctctgggctgcttcccacaatgggtgaactactttacatttccaccaggagtgtataagcattcccttttttccacaaccccaccagcatctgttattttttgactttttgataatagtaattctgactggtgtgaaatggtatctcattgtggtttttatttacatttctctaatgttagtgatgttgaacatttttcatatgcttgttggccatgtgaatgtcttctttggaaacgtgtccatttgtgtcctttgcctattttttaatggggttgtttggtttttcttgttgatttgtttaagtttcttacagattctggacattagacctttgttggatgcatagtttgcaattttctcccattctgtaggttgtgtttatgctgttgatggcttcttttgctatgcagaagatctttagtttaattaggtctcgcttaatccatttttgtttttgttgcaattacttttgcagactttgtgatgaaacctttgccaaggtcatgtccagagtggtatttcctagattttttttctaggatatttataatttgaggtcttaaatttaagtctttaattttgagttgatttttgtatatggtagaaggaagtggcccagtttcagtcttcggcatatggctagcgagtgatcccagcaccatttactgaatagggagtccttttcccattgattgttaatgggcagctttgtcaaagatcacatggttgtaggtgtatggctttatttccgggttatctaatattggtctatgtgtctatttttgtaccactaccatgctgtattttactgtagcctactactgtatctattactgtcaccctgtaatatagtttgaagtttgatagtgtgatgcctctggctgtgttcatcttgtttaggattgctttggctattccagctcttttttaggttcatatgaattttagaattttttttctaatgctgtgaaaaatgacattgattgataagaatggtattgaatctgtaaattactttgggaagtatgatcattttagcagtattgattcttcctgtccatgggcattgaatgtttttctttttgtttgtgtcatctctgatttctttcagcagtttctgcaattctcatagagtactttcccctccctggttagctgtcttcctaggtacttgattccttttgtggctattgtgaatgggatcaaattcttgatttggctgccagctattgttgagctactaattgttgtacatttattttgcatcctgaaactttactgaagttgtttgtcagttctatgagcttttggatggagactatgaggttttctaggtatagaatcatatcatctgcaaagggagataatttgactccctctcttcctatttggataccttttatttatttctcatgcctgattgttctgggtaggaattccagtacaatgttgaataggagtggtgagagtgggcatctttgtcttcttccagttgtcaggcggaatgcttccagcttttgtccctccagtatgatgctggccatgggtttgtcaagatgattcttattattttgaggtatggtctttcaatggttagtttgttgagagtttttaaaacaaagggatgtgatgttgaattttattagaagccttttctgtgtctattgagatgatcatgtaatttttgcctttagctctgtttatgtgatgaatcgcatttattgatattcatatgatgagccaatcttacatcccaggactaaagcctgctttattgtggtggattagctgtttcatgtgctgctggatttggtttgctgatattttgttgaagatttttatatctatgttcatcaaggatattagcctgaagttttctttttccctcgtgtctctgccaggttttggtatcagaatgatgctggcctcatagaatgagttaggcaggagtccctcctcctttattttatggtataatgtcagtaaaattggtaccagatcttctttatacatctggtaaaatttggctgtgagtccatctggttcagggtattttttagtttgtatgttgtttattactgattcaatttcagaactcgttattggcctgttcaggatttcaatttattcctgattcaatcttcggaggttgtatgttttcaggaatttatcaatttcttctagatttctggttgtttttttgagacggagtctccctgggtcgccaggctacaatgcagtggcgcaatcttggctcactgcaacctccacctcccaggttcaaatgattctcctgccttagcctcctgagtagctctttccatttctttcaggaatgacaggtgcatgccaccacacccagctaatttttgtgtttttagcagagatggggtttcaccatgttggccaggatggtctcgatctcttgaccttgtgatctgcttgcctcagcctcccaaagtgctgggattacaggcgtgagccactgcacttggcctcttctaggtgttttagttggtgtgcagagaggtgttcataatagtctccggggaatttttgtacctctgtggggtcagtagtaatgtcacctttgtcatttctgattgtgtttatttggatattctttcatttttattaatctaccaagtggtctatcaatcttacttatccattcaaagaaccagcttttgggcttgttcatcttttatatgaattttcatgtcttaatttcattcagttcatctctgattttggatatttcttttcttctgctagctttggggttgggttactcttgtgtttctaactcctctagttgtaatgttaggttgttaatttcagatctttctaactgcttgatgtaggcatttcatgctataaactttcctcttagcacttctttagctatgtcccagagattctgtttgttgtatctctattttcatcagtttcaaagaaatttttgatgtctgccttaattgcattcttcacacaaaagtcattcaggggcaggttgtttaatttccatgtaattgtatggttttgagagattttcttggtattgatttctattcttattttgctgtgttctgagagtgtagcttgtatgatgtcatttttttttgaatttatagagaattgctatatggccaagcatgtggccagtctaagtgtaagcgccatgtgctgatgagaataatgtacattctgttgttgttagatacagtattctctagatgtctccgaattccatttgataagtgtggagtttacatttgatatatctttgttagctttctgccttcatgatctgtctaatactgtcactcgggtgttgaagtctgccactattattgtttgattatctaagtctctttataggtctgcaggaacttttatgaatcttagtgttccagtgttgggtgcatacatatttagtatagttttcatgttgaattgaaccctttatcattatgaaattcccttatttgtcccttttgatcactgttggcttaaagtctgttttatctgaaataataatagccacacctgctctttcttgctctccctttgcttgatctttctccatccctttactttgagcatatggatgtcattgcatgtgagatggatctacagttgggtcttgcttttttatacaacatgacactctgtgtcttttaagtaggggcatttagtacctttacattcaaggctaatattgatatgtgaggatttgatcctgtcctcatgttgttagctggttattatgtagacttaattgtatagttactttatagtgtcagtgggctatgtacatatgtgtgtttttgtggtggcaggtaatcatctcctgtgtttatatttagcactcttttaagaatctcttataaggcaagtctggtggtaacaaattcccttagtgtttgcttgtctgaaaaagattttatttctcctccatttaagaagtttggtttgtctgaatatgaaattattggctgaaatttcttttctttaaagatgctgaatataggaccctgatctcttctggctcataagggttctgctgaaaagtgcactatagcctggcggagttccctttgtacataacctgccccttatttctagctgtctttaagatttttttcttccacattggtttcgaagaatctgatgactacgtgtcttggggatggtcatcttgtatagtattttgcaggggttctctgaatttcctgaatttgcatgttgatcactccagcaaggttggggaaattttcatgaccaatattctcaaatatgttttccaagttgcttgttctctttccatctctttcaggaatgacaacgagttacaggtttggtctccttacataatctcatatttctcagagcttttgttcatttttcaaattcttttttatttttgtctgcctgcattgattccaaaaaacagtcttcgagttctgagacttttttccctcagtttgatctattcagttattaatgcctccaattgcattataaaatttctggagtcaatttttcatctccagacattcagtttgtttctttcttaaaatggatgtgtactctttcaactcttggactgtttcaccgtgttcttgggattgggtttcaaccttctcctgtaactatatgtggttccttgtcattcagctcctgaattctgtatctgtaatttcagcaatttcattctggttaagaaccattgctggggagcaagttgtagtcatttagactcaagaagacactctggctttaagaatcattagagttcttgcactagttcttatctgtgtggactgatgctcctttggtatttgaagctgctgtcttttggatggggctttttgcttttctattatttgatgctcttgaggttttgactatggtataaattgggtttcatggattggtttcaattctgaatgcttttctggagccaaagctcacctcagcactcttgggctgcatgctgtaatcctgggggatgggggattagtcctgtggctttgctctctggccccttgagattaagcacctgctgtgctggaggtgctgaggtgttcccagttcacttgcaacaacactctggcaggggctgctggcaaaattgctccagtggggcagtgggagtctccacacacatgtgcaccaatggaggaggctgcaggcgagtacgcatcagtagggggaggctgagggtgggtgtgcactggcagggaaagactatgggcaggtatgcactgacagggggaggatgcaagcaggtacgtgctggcaggggaggtcatggttggagtgtgccagcagggggagacaatgggtggatgcataatggtaggggtccaccaggtcgttttcttactccaagtttcagttttgttaacctgtactataaaatgactgaactgtaatttttaaagttttcttaagcagaaagacttcaattattttatttgatgtgccactggacagacttgtaaatggaagctcaaggaattcagtgagttgtctctggaaaagagcagagcaggtaatcccaggcttttgtgttacatgtatattgctctttccatcatcttatggctgcttcaaaggttcctcacaggtccaaagtttactctaactcagtgaattcctttggtcattccacatgtaatcctcctggagcacattatcaatggcaatctttggacagtgctaggcctatcaatggtgaacctgggatggctgaagctcatgctgagtcaagtctatactaatctaattctcccaaatgtgatgggaagtgcattttccacaaacagtactcatcttggaaagtagaccagcatcctaataaaagcagagattttagtgtaatacaggttaacattccaatcccacagaatgggcttgcttagtgtataacttttcctagtcttcatacttacgaaaagacatgaggtctatgtgtaacatgtagaagtgtacatggcccaaaatataaattgagcccaaaaaatatctgcaggatacataaaaagctagctcttttctattctctatttggtttgcatacaaatggtagcatccatgcactttaatgttattcaaaatgaacaatagaaaaatccatggaaacttgtccattttgtttgcattgatgtttccagaactactgattttgatagatttgtttttccattaaagaagtaggaacaaatccctgatctcttacactgaattgtggtgaacagagtaagatgggaaattgctcttttaataccaaattgggacaaagccgttaattatgtgaagcttattctaacaatagctcttcaagtgtgtgatggaccaggggcccccaactcctgggccacagactggtactggtctgtggcctgttaggaactggtcacacagcaagaggtgagcagcgggtgagtgagcactactgcctgagctctgcctcttcctgtcagatcagcagtggcattagattctcataggagcatgaaccctattgtgaactgtgcatatgagggatctaggctgagcgctgttggtgagaatctaaccaatgcctgtaaatctgagatgaaacagtttcatctggaaaccatctccaacccccaactagtctgtggaaaaattgcgttccaagaaactggtttctggtgccaagaaggttggggactgttgtgatagactactaatcctgctaatggggtaacccaagtcacaactaagtttaaggttggaaagccccagtaaatatctgaggtcttagtgaaacagggtaagatgaaaggtgagaaaaagttgtattagacactatgggtgcaggggggaagatcccagaaataatagtctttgaatgaaagtccaagatatgaccttcttggtagagaaaaactcaaccaggaaagttgtcttatacatttttcatagatgttgtgcatgttgaatccccacccttatggtaatccattagtatgctgaaggctcagaggaaatagtacaaaacagatgcattcatgcttcatttttccatatgtttgttattcaacaccacacgatgactgatagatcccatatctaattaccatatactggagagctttctggatttttccagcccagcagtgacaataattgccattcaagaaaagataaatcaatgttataataataatacaatgacttatctgatttcccctgttattttttttggaatatcaacttttcactgaatttaagatgattttctgataaaattattatttttttgctctgaaaaccaatataaatatgtttatctgctacaataagaatgataacatgcaacaataaatgtaaacttagctgttatatgcaaaagattttgctagttgcaagaaataaaaagacatcagaagtagttgttgacttcaaactgctcagaatctggtaaaatagatgacctagtgcacagtgattatctcacccaatgtcccattatcacccagctgtattctgttccttttccagtcctcatgctctaattatttaagactcagcttaaatcctataaatatcttggtctgatattttgtcagaagacatatctccccccaatttctcagaggtctttatctctactttgtatgttatttgtaattttttattttatgatactatcatgcttttcaccataacaaagcaaagcctctattttttcttaagttgtatcttattaaagcaactaacctaaagggtaaggaaaggacttctttgagctttcaggaaataagaacaagccaattacgaggagggaaaaaataaagctgaccttagatatctacacagcaacatttaattctagaatacagtgaatcaatgcccacaaaatattcaaggaaagaaaaatataatccaagtctttaatatctagccacagtgttcaagtacaaatacaaacaaaacccaatttttaacatgtaagaattcagggaatactattcccatgagttcttgctgaagaagaatttcactgaacagaaagatatttttggaaagactatataaaaagattagtactgaaatttgaatctatacatttgttgaacaatgatttaaacatatgcaaggattaaggtgacagaagagaatgtaaatgttaaatgactgggtgggagagtgataagtatggtaattttctcacttataataccaggagttaaaggatattttcaatacttcaaaataagtaatgtgaatataaatgtatttaatatctcaaaggaaaacactacaaagattatgtaattaaccgaaatcaaggggataagaggaaaaagcagtataaagaaaaacaaacatactaattccatcactgattatagtggagaatcaaaaacagtttgaagaaacaggggatttagggtataaaaattatattagatcaagaataccaactttctaatgagcagaagcagcactctctctctctccaaagtaggtaaaaaggaaatacaaaaagctttaaagatgggaaaggataacatgaaattctatgctagaattaaaattaaatacatctcccctattgatagttccatgagggaaaggatgtctgcttgttctgtccattgctgtgtcccgagcacctggaacattgcctggctcatgactgcaggcaaaaatttctttaaggaatgaaattcatacggctaaattcacataataaagaaaaaggctttcaagttacttcaaataacaaaaccaactgttcttgagtatatcttcaatcaaaaaagagatcaagaccaaaattacaagacttttagagacaaataataaaaatacgttgcatcagtatttatggggtacagctgaggcagtgttcagaaaaacaaatcactgcattaaatatttatgtaagggaacaagtaaaaagaaaaacacattaagcattcatattcagaaattagttaaaaatcatgaaacctaaggaaagtagaaggaagaatattgcaatgattaaaataaattgatgaattagaaacaaaagagtaggactagtaaataaatacaaaagtaggttctttgaaaaaatataataatataaataagttttagctgccaggatatttccacttcggtacttaaggaagataatttttgttgtgggagctgtcctgttcattatgggatgagcagcatccctagccagatgccagtagccctccccttcctagttctagcaaccaaaagtgtttatgaacattgccaattttccccttgggggtatcaaaattgttccaattgagaaccaaattgttccagttgagaaccactgaagtagcccagtcaaaaaggaaaggaagaagcacaaacacccaatataagaaataataagcaagtaatgatcagtcagggaaaattttaaaaatcaaaggctattttaataaactctacaaattaatatgaaacctgaatataaagcataatattatattaaagtaaaattaacaaaaatagaaaatgtaatatatgaattaccaaaggaggaaacttgccaaaatccaatcatctcaaaaaaaagttaaaaccagtccttactacaatgctatttgacccttccagatacacttggccatataatttagtaaaagaaaataaccttagaaaaagattaagaagacaaaaattagtattattgtttacaggtgcaatttaattttgctgatattattgtttacctggaaagaaaagtatattttactgagcaactatgaaaaatagtaagaaaatttagtcagttagctcagtataaaattaaaagacagaaatcattttcctttatgtatacaaataacctctattatatagaagatcatggtggaaaaacacataatattcaggaataatactgatagttaattttcaggatctatatttagagactatcaaaatacttctgaggtaatcaaaacaataccaggtacttaaacaggcagattcaacttcataaagatgttaaccttaaatatatctataaataaaataccaaaagaaaatctgagagaactgaaaaacctaatgctaacattaatatagaaaacaaaatcagaaagaataactaggatgatcatgaaaacgaagagcaatttggtgtgggatgtggagattaaaagaagaggtagacttgctgttattaaaaaataaagtaaagctacaataattaaatcagtgtgttattggcacatgaataaacagtcataaaattggaacagcctgggtagtacagaagtccaaataagtaaagcatatatgtatattcaaggtagcatttaacactaaggggaaaaagatagtttatttaaaatattgtggtaaaacattagggcagctttatggaaaaaaaaaaaaaactcaagtaaattccctttacagtatatccaacttaagcataaaattttaaacaataaatttacttcaggcattttaatgactttaaatgacaacggaataggaaggtattcctcagtaggagattttaaaatctcagaaactataaaaaaaagattaataaaatgttaacatcattatgttgttgagtctgtcaaacacacggtacttatgaaaatgcaaaaatttttgtattacttaaaatgccataaaccaatcaaaaggtaaaaagtgggaagcatttgcaagggctaactttccgaatataaaagggttccttcagaaagataagtgaaagaccaagatccaaataagaacaaaagcaaggataggtgacaagtaaaacaaaattaaaataaaatcagctattggctattctcctacaatatgctaaaaccacatatcataaataaagtaaaaattaaaactatgatgaatagaattttttatccatcatattttttaaaattacataactcactgtgctagtgaaagtgcagaaaaattggcactgtcgtgtcatatatttctttattgagtgtaaatactatatctagggagatcgatttggcattatctagcaaacttacaaatattctgctttctgctctacttttagaaatttactctgcagatatactataaaatgtgcagaatactgatgtataactatattatttataatagcaaaatattgaggcaaactttcagaaatatgggactgatgaaatcacgtatgtcacagtctatggtataataccacatagcttttaaaaaatacagaaactccctgtgtactgattcggaataatctccaagaaatattaagtggaaagagcaaaatggagtgatagtgtggacagtggctatcttttctaacaaagagaggtaaatagacatatctacttatatgggtataagcaaaaagtaataataataataactccagctgacaaataagaaaattgtaatattgatagcctatagaaaagtggctatagataggcagaatgagattgttcaatttatcttgtatcttatggttgtgagttaagtgaatgtattatctgttcaaagggaaataaattgtttcaaaatagttgacaaaagattattatgataaacctgaaagaagatatgcacagtatgatcaacaaatgctgattttgaaatccagaatactatcccacatgagtcatattttgttaatttaaaattcatgttgacagatgaacacaacagatgaagctattaatgcagctttaccttactgacccagagcccttcgagtctgagtttcctctggaccaagtggttatcttctctatacagactggggattctatctcccaagcatgcaattaactgccccttttgaatattctattccaagactcattgcaactatgatactcttttcttttaagtgtgagcctcagaaacaattaagcaagaaataatcgtgcatttgcataagcccaacttactgtgtttttttgttagtttgtttgcttgggactttctctgagaagcaggaactcgttttgtcatccaggctggagtgcagtggcatgatcaaatctcactgcagccttgaactcctgggctcaagcaatcctctcatctcagcctcccaggtagctaagaccatgagcacatgacaccatgcccggcaattttattttgttttatttatttatttatttatttttcagaaaaatggggtctcgctattttacccaggctggtctcaaactcctggcctcaagttatcctcctgccttggcctcccaaaatgctgggattacaggtgtgagcccccatgcccggccaaggacttactgtttactcagcaaacatttattgggcatcaattagctattggcataatcataacacttcctcctacatgtgagcatcagaaatatttaatcaggaagtaattatgcatttgcataagcacaatttactctttagtcaatgaatatttaatggccatcaattacatgccaggtagcatggaaggtactggaaacagagaaagacatgttccttgcccttaaataatttgcatggtaatcattattcagggagacaagaatataatagaatttaatacaatttggtccatgttagaatagtagccacaaatcataagaatggcaagaggctaggagaaggaggcagtaacaatgcctggggagactcagagagggctttacaaaacagaggaagttttacttctactagactgtctagaattataagtgacagacaacagagtccttgctttttcggaccctaatgctaaaagactgaataaatgtaatagtaaaaaagtgattagtaggacaattaagttttaagttcacattaaactttaaaaaacacttaaaaacttaaaaaacattaaaattaaaatggaattcctagttcgttgatatctcatcacattacaaaattctgtttttaataacatcagaacataaacataacttcaaaacatttaccggaaataatagctttagttttaaaatgcttcctccaaaagcatgttccaattcaaggcaaggctcataaactaaatgaattttaaaatttatattttagaattataattacatacttgattacatatttagtatgagtttataaaaaaagaaagcaaaaggatcactgtgacaacaggtgacatcaagaaccacttggaacaataaaagggaaagaaattaatctttaacataagtggagtaaatataaatgggccaaacattatactgaatttagtggtgctgcccatggaattctggaagtcttaagatgttgtagatagatatacactttccttgactcaagatagcataagtacttattttttcagatagtatgcaggcttttccaggtaggacctggttctaattgacataaatataaaagtgataagaaagcctaaagctgccgggtgtggtggctcactcctgtaatcccagaactttgggagaccgaggtgggtggatcacctgaggtcaggagttctagaccagcctggacaacatggcgaaaccccatctctactgaaaacacaaaaaattagccaggtgcagtggtggacgcctgtaatcccagctactcagaaggctgaggcaggagaatcgcttgaacccgggaagcagagattgcagtgagccaagattgtgccactgtactccagcctgggtgacaagagtgaaactccgtcaaaaaaaaaaaaaaaggagagagagagaggaaagagagagagagagaaagaaagagagagaaagagagaggaagaaagaagaaagaaagagaaaaagaaagaaagaaagaaggaaagaaagaaaaagaaaaggaaagagagggagggagaaaaggcagggaaggaagggagagaaagaaagaaagaaggaagggagggagggaaggaaagaaggaaggaaggaaggaaggaaggaaggaaggaaggaaggaaggaaggaaggaaggaaggaaggaaggaatatcctaaagcaactctcaggaaacaaaacagaatgttgaggaaaggagactggtgatgtgcaatggtgctaagacttgctgatgggaaacatttgtgtagcacaaacccaaatctgtaggcatgcttgcagcctaatcccaaatagtcaacaagcagatgcactcatctgccatccccagagacttcagcactgaagagttgtttcgtcactgtagagtatcaaattggtgagtaattttgcccttctacctggctaaaaaaacattcattcagtttctactagcttaaaggtcactgtattttgcagtcacccatgcatgcaatcagatatggctcaatggactctgctcacctcacaatcatgaatacaatatgatttaaaggtcagccaacttgcattctgtcaaaagagcataaggagagaatttcagctatgtgggtctatatgatggcacatattttgctgacagttttctgaatccacacctagcgatcactggcaggagatgacagttcaaggtcaataatttaataaatcatttcattatatagttattgattctaccacttttaataaggaatgtatgcaaaattgaagacgttaagtctgggaaagatttatagaaaaaacagtcaacagcttctgtgtggcttccaggagagatgaaggccaaaagagtgaggtagaattttgctctaaataagactttaccaataataagggatattgaaaatgaaaagtatttagcttctgaaagtagtgttcctgacatatggttaagccagatggtggattaacacatattgtaatgtctaaaaaattaggactttttaaattggggcccacatactgcttaagaaattgagctatctgacccttcaagactttcttattttattctctatgatcagccatgagagttctaaagggggaataaatggttcagcaaattttatcttgttccaatatactatctagaatcaacggaaccaaactatgaacatctacttcctctaggacaaatttcatcaaaccattagttataatacacatgttcaaaggagctgagataaaaattacaaatggcaaattaataaaacagccattaaggaacttggacatagttaaagtgtacattgaactgaaacatgaccatggagaacaaccttgacaatatgttatttgaagctattttcagatgtatagatgtggcccaatatggcacttttcatattctccatgcagctgctttcacctatcctgacatcttcaagttatctgaatttaagaagtatcactattcatgttgcacaattactaacactgaatatacttatcacattctctggcatgtggctttaagctatcctgggtattcagacagttaagattcttggatgatcccaaagtttccctttaattatttgtagcagtcttctggactaataatacttataaaaccttgggaatagcctatgcaacatagtgagaccccgtctctacaaaaaataaaaacaaaaaattagccaggtgtgatggtacacgcctgtggtcccagctactcatgagactgaggcgggaggatgacttctgccccggggggatccaggcagcagtgagcggtgattacactactgcattccagcctgggcaacagagagagaccctgtctcaaaataaatacacaaatatataaaatcctaagagttaattctttagaaagcattttattttagcttaacacaattaatttgatctatcagaaaaccctacctgcttgatgagccatatttactatcatcactctctgtctaccattacaatcagtgattattgattgggttagtgaagagttttgaatagttttaacaactgttttggcgctcaaattgagacttgattaacaaatgcaaaactagtcaaccatgactaaaatgaaactgcttcaataattacataatgaagatggtagcgagtttttattataagggctatgtaaatgcagcccactgtactattataatattaatcacaagttttttgaggaaaggtatgtgatataactcccatccaaggtccctagcagaatgtctttcacaaagcagatgttcattaaatgacagctgaataataaaacactattatagagaactcaagtatgaatctagtatttcattttaaaaacttgtctgattatacttacatatacaatactgcatgcagcagctactcgataaacgtgtgtaaaagattaagtttggtcaaacaattgctctgaatcaaatttgtgatataattcctgactcagcccccacagaatatttaaaatatagtaatacagtaaaataatttttccaccacttcatgaacagtcagtagggtcttgaatgctacctttcaatatgcaatatggtggccttaggaagagaggagttttttttttctcaacacgtagaatcagggtcttaagaatgactttgtgaaaactccagctttcgttgctagggaacattgattgttttccatggtgcttgtaaaggcattatttgccctgattcttttgatgagttgagactgttcacatagtaacttcagaatggaaagaacaaacccctctcttcctctggtggcactttgcctactgtcagactacaaaagggagaggcatgtgaggtgaccctctcaatgttgtctgaacaatgaggcaatcattacaactcacattctatcagtttttatgtgacactgaccaaaggcaatttggggctcctttcaagcagtttgcatcaaaaaaacgttgaatggcattgtcaccaggactacactacaacaaaaagcaacgattgagaaaggctggtgtctaactagaagacaagagtgctttagatatggaagccattgctctgatattttaaaatacatttttaaaacaaccttattatcgattcatttatacagtcaactccattctgcttagtactcgaagtgtgcactcatgtggataatctaaaacattgagaattcaaataacatttatattaaatctgacataataacctaacgttttagggtatgcctaaatttgcctttctatttctgtttattctggtaacttttgaatttggttctctggccctggaaatgccacatttagccaaagaaaaacagttttgattaggggatagcattaatcattagctagttaagtgtacactaaggaaaaattagagtcattattttgatgagttgtgcataagttatggtcagcacaagaaaacagggcacctgttcatatttggtcaccaaagaatgttctacatttaattaaccacttaatatttacaccttgagaaaaaattatgccacaatacaagcataagtgtttttgataaatattcaaatattagaaaaatatattaagatttaaatatttcaagtttgtttcagccataaaattctgatcatactctccctatctacctaattgctgctaacaataattcaaatgccaataatgatatatttagataattgattttaaagaatttatcaaacaaaaaatagaggatacctataggtatcttctttttctggagaatcaaaacatagtataaaatggaagctttctttgtgctgtaaagaattcaatacattatggggcaaataaatctattttgaaggtttttttttaatttctggtagactagaaaggaaggatccaactcggatgttcatttatttaaaatcaaacatagaagattaaattcatacaagccaaagaacatctggcccttccagaaagagaatagagttctaaatgctgaaatcaggtgaagcatacttaattactggtatccagaaagagcaaaagtgagacatcctattatatttattctaggacaaaatataccattgcctatgattgtgggttttggataagaaaaacttacagtcttaagctgatcgtgagtcaataatggagctactgggacacaaatctgtaccctttgtcactctatggaaactcttctgtctcaccacaactcacttttgtctgttgatcaaatatttcagggccttcaaactcatataacatgtttctcctagaaagagctgcttatcttttcctaactaagagcagggagtgcgccatgaaaatgttgtcattgatgagaacccactttgattctgatagagagtaagttgtgctcttttgctttagtcatgctgtgtattgtctataactctattgtactattacattcctaaatttggctataacaggtgtatcagttgattcaccaactttcaagaaatgtttgacactatctactaaagctaaacataggtagcctatgactgtgcaattctattcttatacaaagtcccaagacaaatgactgtacatgtccaccaaaagaaaatgactagaatatgtttagaaactttattcataatagctccaaactgaaaataacccaaatgtctatcatcaggagaatgggtaaagaaattgtattatatacaatacaaaggaatactacattgcaataataatgaatgaacgaagatgtacaaaacagcatgaaaaagattagatatttttagttgcatgagaaaaaaaagccagatacaaatggcccatatagtatgatcctatttatataaagttcaaaaacagaaaaaaaaataggtgtagaaaacaaaatggtagttaattcttgatggagagctttgtctgtgaaggggcattaggaatacttcggggagtggtagaagggttccaaatatctggatagtggttacacaggagctttacacattagatttgagcactttgtccataaatcattcctcacaagaaacacgtatcgttatttaggatttagtctatgctaggtatttatataagaacaccaacaaacaagatgacaggtaattgcatgcttaatttttttttgtgtgtaagtctttttaatatagattgagagtaacgtgaagtcagagacctgtctgactaaattttgtattctctaggatgcgaaatattcaggctcttaagaaagaatataagccgggcatggtggctcacgcctgtaatcacagcactttgggaggccaagatgggcagatcacttgagctcaggagttccagaccagtttggccaacttggcaaaaccctgtctctactaaaaaatacaaaaattagccaggagtggtggtagcgtgcctggaatcccagctactggggaggttgaggctggaggatcccttgaacccaggaagtggaggttgcagtgagcccagatcatgcccctgcactccagcctgggtaatggagtgagaatctgtctcaaaaaaaaaaaaaaaaaaaaaaaaaaaaaaagaaaagagaagagaagacaagagaagacaagaaaagacaagaaaagaaaagtcttctccaactctacagtgaccgaggaaataaaaatgtatgtacctatgttggttgcttctaactagaatcaatgtctctgtcaaagtactttctgccgccaactctttgacaaataatcacttgtcttcaagtaacacaaggatcaccttaattttgattaatgtcagctatggtagaaaagaaaaaaacttactggatagtcaggaaaaatactctgaaaaatagtacttaattcacataagatatatatctcagtaaaattaaaataaagagcccctaaaaagattaattataataaaaagcattatatcaagtgtgcttttcacattattgccttttgaaacattgctctcattataccctgggggaactgatttggtcttaatgccaaggaaagaaacaataagaaactaaatcacatcagttgttgaataaaactgttgaaatgcatatccttgaaaatggatttatgaattgatcaatggatccagaggttatttctgaccaatggcatataaaatgtatcaaaaatcgttggatctctctacttttcactgaaggaaaaatatgttctgactctggatgaggagatatggtttgattttgcaggctcctaggatctgaactcaccctctcaattgcatactttacaaaagtgctcagtcacctcctttcaatctccagaagataatatttcttagagcagagagaccattttattgatgttggatttttgctcctagacatggaactaatcctattaaagaaaagggaaagggaaggaggaaataagatgacattgagaaatcatgactcctggcaagagtaacgcatattacataagtacttaataaaaaatatggcaacaaggagagagggaggaagggaaaagggaagaacaaaagtaagaaagaatgaaaaaaatggaaagagaaaagaaattaatttagctttagttaacagtaagaaatgaagattgaataaaaattaggatgttctcttgcttttctgttaaatgtgtccagaattacagaattattttaaaaaattgaaaaaagaaaaggctggatgtggctaaagtttgtggtttggaaggggaaatggtgttattcaaattatgtttggagtcttgccctctcatatcaatccagagaaagtcggatgttttcctgagactctcggcataaaaagatgcaggaaattttccccacagaatgatttaggctatgaaaattattcactttagaaaagaaatgaatcatgtattattgttaacataagatttgtcattcatttataactggtttaaaacagctatttgtaaaaccaccacagtattttaaaaattaattaactttaacttgacgaataaaaaatgtatatatttatcatgtacaagatgatgttttgaaatatatatacattgttgaatggctaaatggagctaattaacatatgtatctcacatacttatttttttgagatgagaacacttaaatccactctctcagtgattttcaagaatacattgttattagctatagtcaccaccttgtaccatagttctcttgaacttattcctcctatcaaactgaaattttgtatcctttgaccaatatctccccaacccctcctctccccaagacccaggtaactaccattctactctctgcgtctatgaattcaaatatttagactccgcatatagatgagatcatgtggtatttgtctttctgtgcctggcttatttcatttaacataatgtcctctaggttcatttatggtgtcaaaaatgacaggatttcccactttattaaggctgaagtgtatttcattgtgcatatatactacattttctgtttctattcatgttgatagccatcttaatattgtgatgcattataaataaaatatgtattcaatttcctattatgttacagccattctctgcaatattgacacacaacataggatatttgataaatttatcattgaagataaattcagaggctatgtaggaaaatgtacaaaggataactgcattgaatgtgatactggactactaataatctgtaatttacctttaaactaaaaatatttgattctacaactaggcaaaagccaagattctcaggctaatgtataaacattaaaagatccaatgggaagacattaagtgcttacataacaatgatgagttaaaattctctgtcactttgcactataaaaagtttaacaattcaatcaaaagaagttataacaagttaaaagtgtgtttatataacaaatagatccttccttaatatttattttataatgaacacatataaaactccttcaaattatttggaacattaggtaacattatataatttttgctaagtttcaaaatgttcactctgcaaatgcatatcatgccataggtctagagagatgagaggtatggatgtgaactagtaggaagagtattaacttaggaggcacactgatcagggtatgaattgtgattcccctgtttaccagctgtgagatcttgagaaaaatactttaattgctgatgcctcagtttccttatctgtaaaatgtgaattaacagcacagctctctcataaaaggctacaggaaggattaatagaaatactgctcacagcattgtatcaaatagctgagcacattataaaacctcaataaaaggtaatttattattaatgttagagaaaagtttaaattattaatattataaacattgtcaacttttcccattacaatcgttctaacaaaagccaatgaatagggctgggggagaggtatactaattaaaattacaatctaactggggagagaaaacatttcagagttttacttattaagtgcatcctgagtaagctgagttggggaagaaagtgttatggtacctagaaagtttaaattatcaatgcacagtagggatcatgttaaaatgcatatcatagcataaagttttccaatctattccaattcacgtttggtataataaaataattagatatctgttttacatatcacatgtaagcacaacctaatcctctactattatttctttattatttgcaatctctgattagtcatcaatgtaaacctaactttattaaaacaatatttaaaatggtatttgccaaagcttaaacatagtttctcatgtcggacccccaagcagtttttaacatgaaagaaatatgttacatttactaaacgtagccatgcacatacattttcctagagatgtgcctattattaagtctatggaacatctccagtagccattaatgtctttcccgaagttatatggcatttcatgaatgtacccacctggcaggcctctggttggcattccacaacaaagagttaaaacatcccattaatgaaatttatagtgctttttgacatcatttctggtggggagggaaactgcaagtcacttctgttatggtttaacttgttatgctattccagaagatgaattcattgtcataaatattcagcttcacgccaaagaagagtgaacccagctggttggtccttgtcctgtcctcatcttctgtcataattcttacaactagctacaatgaggcagagtcttacttcccatgcaaattagtcatttactttgatttccagcttctgacttataaatatgcataattttataattgttaaataatagaaactttcaataatctgaccaagtatacattgttccttttaatcttttgatacttttgcaataattcattgtcttattgatttgtaccctctatgcaaatctacttccccattactcataccgcacacacacacacacacgtaaacctataagcaacatacttgttactgtatagatatttacatattttatgtttacttataaatataaattgtacatattttatatatttatatattttaagtaaaatatgcgggtttactttctttagaaatgatgtgctctatactaatttgcatgttatttggtatggcatatgccatatatttaaagcatttaatggcaaaaaaactttttaacatcaagtttctcttgctcccttaaaaatgctctttgagccattttaattagactgaaatgaaatagattccttaggcaacagcataaaaatagtaaagtaggttttaaaagtcttattggagaataatttcaagtatggttttatttgatgtaattatttatggattaaacacacagatagcagaatagatgaataatgagcattccctcaactcaggcaatttaaactgaattttcttgagcttttggactttcctttaattagcttggatctggttagtgactatatggaaattaatatttgttttcaccatcgctagtttccaagtctggatttcaagaattgtgctcctcagaaaacctcacccttcagtaactttttcccataagctcataaattgtaattatgctctcacagactaaatgtaagatcctactagtgtttggtttttgtaaaactgtaagagcaatctgtgcaaataatataacgtgacttggttattcttcaaaatattaaaccagtaccattattgctacatgccttttctaattttcccacattttatcagattaaataagtaccttcccatatcttttgggggtaattttatcagtatcaaaagccctgtcagagtctcagcattagcatttagctatagaaccagaattttgaatttatgtcctagttttgccaccgtgttatttagacccaatttcctattcaataacaatcaaaatatagcctgtccatcacccagatgatctctatatcaacatcagagagtggcagatgaagctctaatccctatatcagttgcacacatattgcttgtaatcgtgcacatccctgacttttgagtaatttctcggaaacccttacccatcattatcttgggattttgacttcttaaagaatagatttctccatatcttctcttcagagccattttaacttccacttatggtgcagtggtggctaagtgtagttcatctatttcatgaaaaatattttggtgctgattttgctgattggttgagttaaccaaatgttctagttatttgactagggagggttttttgtttgtgtttttactcttaagcataaacatactactttgccagaagtctccctttgaagagtctttccatggtcacaggaaaattggctttctcctgatttcataacaaggaatacaaatttacactttatacaagattagggtgagcaaattctaaacgatattattctatttttgaacttcggcttgacttctgagagggcttgacttctgagagggcttgacatgcagcaaatgtttgagaatcaaactcttaaattccaatccttacggtaccctgtgtgattcagaaccagtgaagcttgcatattggtaaggtagtggtaaaatttaaaaaaaaaaaaaaaagcaaaacgaacagaaatgttacaaagtaaaggttgtttttgtttgtttgtttgtttgtttgcaggggagagaggaaccaggaaaattttgcatgaggaaaaatataagacacgacaataaatataatttaaaagatagggctgggtgcaatgactcatgcctgtaatcccagcaatttgggaggccaaggtggatggatcacttcaggccagaagtttcagaccagcatggccaatatggcaaaaccccatctctactagaaatacaaacattagccaggcgtggtagtgcacgtgtgtagtcccagctactaaggaggctgaggcaggggaatcacttgaacccgcgaggcagaggttgcagtgagctgaaatcacactactgcattccagctgggtgacagagtgagaccctttctcaaaaaataaataaatacataaataaaataaacaatagcagttaaaaacagtatagtttgtttataataaaaacgtatttaaagcataagcagtatgtagttgattcattttctttaaaattggagaaggttaatattggataccttaatcttttgctctgttgtaatccatatgaagatttaaaggtttttgaagcattttatttttatactattaaagaaagtataaaaacttttgggtgactcaaaagcagattaacacaaatgggcagattgatgactagaagttcctcaagtaatgatatatgaaagaaattcatgttccacataaagagaaagaaagcagtgaacgacttgtgaaaatcgtgtttctataaatctttgaatatgatatgctgtcatcaatgcttagcaactgcagaaatatgcgtcactaacgaatcagattttattaaatgtatgtgtgatgtgtgtgtttgcatttgcacgtatatttatcccccttatctgcacagcatcactattacttacgtaactgcagttactcagttaaacacatcctaatagagaatataaaatcattctcttgagaatctaagcaaattgcttggttgcatttaagatccatcatgagtagcttttcctgtgtcaattcattatacccaagggcaattcctctatttcatcctttttcaaggtcatgggttgagcttgattaatatgactggaaaacagaatcataagtggaaaatatcggtctggtatcagaaaaggttttgctaagaaactgaataagggaaagcttcataatgaaaatactgcatcataagataagagttgtattggaattttaaaaattattttgggggtgatgaataagaaccataacaatagatgttaaggctatggttcaatggctgtaaaacaactttctatacgtaaaaatgtagctgacaatatatccataaaatagaacaaaaaatgaattgagctgagcacaattatgttatttaaaaactccagaagcattagattggaacaaggaaagtctaagtgtatgggcaaaacgcactaagtctctgacatgccatgtataaatattcatggcaataattttcccatgagaggaaaaaaatgttttaggaaatgtttgtaagtagaaatagggtggttttatactttcttcactaaagaaatctgtagattgaggggagtttaaaaatatttcctcaaagaagaaacaatcagaaattccctctttttttataagatacaaaaagacaataaatatgttcttaccacaaaatagtggaaatagtttaactttaggtaatggttgaaggaaaagtttgctgaagcataggatgtagcaatgaaaataaacgaggtgtgaggtttcacgaccaatgattcacacctaggattaatgccagaattcttaatagctgatctcgtaggtgggattatatgtggcattctcatatatgtctctaatggttgaatgtcttcactgtggatgcttttgctgacagaaattactcagtaaaatctgtgggcttagcctaagtttataatttgctgttacatattttttcttccccaaccggatcttctgtcacttgaagcatctctacgataatatcaataacctcaccaatctccaaaccaaaatcatcatgccaaaatgttcctatgcctagcaaactagttttccctttgccaagtacaaaaccttctgacttgacaaactacaagataccataccagggtagtttaggcaagtgtatatcacagccgtattcatctatatttagctatttacagtgtatctggctttcccaattaggttgtttgccaatgaagacaaatgttatattttatacatctttgatctcccaccaaatttttactgtgccaactaatagtgtttattcagtggctaagaaatcacactaaattggattctgttcatccccaacttgttaaaatatgtaacaaatccttggactgggattcttcctgcctcagatttcactgtagaatcaacccagcggataccataatacaacccgcgtattacacaaatctccatatgcagaatttacacatgtgatgtgggagaacatattccattactcttggacctctcagttagcataaggtataaatagaggtccaagggtcagaaatagaattttggagaaagcctgttatcagatttctccagagaaagttattgctgtgttgtaagtcccctttcctgcttctatggagggagggctgagaggtgttatctctctgcaatggaaagacacagaggacaggggcctgactcatttcttaaaaagttaaactttactaggctctaacccatgccagagaaatatatacagagactgaaagcctgaccagctgctttgatagcagaaacagataggagagtaccgctgtattgagatagggcacaacccccagaagttgtgagaaccaaggatgtatagggttttatctggatcagatgtaggccaagacagatgggggtagggagtcacttcggataagctaaactggggtacaggggtaaaggaacctcaccacaaagagaccggccacacaccacagggtacgcaggggctgaggaaggagccacaaaggaattatctgcaatagaaatatcagctaagggaactgcaggtgagagaatccagcaaggaatctttaaagattccatgaaaacactcatgaaaggaaaaaaagatggcttttatattggcctggtctacctgaaaacctcaacttcaaacgttggccatggccgagggtttatgaagccacccagataaacaagaactgtactatttttacacctcctctgctctacacatcactttggtcctggtagagctaacacagcatctaggtagtaagagactctaagaggagctaatgctatacttccgtttccaaccacaggcttctgcactaaagcaaacctcacctgggagaggatttaactgttgattacacaagcttttaagtttggattaacaccttggactccattctaattactgaattggcactatgtttgtgatctaaagtgtctgtagagctgtggagatgtcatggctccgccagaggttatgtccaggaacacatgaagatatgccacactgtaacaaagtgtaaggaggacagagagagagaaaaggaaatcttttttgcttacatcatgagcttacatcgaacacagtggttacaaatagatgagttttttagttagtaaaatgaattctccctacctaaagtaattttatgtagagtcagacgaggaaaactcaatacgtgttatctccagcagcctgtggcacaatctgaattgttcgtgctttatggggaaagaagtgtgtgaagaaaaaaatagtagtagtagcccatgaaaattctctcttatgggttgttttcctgagaatgtgtccagctgattttattaaggagggggactgactgtcaaagacaacagaggtgcccccttagtactcgaagaattagaaaatgtgttcagataatagcttgaacccctaggtgtgccaagagaaagggagacagcaggctcttaaacagtgttgttaaaattcacatttatttaaaacacagcaattagctaacaaaccttggtgacagactgctatgaattttgtgctgactccgtacacataaattaaaccattccaagttccccacgtgcagcttttgacatttgtttcgtacaagtatgctggccgtggggaggcataaactttgcttttaattcctttggcaacagctgtggatcattttgttaaatttcttgtaagagattcaaaaacacttttctgaagacaaaaaatgttgtctccattgcatgttaagctctaaaatgtattctatatgagtagttttcaaaatggtttttagatctgactgcagacagttaaatattatggaattatggtatatatagttgtgtgccacataacgatgttttggtcaacaatgtactacatataagaagatggccccataagattagaatactatatttttaccgtacctttctaggtttagatacacaaatatcactacgttacaactgcctacagtattcagtaccacaccatatgggtttgtagcataggaaccagagtctataccattcagcccaggtgtgtagtaggctctcacatctaggtttacctacgtatactccatgatgtttgttcagtgacaaaattgcctgaggatgcatttctcacatgtatcccaatcattaagtgacacgtgactgtaattttttttttccaatcaagtgctcctctagttgctttggataaacccatcaaaaaagtagataaaaacccctaagaactactcccccatacacacacacacacgcatcctgcagaaagggagagagaaagaaaagatgtcagatttcaataatttctaaaacgtaagaaatctctctaacaaaaaggcataatacctcaaaattaagtataaaatcaaaaattttacttacaagccttttccttttaattatggtcattagcataaacactctgattctctgagctatttaagcataggatttctatttttctactctgtacattccctgcaagactagcaaaatagtaagtatatagtaggtggtcagaaaatataggattgaatcaagcaatatggcagtaaaaatggtccattgtaaaatgttgagtatgacatcatttcgagtaatcaagtaaacattaattatttcataaacaattatttagtatcaaggcattgattgataaaatgttttctaactacattgggccttagcttagacctttcttactgaaaatatggtctttgactcagcagcattaatcccatcaatgtcccatcccagaactacagaagaatcagaatctatattttaacaaaattcccaggtggtttatacatgcattacaatttgagaagtgctaatttataccactggttttcaatcaaaactactcgttaaaatcatctggtgttgttttaaaaaaataaaaaaaaagagggaaaaaaaaaaaactattcctgagccacactccaaaccaattaaatacgcatatgagtccagggatgaagtttcttttttaatgctccatgaagttctcaggtgcagccaagttgagaaacattgatttaaacaaaacaatgaaatatcatgctggctatgctggaattttctgaaataaatgaaattgagttttgaaattaaatcagaggaaataaacttctaataccatatatgaaaactccagtaagacattacttaataccctacagattttaggatcaaatggaaagacacattagtctaaatatgccctctaaggctcataaatgcagtccaacaaaatatcttattcttattcttctttgactcaaaatcatcttaaacagttaatatcagtatgcagaataaaactgaactttaaagttctgcaaaattaaagcaaactttccttactgagcctaaagaggatctaatgtgtcatatttcatctttaaagcctgaaacactgttttcccctaggaaaaatcaaatgaatcaatcctcccatcaagtaaactaatatctcattatgacttagattcttgttaaaaatttggcagagtattccgatttgttttcatatatcaccataactatatagcacatccagaaatctccagaatgaataaatattctccaagcacacgataactaaattgacctaacattttgtgttaattcacaccatcaataaaatgactttcaaaaaggaagacttttcctaaaagctaaataatacaattgcctgggtatatcatatttttttgacgatattgatgaacaaaaataagagatgattttttttcacatttaatgtggaatccaaaagcgtctaagcaaaaaaagcttgcattcataacagataaatcaggaatgtagaaaatatgaattctatttttaattctggagaaaagggtaaacaaaaattcaaagagcgtaattaaaataatttaaatgatttattttcttatttagtcctctattcaacctaaggaagtagctattattacccccactttccagaagaggaaactgatgtacagagaggatagaaacgttgccaaggtcatactttatactttattgagtagaatcttatgatgatttgactcttagagtctttgcagtcagacagacctccatgaaaatctctaatatactcctggttatcaagactctacttctcaaccaacaagagtggaattccagaagtctagccctagaaacttacagcaaatgtctagtgaaccttaaaacgtctctgggatccaccgtctgatgccaagtgctttgcctctgtctctctaaatgttctggtctacatcaaggccattcaggtgtgttagaattcactaggtatattgaagtatacaggatatcatcaatgctttctaaggacataatcaggcttgcatcattttcactttataagtaagtcaaacttcagggactttttcatattttttaatcaaaaagggaaccattgaagataaaggagaaaacataaaaagcccttgctgtgtaaagattgacaaacaaggtaacttaagtatgacataactttgctcactttaagagttggcctggaaacatttctttgttcaataatagagtcaagtcttatctcagatgatttttttaacctattatttttcagcagatgcatctgtgtaagaggtagtaacatccgatgttatattcctccgtgttgggagttcactggtcactcaaactgcagagaccacaattgcaggcagtgctattcagatggactaaaaatcaaatgaagacccaggagttgtgtgatgcgatggcctcatataaagggtaggtggctctttctcccttaattatttctcatgataagtattgataaagcttcaagggtcagcaaagtatgtcctacaggacaaatccagcccacctcctgattctgtagagccatgagcaaagaacagttttaacatttttagatagttcagaaattaaaaagaagaatatttgatgaaacctgaaaactgtgtaaaatttaactttcaatatctataaatgagttttttttttaacacagccatgctcattcatttacttatggtatatggctgcttttaagctatacaccagagagtctggtgtataccatggcagaggtgagtaattgtgacagagattgtgcagtgtaaaaagcctacaatatttactatctggctctttaagcaaaggtttgccaacctctctctgacacaataatgaaaaaaagaaatgtctttcagcttagcaaatatggcagtgactctgttacttgctctttcttttggccagaaaataaactgaatctctgcaagcttccgtttccttctatgcattgtggggataaagaactggctcataggaaagaattcatttagcagactgttttgcacataaaaagcacttaataaattaatgtttcccttaagttggaagcacttagcaccttttctcctcctctatctgctaaaatcgtactggtccttcgaaggcaaaacaaaatactgtattttcatacaatcttctctgactgctcaggttaaattagttgctccctctatgtttccacagcattctgtttaccagtctgtcatattatgatcctcaatctaccttgtactttggttatgtctaagacccttcttaaatgcagatattatttcttatgaatttcatgacttgcataatgttaagcacagatagggccttatacacaggggacattcaatgtttgctgaacaaatgaaaagctgaatgaagatgaaaatgaacaaccaactgggggtatttaagtaggtttactgccctcccaaataataggcaacatgttatctaggaggttcagtcaaaggaatgtcagggaaaggctttctccaaccagtatcaaatattagactgtctaatttatatcttgctatattttacctatgaagatatatattccacttggctttagggtataaattaaaatatgtcatagcaatagcaactgccagagtcaaaagaggcatttagtgagaaaatggtagctcataaaatgaatatgttaattaggaacttttaatactttccatttttttctgctgctcaatcagtcttactccatcctgtattactaacccgaatggctttattaaccacgttcttttcaaaagtcaatttgctctatctttaaacaccacacacacacacacacacacacacatacactacctcacacatgaacaaatacacttttaaaaagctaacaaaaggaaaagaaactcagggaaaaaatctatgaagtgacttatatctcaaaaagctcttattaaagtaaaagcaataaaaacctgaattataggagagaaataaatctcttctcattggttatctgcttcaaggaactgatgccttgaggaatcagatgtttcatgctaatttaaatttttggcaccttcgattacatgaaatctaaaagattgctttctaaataatgacaacagatttcctgacaatgcgaacaacagatgtcaccaaggtaagcaatggaggtttaattgagtcttagtccttggaaaggtgatttcgtctgagaggaaatcacaggttacatagttgattaatgcaacttagataactatgcttgattggctggcagcacagcatctccaggaagaaccccagtctatcatctcaatgctctgattcatctttatgccaaaatacaatgtgcaaggtatagctgcagcccccgtctaaaattcccatgcattacgcttttcaatggccacagattaaaggtatttaaatacatgttagttatttccatttccaatgagagtttaataaaagactatatcttctctttttaatgagaatattaacaacattagtaggggccaagaagattctccaagtctatgcaagagattatatttatatatctgtttttatatctatcatcaatctatctgtcatctatctacctaaattaccattcagtcctctcttttcccgtaacatatcagtggagatgttatagtagtaaatgtggcattgtggacatttataaacatttgattaaaaccatggatttcccttcctgaaaatattcatatgcacatacatcaatttgctgtataatttccctaaacttattcatggactcccaatgttaaaaattttataggacattttaaattataaaatatgatttctgtgctattcaaaatcataaaaacccactatagataattttgcatcaaaaatcacaaatttctaacaacgcacctttaataagtttaacacaaatcatagttctccttccacatcacatattctctattctataagttgcttgacctcccactttgtaagaatcctttctgtttctatttgagtattcttgttctcccaagggatggatatctcagatttaaagataaagcttttattttaaaacatgaatacacaacccagcacagtactatgaaatctcagaagttcttcctaatgtttaacgtaaatatttcctatgccagatgtagctattttccttgtcacttttgcatcataggctagaggattacaaactgattacccagactgcacttctctgccctacatactagcaaattctgctgcttccaattttccacgaagagctcatccttcaagcatctactccatctggggagctgtggtggcctttatctaaaactagatttaacaccagaactctagatgtgggttttcaaatggaataagaggtcatgtgggatagagagctcttttctttcatactatgtgatggatgatatcgtttggatatctgtccctgcccaaatctcattttgaaatgtaatctccaatgttggaggtggggcctggtgggagatgtttgaatcatgggagcagatgcctcatgaatggcttgggtcatccccttgatgataagtgaactctctctctgagtttgcatgagatctggctgtgtaaaagtgtgtggcttctcccctgcattgctcctgattttgccatgtgacatacctgctcctcctttgccttgtcatgattgtaagcttcctgaggcttccctagaaaccaaggagatgccagcaccatgcttcctgtaaaacctgcagaactgtgagccgatcaaaactattgtcttcataaattacccagtctcaagtatttctttatagcaatgcaagaataatctaatacaatagcctactttaataaagtttgaactttgtatgcaaatgttacacattactaaaacatttttatttttatttatttattttttgttttttatttttttgagatggagtctctcactctgtcacccaggctggagtgcagcagcatgaacctggctcacagcagcctccgcctcctgggttcaagtgattctcctgcctcagcctccctagtagctgggattacaggcgtgtgccaccacgcctggctaatttttgtatttttagtagagaaagtgtttcaccatgttggccaggctggtctcaaattcctgacctcaagtgatccaccagccttgtcctgtcctctcaaagtgctgagattacaggcatgagctaacatacttggccctactaagacatttttaaatagtgaaagccacccactagaacataaaagaaaatttaaaaaaatgcctctcttccaaatttcagcagtcttaactaattttatttctctatattctcctagctttttaacctgcactcagtgttaccagatgtaatcaatgtagatacagccatttgttgatcgtatacacagtactggttaaatgtgaactctgcagacagactctctacatttgaatcccaaacccaggggttatcagccctgcaatcttgctcagttccttcatgtgtaaattagggaccataatagtactacctaataatattactgttaggcttaataaatgtaaagtccttcaaaagtgtttggcacattaaaaggacctaataaatgctatatttattatgactagttatttagttcctctatataacactaggttggagccaattttctgcagttgcagagtctacccaataactcttaatggccacacaatatttctttacctcttggcatgtaaactcatttaataatttctataccattgggtatttaaattgtttccatcttttactattatagctaatactacaaagaatatcttcagacatacagctcttttttttctcctttgaagtgattttattaagacaaatttctgagtttaataaatggctgaaaagctgaacattgttagtgagccctgtgttataaagagaaacaaaactgacatccattcaggttagtggcaaggtgtttcattaaagaacatggaatatttgtaatactgtagtattactgaaaaagagtaactttcatgggccacaatttcaattttgtgttccacatcctcctgcattctgaggtcaatggagtcaggacctagcggtttttcagtagaaatctttcacatataaaattcaaggcctttttgctctgatgaccatagagctatttttcacagaaataaagcttttcctgatggtcttgaaacaacttcccacagctcaatgaaaagcaaaagcatttttcttttctccaaggagcctcaggctacatgtaatacagcacttaatttcctgcaccttagttggtaactgttaaatcaattcatgagcaaagaactgaactttcttgaaattctccactcatgctattccactatatcaacatttcataaaacccctcatttctcccctactattactgggcaaagtgaactaagaagagaaaaagaaaagaaaaataattcaatctaagttactatgaaccacagcagatctcatgaagggtactggggagaaataagatgttaagtacattgcaggagctgacaaactaattctggatgagccaagtcacaaaaaattaagagaattattgtatcttatacgttatgtatccttcactatttcagcaaaggtaaactaaaatgacaaatatgtttccacacttacataacccatatattcctccagattgtagaagaaaaatgctatgctgaaatttttaaaaagaaggaaaaaaggtaagacagatgaatggatggagggaagaaaagtgggaaggaaggaaggaaggaaggaaggaaggaaagaaggaaggaaggaaggaagataaaagaatccactaattcaatgggaagaaaatagggagatataatgggtgttggtggatgttagaattccaccaaaaacacctcaaattccatttaaattgatttgatatgtaggtttttcttgcccttctgagtttctcagatagtatattggcaggcagcctcattccctgcagtaaggatggttcttaaaaaactggaccaaaatcaatcaattagacattgccaaagatttctctccaagtgtcatctaaaaatcattaactgtggcatgaaatatcatggacattgtataagacatccatgcatcatttttggttaccaaggaagaataagcctcatgtttgaaactacagagcctccttcatgtcatgtatttagtaacatccagtacatctgctggctttgtatgaattcagaggttcaagcactcttcaaattcttttctcctgtattctgtgttattcgcccattaaactttttctgagtcgacataagtatctgcattgttgaatgctgtactgtcaaccagaactattgtgaatctgattctcagcccatttgctggaagttacagtagcaaggctgaaacattacaatagcaaggcaaagtctgatttggctcagaattcctgatttaaactcccatcagcgtatcccacccatctttgaaatccaacctacaaagcctaacttaccatttcccacctacctgcctatctctagctttccctatcacctctgccttccttctttctactaatggtatcttccaacctttacttaatttactcctaatttttcctttagatatcaattcaaatatttctgtttggggggaagtctttcccaaccctcatccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaaaagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatctgaaaattaaacaatcacccagagacaaatccaaatttttttaaaaaagcatttcataaagacacagtttattctaggaattttcagtaactgttattgcttttttgtggtagctatgcttcaagtaaggctcatttcgtttcaagcctaacttagttccattgcagacaaggaaaggggacggggaggttatattttcatattatctgattttgtgaaattgctatgtaaaaatgtaatccatttcatgaagataaaaaactactttaaaacatttttaaataaaataaaacgtaaccagtgaaatatggctgcatgattacggggcacagttgaacctaattaccagcaaattacaaaccactccactaaatgaatataaatcctcaacaatggagaagggggctctatgactatatgatatgcttggtactcttttaaatgatacttccctatttgagtaaaacaaagaagaaactgcaaagggatgaggcaggataactgcggctcatttgtcacaaggctccaacttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaaggaaggaagagaacaggtgaagtggatagagccacacttcccacataactaagggcaagttagttttatcacttttgggtaaagtgttccctatgaggggatttactcctttcataagaaaatcaatctcttcttccaacaaaagctactgaaccacttatgctgttacataaatgtgttaatggggaaatccattcaaacatctgcactaagcactctgtatttatacatatgaatgagattgagagacactgccattcctactgttttagcttccactatagtggaaaagggaaaatatatacaatatactctgatccaaggagaaagaagaaaacttcacaaaatacaaacttgttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggcaagaaagagaggaagagagaggagagagaagaggggaaagagagagagatagaatatagaagaaatggtttctacttacagctactatctaatcccctggcttttctgaagttgaagccaataatatgtgaatactttaaggatacgtaagcatttgtccaaattagcatgactgatgttcagataaggacataacaaggacacagtgtggcactaaagaaacaaagttgctaataacatacagcttttgcaagtaaactggtttccttcatatcaatcactgtggaaggcttcacattttctttatccaacgatgccatcagtacaaagtccatggtttaggtgtttctttaaattatgctttaagaacctaggacaggtccttcaactgttttcaaagggaaaaaaaatacatcctaacaaagtgaaaacagatctttcaaataatatagataatgaagctgcatattaatgttttagattaaagatgattagtatctattatttcttttgttcagtacctggcatgagagctatctataagtaatcagactttatttatagataaataaaatttataggaagccattcgtttagactgagctcctgcaccaagcccaacagaccaaaccaagatggagtcactcatgctgaaattcctcatcaccaagccaaaactaagttgtttatttgaccttttaagcaatcaggagagactcacatccccaaacagtccagttttaggtactacgataaggaagttcctcctgcattaacctttgcaagtaaagtaactttgaaaagaccaatttgctttttgttttctatatatgttttcctctacccttttctgtttgtaaaaccaaactctgttcagctcattgaaatattcattctattttatagaatgcaaaattgcttgactctagaatggtaaataaaaaacaattaggatcttcaaactaaaatctgttgtaattttgtctttagaattatatctacctgttgggactagaaaaggttttgtgaaggtggtgttttctaagtgggaactaaaaagattggtagaaacaatacaggaaaacacaatagaaaaataatgaagagagtttgcccaaggaatggtaagatatcctttttagttaagtaaagtataagtaagataaacaactagaaatgtactttggggacaaaatgtgaagaaatatgaatgtcaagccacggaatttggactttactcattgttctccaggaaattatgaaagattataaattacgagattggcttgaccacattgttcagataactccacattccaacctcccagctaaggatattgcctcactgtcacctcactgagatggattggaacccctttccctgtaatctgaaactaacataaattatattaccaacagcatcttgtatgtatcacaacactccatataaaaccaacacctactgataagggatggaataacgttacttacttttctagattatcaatgttaacagtcagcgattcattaagaatcatcaaaccttggagttaaagaggctcatatatgcagtgttcaaaaagcaaacgtggaaacaaatgctcactggcaggagagctgattcaccagtcgtacagtcactgcagaaaatatagtccacgtgtttaagcactaaagtttcttttccctcacaagagcacaacttcaagaggaaatgcatgggtaaaatggataaatcccaggcctacacaacaacctagatgaagtctagaaatttagtgctgagtaaaatggacaagtttgttcaagtcatcatccagcgcaaatcacaatgttctgaatgtgttctgacaaggttttagagtgtagattcactacttttttggttacagcttattttaaaatttatgatttcttataaactcacagataaccaaggtgccttatgagaaaatgattctcattttaatgttgttgttgcaagttagaaaacaatacccccaactgaaggcctcagaatccaatctttttctgtccttttcctgtcctcctgcctctcagttccaatttttcctgaggttagccatagaaactagaccccttctttcccaaggtgggtgatagaaaccagaaccccatttccctgaagccagccaaaaaccttaacatattactctaacttgccccctctacctttctgtacaaaaattggctatgaaaaaattatctgacctaccttgtttaactgtaggtaataagattccctttccagagagggtcctcaccacactcagaagaaaggaatacgtactcagaaaggccaagaaaaatctagacagacaggtcttactgagtttccctactcagtctattagcattaaatcatattcgttttgtccaatcatatttctacaggatactgtccatactttgttaaacctaagaataaaaagggacaaattattcccctgcttctttgggccttcattctgaaaggcttcatgtcatgtaaaactgtgatcaaacaaatttatatgcctttttcctctcaatctgcctcttgtcaataattttcagtgaaccttaaggcagcagaggaaaatttttctcttagcccgtatactctccattcattgataaaatgattcactgctgtccctatcaaagaatagattgtttctaagtgaagatattatctcaagtttattcagattttagagatatgcctaggccagaagagagaagccagaagttggtaagaggagccaaatttgaggagcagtcataaaacacttattacttttattgggctgaatgagaaagcattctgtaaagatttctgtccatatgcataactgctgtgattgcaaaaccaagagacacagtaaagacggttttcaagggaaaccaaagaatgatgcttggtctgcagtgggggcagctgtttgatcaatctctatagggtattcacatgaagtttttggtccacaagaggcaaatctcttactatttttaactgggtaactatgagtattgcttgcagaacctacaactgtgttgcagtgctcactactgcttgcatgggtctttacagtgaacattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggggtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaagtttaagagtagggcttggtaatttcttcatctaaaacctagagaaagggcttcaatagggccatggagagtttttgatcttcttcccattgtactgagaagcacagtacaccaacgtcaaaatatagtcccacctaggaacgtagaaagcaagggcaaggagctcatcctatattttgactgaacggcattcccaaagctggtcaagacagaggagaatgagtgtataatacttctagaatagatgtgggccacatggcaaaaaagaaccagcctagagtcttttaaaactccaatgcaagagaacagggtaagaggaaacgaggctttaataggaaaagcctacatatggtagaaagtggaaaaccaagagctgatggaaaagtggtttgaaggtgagaagtcatcactgaccggacagagtttcagttggagagcccacaaagggaagtctctaaaaaacccttaactacagtaggtaagcgctacccccagattcttactgaagtaccaatcaagtaacaattctctggttcccttcctgctcctccctctccatagtctaactagtcctgaagatatcagtcatggtggttggtttgggcagtgggggtgactaaaatttttggtggccttcctgcaagaatgtcacagttagggcctgattgtggatgagagtgtggaatgaataacctttgaataacgaaggaagtgtttatattatattgagctgggaaatttacttattaagtgaataagtgttttacaacttgaagaaaaatgatgagtttcatccatggacatgggaaaatttttcttatgcataaatttttaaaggacagttaaagaaaatgatcagtttgtatactgattttaccttataagtcatgcttggttaatgtatgagtatatatatatatatatatatataaaatgtacattcccatagagaactttatttaacctagacagccactctgtgagataaatatgtctctcatttcataggtaaagaaaatgactctaagagagagcatttaagacaatcaatagcttgcttgaattgaatgaactgccagacatttttctaagcatttcacatatttatttcatttaattctaataacaaccctatgaagtagtcactattatattccccattttatagatgaagaaacagaggcatagagatactaaagttcacagccagcaagtgatatggtcagcaattacacctgtcagttgagcttcagagcctacagtcctatccaggaggcacatgatatagtgagtgagcagcaaagccagcgtctacaccagaaatcctgaatgagatttcccctagatcaatttgtgaggactcagctgtatcataaacaataaaacaaaagttaaaaaggaaggagggcagcacaacaggtctgtcactatcttgctgtgtggcatggggtaaataacttacattttctgggcttgagtttccatgtcgattaaattaaggaaatggactagagagtctccagggtcccttccagatttgaatttgatttccagctctaaaagaatatgtgtgtggtgggtagctaatgcatattaaattatgcaaacaatttagccttgcatttgactgcagggctgatgaaatatttttaaaatttacatttacataagagatagttttgaaaaaatgctatctgaacataacatgcaatcaaaaatatgttttataacatgtcaactggatgaaaataaaagacagtttcaaagatcaaagaagcctaaatgtgtttttttaaagagagtgtgatggggttatacatagattcattattattatttttagaactgcacagctgttttggcagcttgttttgtaaatcctactttgcaaatgtaatgaggtttttttccaaacaaatgttagttaatggagcagataacacatttatttccttgtcatagcttagcattaaataagaaatgtaacaagaattcagagtttaaaatatgaaacatggtatttggtctctttacttactagttacaaaattagaaaataactcaatattttactttctctccatatatattataattatctgtaattataaaatatttttcataacttcatttcttgtcacataagtcttttgctactgtaaaatcaatagttgtattactagtgcctcttcaaagcaaatctcaagtcgctgagcagaaatttttatagtatctgacatgatttaggcacttcttatgtgcaaaatactgctctgaatgctttacatttatgatattatttttttctcacaacgaacccatatctaggaactatcatcctcatttgacaaatgaggaaactgaggcagaaagagtaacttgccaaagttaatcagttagttgaagagctaggatgtgacaacagaccgttgagaggtgcagaataaaaccagaaacaacaggataaatagcaataatataagctaaaatattgtaatttttagttcaaatgtttgaggctttgatgtgatatcttagatatatttccacagaaggtctgtcttaaaaatgtaaaatttaggccttttttgaagccttatttattcttgaaaattctgtttcattacaaaaaggatttgacaagagaaatgctgttctccacttactcactacactgaatgatggggcctcagaaatttgtggtgcagttttccttacactttctgcagtctctcacattcagtgtgtggggtatattagtttcctggggctgccactacaatcaccacaaactgggtggcttagacaacaaaaacttattatctcacagttctgaaggccagaattctaaaaccaaaacgtcagcaaggccatcttccctctgaatcctctagggaagaatcctagtttgccttttcctagctttggggggttaatgaaaatctttggtgtttttggtttgtagccacatcacttcaccctctgcctctgtcttcacacggccttctacctgtgtatctctgcatctctccttcttttataaggacactagtcattggatggagggcccactctgaatcaagtatgacatcatctcaaggtccttaattaattatatatgtagaaagcctatttccaaataaggtcacattctgagattcgaagtacacatgaatttggaggacactattcatgtgtggagatactgtggcctggcattaagttgacattgacatacacctctgagagaccctatattaaacacataatctctgtaatgacttcacagatgtctccatgctgccgaaggtcgcactgtgacctcagcttgggcacttagcaacacatgggcaaacagttttcagcgatctcaaaggactgaggtgaaaggattaggggtaatcctctgagtacagtgcatccagggcttacctaaaacataacaaatatgtgcctcagccctcccaaagctgttccctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaacattcgtaagtgataggtggtgtttttaatcataagttagtaaaatgtgtattttattggtaggttatattttcaatcttctaaatatttctgaacaattgtctgattaattccttagaatgcaagctccatttgttctcagatttcttgccaatatctaggtgaacatctggtacatagtaggtactcaacacaacacatattttttgagtaaatgaatgaatgagtgaatgaacttggctgaatgaatgaatgaaactggatgacaaagaagagaatgcaaaattactagattcttaaatacacaacatgcccccttattactctagtcaaaaaataatttatgctaaaagagctattttgttttggattctcttccactgtgtgccgtccctccatactcccactatgagatgtttgaaaattttctttaaggagtggctaagtgtactatgtaccaaaatcaaaaagtaagtatgtaaatgactatatctttgttttcactgtggcttccaaggagttctaggtcaattaattgggtcaaatataaaagctccataggcctttatgcctacagattctgtatatctaatatttatctgatatatgtatattagatatatatatgtatatattagagagacagagagagctgtaacacatataacaatatgacctcgaattaatattttactcttgtttcccacattaagaagttcattcttttgaatagtttcaggtctacagaaattgcacagagagtgcagagagtatatactataaataaggcaccagatgtgattactcaggaagagcgaagagacatgtagagcttaatttctgcccatgaggtaagtggacgtgagagatatacacataaacagataaaatggatgccttgtactgttgaaaaagggatgaccatgttttgcaggcagtattacagtgtttcctagaatcaagaaatgctgtatgtgagggaaaaccgggagggacttcccagatgaagtggctcttggactggcctttgaaaaataatgtaaaggtacaacaggtatgagaaaaattttcgtgacatgaatggcataacacatatttttgaatgttatctaaaatattagatgaatgtaaccaccatagtctggggctagaacatatggaaccacagtctagaagaactattactatttatgttatttataatagtaataacagtatgaaaagttctttgtcagttgtgattcactctgggtaggacattgtgattcaccttgttttctttccaaacaaaaacattattatctttaataattttttgacatcagagaggcaactaaactcttcgttaaaggataaggttgagcacaggcatttatttgatcatttatattcagctctattcataaaaggattgaaaataatttccacacacatataattaaatagctataggatttcagtttttaggagattttagttagaatagttatttgtgtacacatgttatcactcctggttgggagagaatatcattttaccttagaagggtaaattgtcacccctttatttgccacaacagagaagccgattttcagtcactcctcctacatctttattccatatgagatgtaggtaatctcattagtcaaaacttgatgcactgggccatgtaaaaaatgaatagggctatttaggtttaaaaggtggtgggagagtggtcagtcggggaagcactattttatatcactgcctgaatagtgacaaagaattcctctcctatttccacgtggtcagcacttctaaaacagagcccaggttctctcaatctcagtgcacacataaaagcctgaaattctccttctttcctgctctaccagagaaattccacaaagctgaatgcataagaacatttgggatcacttacagacacagctttctccacaggtaggctctgaggtctaattcagatactcagaaataatcccacactctgtcttagagcaacactgaattctgcattgcagcttttccagctactagacacttgccactaataataaaactgtactttgctccccatttgcactcttgtccctattttctactagttagaacctagaaaatcattactccaaacctcaacgttctttctacactggaaagttcttgatgaggaggatcatggaatattcgcattttacctttggtgacatgctgatgatcacagggcaccctgcccattgtggatgttcaattaatattcttaaatgtaaatctggttaatataattctttgagatatctgctaaaatatgccccaattgctgctatattctactctgtccttcaaataatctttacaccagaagtttccaacacaaatgtaaaaaacatagtattacctttgcaatttggcttcccaatgatatgagactctagctaaatgcaggatatggggacagaagggagaggagattttcaaaaaaataggaagaacaaaatgtattgatctatttgatttttgagaagcaggtcacactgcagaacagccttttatctagcattccacagggagagagtaatgtttgtcatgattctcaaggcaaatcaatagagctagagaataaaaagaacaaaactccaaatctcaagttcccaattaactcagaaagcaatgaaatctagacaagctctaatgtaatgcactggctttcataaagtcatagaatcaacaggctggaagtgttgaaataagttcctggagtcacctagaaaactactggggaagctggattttaactcattggccctggtgttatgcagcaagcactaggctcttatcagattgctggtgactctgaagttatgaatgttactgggatttacaacaagctgattggactgcccaggagctactttagttaggttccaccaaggtacaagtacagacatagcctttattcggatacacattacagagacgtataacaagctattgtagtatactaagtactatttgggatttaccatgacctgacaaatgcagtgttcaagtcttgagtatactgctgccctatgaaatgaaatgtaatataaatcatgttctgccagtttaatccccatgacccttagtagttgataagcaatacctgtgacagtggaattattatctccattttacagatgagctatataagcctcaaagaaataaagtaacttggccataaccacattatttctaattggccaagccagtactaaaattcaagcctcctgagtctaaaccttatgctcttttcactacaatctcaagcaaatatcttcacatcaagaactgattttctagatcaatgacttatgaagaatatcagcttattacagggaatgcaacatgagtaaattaaatatcattcatatagtttgctcctgtatttttttttcaaaaatggcctatgtaaataagcatttttctaagaatctctcatgtgagtgtagttcagttactgtcattttcttattataacttgaaattcttttaaattctgaagctctcgtttcactttctaccctctgtaataaaactgaaatgtccaaaaaactaattatactttcatttttggtgtttatgctgtgaaccaccttttaggtcaaactaaaattattttcatggctgcctttagtaattaaaacttcttgcatgaagtaaaagaaataacatcctattgtgagagtattctagactatttcaaggttatcttgtttttggtggaaataaccaaagataattgagtgaacgaatagtgtgctccttaactatgacagcaaatgtttgcatatttacaatgtgctggagatacaaaaattagcacaacctggtgcctgtccctgacgagactgcagtttaggagagatggatacacaatcaattaaacaaaaatttatcaaacttagtcatataagcaaagaatggcaggcttagagaaggccagtcattcattcatgtgatgcaagtgaaaattccaataaggaggtgataactgaaccttgaagtaacagacatacttttgctacaatatgaactttaaaaagctaaggagtaaaaggatcaatcctagagctctgaattgtatatcatcggatttctggttaagttttccattacatgtgctgttggcgcccatcagagagaggttaattttctgatggagctatgaagcctcccaaaggtccttaccaaatcagaaaaccctccaactcaaatatgcatccatggtagactctgtttggaagcgttcccactcactgtttgcattcactgttactagtgctgagtactgtggtgttactgagttatggagaatttaaagcagccagaaatctgtaccctctttttcagttgcttagaatgatctgcaatctgactgaattgattgatttctgggatcatgaccagttttggttgtttcacatatgcttacaaatggtagatacagaggttttcaacaaggaaatgttaaatcgtctcccaaaaaggcacaaaagagagaatggaatgaactgattcttaatgaagaaataactgaatgaaaaagaaatccttttatctattgtgttaattaatattcacaaaacttttaagacaatggtttattgttgttctgagtatactcttgagattgatttttgtttaattatcttcatttttatcaacaagtgatcaaataacacaacagttccatgatagcagagggttttgaccacttatgggaaactttaagacactatatatctgctgctaagccatggcatgcacacttacaatgtacagaagtgttgctgtaaaatatgtcagcctttcaaaatgttttcttcagggtttacatcctatgcaattctaagataataaggcaatttacaaacttataaaaaagccaaaatagaaaattaatgatcaaacataaatggaattgtctgaatgactcagaataaattaaagactaccaggcctaaaataagaaaaatatagcatttgactatactaaccttttttctccaaataaattttgtcaatctccctgtttctttttgattaacgttcaatgtttagatctaatcacatcgactaccataataatttatgaaccatcctttatttactaattcccttagtgttacttccttaaccctcatctgcacttaacaattcactgctggatatattatctcattctccagttgtattccctttttgcctattgtctctccaagtaaatcagggaggaaccgtgtcttgtactttctttgtatcttaatgatacttaacacaactctatgcatatacctttattcagcagttgttcagaggttaacagtccgtgaaatttagcttattgttttaatgtgtttagctatctggtctgttgcatcaaagcagactagaagcagcaaccatgagaaaagctccgaaagctagcacagatgagaagagattacatttaaaaagccagccaaaatagtaaaaccactaaccccaaagtagactggggtccttcagtggaggggcaaatgattgcaaaaccttcagtgactctgagaatgtaaatgaaaagggtattcatctagattccaagttcaacaactatttatttaatacttattgtgtgccaagaactatgccagaatttgagtttacaaaggttgacacggcatctggatcatttgcttttgagatgctcactgtctactggtggaaagggatacattatcttattttcaaaaaaaagaaaaagtggcaaatgcgatgacaaacacaaacacattagagcagaagcgcagacaaaagatacttctttaacccagcctaagccaaaaagggcttcctggtgtagtaacttcccttgataaactcagttgccaagaaaatgtagttattgtctgttattgtttaataaggcactaatcactaatcactcctagaaataagttgaaggaaaggctttagaataaaaaaaatcttccaaaagtgcttcaggatttggggtgttcactataggcataactttgggtagaagtgacaagttttcaagcgatgtgtgggcagggaaaaacttagtttgtgaattgcaatgctactctgtgtgacaaagatgcgtcattcacaaaatacaaacaattacctaacagaaaaataaattcacagcaggaacaagagtgatttatagcaattaatgcagaatacacttaacacagacatcaagaaatactatcaaagctgaagcacaattacataaaccatctaggtatcgtttaagagaaagacaaaacatagtatctattctcccgaaggattcatgaatcttccttcaaaattagatttatacctgtgattaatttttttaatttttactaaattatggtatgctcttttgttatagctgatatccagatgaaatttatatttaaaatacaaatgatacttgtatcttaattgatgattccacgtttccacttaacagcctgaaagttcatccatggccatcctattttcttgaatcatcaactataaagtgttcataattaggattttggcaatgataaatgtacttaagcaatggagctcaaactaattcttatttaatggcttttcagtatcaaagtagacaaaattttagtctatcccaaaactagtttgtgctggttaccaaggaacatgggacctggttataaatccatttttctatttgaaatgacactttaaagattggctgcaaactgtgcactcaagatataaacactatatttccattttaaatgtcttcaacattacctaagctctcatgtgcaccatgccttttatgcttaacttttatcacagaactaccattcatgataccaaaaaaggcctcatgtccgagtgcccttgacatcctgctacaagaggaaaccactcactgatactcaagtctattatcaccaagaaatctttccaggaaattagatgacattcaaggaaaacactgataatcatgcaggaacctgaaggttatattttaaatgatttgatcagcctctgacgataggaaatagatttggggaaatagctgagcatctttcattcatttattcaacagttattgattatgtattcacaatgccaggctccattctaagtgctgggatgcaggacccaacaaggtagacaaggtccctggtctcatggaacttacattcctttgaatgagtccatcagtgcctagctaaatacatcaataatttcagacagtggcaagtgctgtaatgacaacaaaataggtaacgtgactggtgatttggagcaacaggatagcgtctcagcttttgtgccaaaaggaaggtaagaataaaacgagaaggaacactcactggaagatatgaagaaaaaaataagtagaggattcaaatgcgaaaatacaatgaccattctaagtcgatatgtgtgaggaagagactggaatcttgctgggtactgcacagacctggctccagcctacagaagagaagagcaaacaatccagagtgggattatcgactgcatctcttattttcattatgtgggagagttaaccacttttaacttttgtttattcactacaaaattagaggaacaacatcaaatttctaagtttgtagttaatattaattagtgtaaataaagcacttggtacatattagatgtccaataaatgccagttctctctttatcaggggaataagtagaatttacaaaatagggattacaaggagatatgaaacccagttataataatttattttataacacagctgacagtgcctcattcaaccttccagtaacccttcagaaaaggttttatcatctttctcttatggatgagaaaactgaagctcaaagagatcaagtgacatttgcaagatgattgctttgcatgggagcttggagttagacccaactaatatctcctcttggctggggatggaaagacaaagttgttggtcaaagggtacaaagttttagttagatgagaataagttttgagatcaattgcacagcagggtgattataatcaataataatatattgtgtaatgcaaaattactacgatagtaaacttccaatttcttaccacagaaaattatgtgagatgataaatatgttaattagtttgacttattccactttgtacatatatatcaaaacatcagtctgtacctcataagtgtgtgcaattatgatttctcaattaaaaataacaatttttaaaaagatttggctgcactacactgcctactgatcgtatccctatgataaagtaatacataagtcacagcttcagataaaggcgtaggagcttttcataaagtagtgaaagaaggggaagttgtaggagttacaatctgtctatagagtacaattccaagttacaatggttaagggcaagcctactgaagacagctaagcccagccctgtggtgtgccatttattagtcatacatgcgaaacacctagcatgctacctgacactaacagagtattcatttgcccaagttgtgctgctcgtgagtagcagggatgggacttgacctctcaagtttccaacacatcatgatacttatttcttcatgtaactagctgggaaattcacttgctacacagaaaagacaggttcttaaattatattgtattaaagtgactctttgttaaaacacaaaaatatcccaatagttacatgcaggttgtatccttgttaataacaatataggaatcttagaatcaattctggtctggtaagctataaagttatttacttcaaaaaaaaggacacatacaaaaaatatgtatataacatacatgtatatacacacatacatcgaaaaacatctatacatacaagtgtgtatttttcacctctatgcatatatgtgtgtgtatttatctatctatctacatatacaatgtcactatcccttgtttattaaataacattaaattaccatgtctccagttcatggactgtacatgtatttgtgcataaataaattgcttttcttattatcttctggtgatttactactattgagtaggagagcttcttgtatacgaagaacatctgatatatgtgtatatatttttataaaacacttttcatttattaattattctatggacataacagtttgagaatcttatggatgttactttttaaaaaattatcactacaggccaggcatggtggcttatacctgtaatcccagcactttgggagggcaagggagaaggatcacttgaaaccaggagtttaagaccaacctgggcaacacagtgagatctcatctccataaaaaaataaacaaaattagctgggtgtggtggcacacacctgtggttctagctactcaggaagctgaggtggaagaattgcttgggcctgggaggtcgaggttgcagtgagccaaggttgcaccaatgcattcctgccagggcaaaagaacaaaaccctgtcttaaaaaaaagaaaaaaaaaaattaccatggccagaggtttgttccagaatatcacccaaaaatattcctcaaatgaatactctgggaagtactggcttactaatacagagcaaaaggtatatattaatagaataaatgtgagaaacctatggaaataagtaggggaaataaatatatggaaacaaatgagtcatagaaatacattctttctatgttttaagggaaatactaaagttatgtaacctttgacacaacttgtggagcaaaagattgtgaatcttaactaaaaggaaaaaagaactattttcccaaagtcctcataaaagcaaagtgtgctatattcaacaatacgtgtatcaaattggcattgggatcatgcagctaacccaatttgaaatgccatttaagtagaaataggaaggcaaatcataataattccacaatcaaagctcaaaacatgtgttgacactcaaccaaaatatgaaaatggctaacattcacaccaaattttgattacactcatagtaaatttaaaactactcactaatattgctcagaatcagaagtttgttcagcgtgttataagcgactttctaagggcaagttactttgttcacatatggaccaagtagctattgacaaatcacgtggtttcttttcaaatgctttgtgtttgtggcattttattggtcattgtgtcaggaataccaaacaatttttttttttttagtgtttgcagaatattatacagtacaaacataaaataatatgttgcaatgagtcagcatccttttctaagttttataaagagaattcgtgataatttactttaggacagtgaccttgattgctttaaaatgcctttaatcagtgctaatttctcatcttaaaggaaaatggaaacatctgagtcaattctatttctacattgtcttacttataaaataataaaataatgagaggatattaaaggaaaaatcattcatttattcaaatatgcatacaattgctttaagtctaagatattgaaataaacatggcaccgttaaaaatattttaacggtctatacaattttctggcttgtaaagtcagtctctctctctgactggctcactttctatctaaaacatacctatctgaaacaacaaacaacacacttcaatacaaacataccagttgaacaagggacttcttatttattttcaattttttgagacaaagtctcgcttggtcacccaggctgaagtgcagtggtatgatcatggctcactacagcctcgacctcctgagctcaaacgatcctcccacttcagcctcctgagtagctacaggactacaggcatgtaccactatgtccagctaggctttttttatttttttaagatgggggtcatgctaagttgctcaggctgatctcgaactcctggcctcaagcagtcctcccacttcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtgatgtttactgaaaaaaaaatggtggaatttagaggaagaaaaacactttctcttgggaaataaaagaaaatcatatgaaaatttacctgttacaattcgttaacagaagagaaaatgaagtgtatgtatctggagatttccaatcatctttccagtgctaaatttgaacctcattctcaagggttttctaaaataaaacttaacatacctttccatcgtcacatcctcatgtcctcaaggctaatttgatttagggattattctagtgtttcgatttgctatcagtttgagagcctttgtatcaaaaagaagtgccaaattttgtgaggttcttaagagaataatgcaggtgaataaagcctcagtatactgggcttctcaggaatgtagcactgactgccatttataattaattaaagatttagagattctgtacctttcaaacgttccttctttttgtgtggaacattttctaatatatattcaacatttgcctgccttttcttttgattcagggttgtttctcctagttcttgcttatcttcatctgtttgggtagttgtagccaatggcttataaacaatataactttatttcttacagttccagaggatgggaagtccaatatccaggtgatggcagatttagtgtctggtaagtgcttgctcttctggtcgatagatgaggctgtctgtctgtgtccctacccaaatctcatcttgaattgtactcccattattcactcaagttgtgggaggcacctggtgggagataattgaatcatgggggtggtttcccccatactgttctcatggtagtgaataaatctcatgagatctgatggttttataaggggtttccgctttcacttttctctcattctctctttgcctgctgccatccctgtaagatgggacttgttcctccttgccttccaccatgatcatgaggcctccccagccatgtggaactgtgagttcattaaaccttttttcttcccagactcgggtatgtctttatcagcagtgtgaaacagactaattctcagagtccttacttggaggaaggggctaactagatctccagggtctcttttataaggacatttatgacatttttgagagcccttatgacttaatctcccaaaggccccatttcctaaaactaccaccttaggagttaggatttcaacatatgaatgtaggggggcacaaacattcagtcatagcactgttccctgtcatcgctgtcactcttttctttttctcctttttaagtgtagcttcctgtctccttaggcaaagaaacaaaacaacctaggttggaagaagcacagatatcagatcatataaaagcagaataatttctactcttacaaataaagtgcatgagattgtatagaaaggcatcacaatttgtctttttaatgtttaacatgcttttttgctttcttcctgatcttccaacatattttggcttatagggaaaagttttgcaactataacataaaataaaagataagcaacagcaatcttctaaattgataggggtaaataaactttaattagattaggtaactacttttagaaaaatataatatctctctataaagacatattgtttaacactaagagggctcccttgagtatataaaactaagaagtcatcaagaggtttggtttcttgaaacacaaactctcagaattttgcccataagaccctaacttaaaataataccagtggactctagcaggttaattatcctaccaatcaaagacagttctatgcagatgtaaacatattgtttctagtgacaaaaaatgatgaggctttaagactcagagtgatggagaagaaacggtatgaatcttgcctcattctcttgctagcattcagtcacctccccacctcctactctctctggcttacaaaagccgacctatctaagagaactgcctagagccttctggcaatacattgtactttttggtgtgggtcagtggcaggattggaactagtaattggatttccgcactcccagttcacttatctatccactacaaaacagcatgttaattttggaaatatttataccactaggtcatcatgacctttgaatataaccactggcaccaattatataccaggaatctccttatgcctcacctaactagagtcattgcccatggcagtatggacttcagatgccttctctcctggataactgttcgacatatataaaacctcaaaataatgtgttatatttaagaagaattcgaagacagaatatccaagtgtggatatatcaaattaatgtctacatttctctcttaattttctatccaaggaataagagctaaatataatcacagcaggaatcctaatgaaatgtttcaacaggaagcaatattaaagtatatcaacctagagtgattgttttgatagactgtcttaaaggtaaatctagattttctctttaaagaatactgaatctcaaataaaatcaaatctcttccctgaaatatctgtcaaaatcaaattggtatagactatttttatcacaaacactcccatttttcatagctattccaatacaactctgatttaaaaactgcaatagaaatatttaatttaattaatttatttttaaattttattttattttttttgagacaaggtcttgctctgttgcccaggctgagtgcagtagcactatcacagctcactgcaacctccatctaccaggctcaagcgatcctcccacctcagcctcccaagtagctggaaccacaggcacacaccaccatgctgactaactttgtttttctttcttttttttttttttttttttttttgtggagacagggtttcaccatgttgcccaggctggtcttaaattcctgacctcaaccaatctacctgactcggcctcccaaagtgctgggattacaggcgtaagccaccatgcctggcctacaatgttttcattttattttatttttttttttttgagacagggtctcactctgtcacccaggctggagtgcagtggcacaatcatggctcactgcagccttgacctcccaggctcaagtggtccccccacctcagccttcccagtagctgggaccacaggtgcacaccatcatgcccagcttatttccatattttttgtagagtcaaggttttgccatgttacccaggctggtctcaaactcctgagctcaagtgatagccccgccttggcctctaaaaggggtgggattacatgtgtgagacactgtgcccagcctcattttatttttaaacaaaatcttcaaaaattgtcctgatttaataagaaaatacaacatcctaaaacatgatattaatatttaccatctttagttgtacagattctttatttctttgtaaagaacattattaggtcttcataagaaatgaaatattgctctttatgagtttaatgcacataagtaatctataattctgtatgaaacttttacaatcccttaagaaatgtcctgcaaatttgataatatcaaatttaaaaataaaatacttttaaggtccaaactttagatttcagaaaaaaacatgtggagtacttagtttatacagcctaactctgttctatcatttgcactgataacattattcctgaacacattttagcccaaacccagggaagataggcttacatgcaagtttacaaaaggaataaaatccaggtagtcagcaaagtgcccacaaatgagaaccgaaattcttctaaattgctttgttcaagtttcattatctagacttgtttttggcacaacatggttattgctcaccctttactatcccttctaccagcacatgttgtgaagaacaataaaagtactagggtcaatatataggtatgtctgctcaaaaaaataataataagagaaaaacctatttggttagaatttcccacgatttgcgtcatagcccacaaacaagaccgattcattcacttttctggaaatatgctatgaagcaaaaattttaaaaattaaaaacgtcttctggattgctagactggttcagtcgcaatactttgtttgaaaagggaagagaaaagtatactgtttggtaattggaactcaaagaccacatcctgtgttgttaaatgcagatttcttgattggcatgacagagtatgcaatataattatttttaattgccaattcacatatctaaagaaaagaatatataagactcccagaggcactgttctatagcaggagtttaatacgtcaatgcaggctttagcaaataagggcttttgtcaatatttccctggcacatcacccacaacataacaataccacttagaatttatataggcccttcatttgcaaagtgctttaaaataattaatccccagaatactcatttgtcaggggaatgagcaattgattataaaactgaggatttcaagcaagaaatggtttggataagttcaaaaaggaatctcattttgaaatagaatctctatttgaaatagaatctctaacatccccaaagttagcagtgctgttttgatatggttaacatctttaatatttttaggcactgataagttgaacccataggtttctttatgctctctatatttctcgaaagctcacttctgtactccaacgtgtgtgcagtttttaagagccacaggtttttccatacattctcaaaaatggtagaatgtctatatttctgaatataacactgagaaggcatttgtaaccgctattacaatattagaccattagcgctgtggtggcaagcacaagttcactattgtatacccgagactgaacacagtgcatggcacacagcaatcactagtcatcccaacataaaaagctaatgttctctcagcttcattaactcatatctttatttgttcattcatttaaccagtcaatcaatcatcatttgttgagctctgctatctgcaaatcactgaatgatttagcaagaagatgagaaaaatgttatctgtcccttgatctcatagagtttacaattaactagagatatataggtaagtgaaaaatgaagatgattaaagacaacaatagaagaacaggaaggtcggagaacaaaagaagaaagaaatatttctatttggtgagtgtcttagtccattttgtgttgctataaaggaaaatctggggctgggtaatttattttaaaaataggtttattttggccagtcacagtggcacatgcctgtaatatcccagcatttcgggaggccgaggtagacagatcacttgaggtcaggagttcaagaccagccgggccaaaatggtgaaactccatctctactaaaaatacaaaaattagccaggtgtggtgcatgtctgtaatcccagttactcaggaggctgaggcagaatcacttgaacccaggaggtggaggttgcagtgagctatcgtgccactgcactccagcctgggtgacaagcaagtctctgtctcaaagaaaaaaaaaagaggtttattttactgatggttctacagactttacaagaagcatggcaccagcctctgcttctggtgaggactcaggaaacttctggtcatggtggaaggagatgtgggaggtggagtctgcatatcacatggtgagagagggagcaagagaacaaacagaacatgtcaggttctttttaacacacagatctcattggaactaagagtgagaactcattcaattcctcaagaatggcaccaggcaattcataaaggatgtgcttccacgacctgaacacctcccaccaggccccgcctccaacagtgcagatcaaatttcaacacctgatttgaaggggacaaatatccaatcaatatcagtgaggattcaaaacaatgcttcacaaaagatgtagttttacttgggttttgcatgattttgataggcagaagaaattggagaagattgttgcagactgagggaaggccaagaagtagaaatagctttcctgccaccaccaatttggagaaatttgtagctgaaattatatcacttttgactacactctgtaaattcaaatttgatttgtgttgctgagaaattctggatgagattggcctgtgattaccatacaaattggttgtatgtaaatatgtgcttctatagtgtttgaggacatgacttattctttcatatatctgaaatattcctcagattgtttcctctcctaatgtatattgtatttaaaaaatgagaaaatgtaagtctcttttgaataaaaggctgaaagacttctatggcatactacaccataattacttatatgcaaacatacaataagtctacagaaactcctcaaatacacatttaactttgttctaggcattatggaggatatagtgttgttcccaaaagaatgtcttaacagtgctgatacattaaaaatgttctataaattcttgttaattaaatattacctgatgagtttacaatttgaagggaggacgagtgactccagactatgaggagaacgactggaatgccacatgaagtcgtagacagtgctctctgtgcaatgagtaaggcacaaaacactgagccagtcattgaactcaagtcttcccgatcccagtctaagatagtctttccacagatacattgattctattagatatttcctcattagaaggacttcatttcagtactgaaattacaaagctgcctcaggtatttatgcattttatttttcttcccctgtgctcatgtgatgctccacctgtcccactggggcctattttctctatggattgtgttcatctcccacaaaagccaatagaaactctggcaaaacataggggagcacaggcaatcccttctgccacccctagggcatgctcaggaagacactggtatcgctgctaatagcacctaccaggtgtcctgggttggaaaatcttacctactctgtcacatggcagccctcctcccagagctagccaccagtggtacttactaaattataatgatctactttaaatatcagtaaatgatggtgcaactgactttaaaaccaatttggatatttgctggacatatctgtcattgaggccgattatgaaaggttatataaaacttaacaatggggctgtccagatgggacctaatagtttaccttaatttttagcttaaacagagacagcccaatattacaatcctggactaccaatctattaccttccaaatgcctggggccaggtcctgggggaagcatggtaggtgccaattttggtcaagtcaggtctttcttgggggcggtcatgagaagtaagagtgaagagttgtagataattatatttcataataattcattttctttataatgttatgtatttttttatatataaattaaaaagtattattctaaaaagggaatccctagacttcacaagactgccaagttgatccatggcacaaaacggttaagaatccctgaaggctcacctggcgcagtggctcacatctgtaatcccagcacttgggaggccaaggggggctgagcacttgcaactaggagtttgagaccaccctggacaacatggtgaaaccccatctctcctaagaaatacaaaaattagttgggtgtggtggcacatacctgttaccccagctacttgggaggctgaggcatgagaattgcttgaatccgggagtcgagatcaccccactgcactccagcctggaggacagagtaagattctgcctcaaaggaaaagaaaattcccgaaagattgtccagaaatcagttaatgtgcaagcatagcaaatgcatgggacaaagaagagtagagaggtcactttccataaggaaaacacaatgaggtattgaaagtccaaagaaacatggacttaaaatattactgtgaaaaaaaaagggcaatagaaaggagtttgcaatatctggaaggggatgggttaagactaggtgaagataaacgaatcaccgggcatggagaaatcattccaagacaagcatcagggagaaaaccgaatactctctttatcttgcaagtagtgtcttaaagaaacagggtcccactaaatagtcacttgggagaaatagccaagagctactaattattgtttagttactcaattcatccagtaagtaaaaatgtattgaacacttattatgtgtcaggtaccacatgctaggtgatagatatccaatggtatagaaacaccacaaatggtctttgaccttgtgaagcttacagttgacttggagagacaggcattagttaagtgagtaagaacccaaaaaattatgataagctctacggaggaaaagagtactgtggcaacaaaggcatgcatagtctcgtggtcagtggaattgaagttttgacctgtaagatgagcacaaattggccaggcagagtggagggagggtgttccagatgaagggaggagcatgtagaaaaagagggtactgctgcttagtattttgaattatgacactcttcaacacactgcagaaattgggtagattctccaccttgagaagaagaaaagagagtatgggagtagaagtcaggtaaggaagggagcagggaaagaaacaaggaggaggaggcaaactttcgccatctaatcctttgactggagcccgagcaaccacctcttcttttatttactctccaaatcagagccatcttttctctcttacaccttttgccatgaaaagaatatgatgaagagaataagagaaaccctatttcattttaatatttaccaagaatccaaaatgtacaactgagacggtgttatggagaatataaaagtgagcacaacacttgctttgcagaacaatcaagtgacagggagaaaaaaatctaacagaacgcctgctaggtgttgaagtagagccaccagccctctgggtggccttaggcaggtcatgtctcctctgggagccttcctttcacatctgtcatagagcttgtaggcaactgactttgtgaagttcctgccaggttaaacagactctgctccatttttcagactgttattagaaaatgctcaaatacatctgagtttgtgtaggattggaggcagttaatatatttaaggagtcagacatataattaagattttgttgttggggtgggatttctcccccttttaagtctcacttttgagaaactggaacctgaattgagctgttcagagatgaagactaatatatcataatgtgcacttactaattcactaaatgtctagatgttgatgttggggatttaaggaggggtgtttactaagaccaggcacgggactaggtcccaggaattccaaattgcataaaatgtggtccttgcatattagtcattcaacgggctcagaatggaaatggccatgcagaaaacagtgagcataaagagtttactgctgtatcaacctggacatacaaaggaagaactctgagaccactaagaaggaagtaagtgttaatgggagaggtacatgtggaaagttttgtcacaagtcttgcattggtgcctgatcttaaggagtgaacaggagttagctaaacaaggtgaagaacattccaggcagacagactatgataagtaaaggcaagaagggaaagaatgaacataatgcttttccttccccagcatctatttcagtcacattgcagataaacaggattttaaacatgggaagtcatccaaatcagacaattctcattcttttatcaaaatcctaaagggaacatttttaaatctcttttgtaattgctaggaaaatgatgtgtgcccagagtccttatttagaaaaaacagtccttattttttaaatcaaacaatatatcaattttccaatagagctggaaccaaattctgcatttcatatgttaattgcaatgtactttttcttttgtaaggtgcatgaatatggtctgtcagccattacacaaatttaagtatggaaaaaaaatgggcttcacaaaaagcaatgaaatgcatcaacatcagagattttgtcacgttagtagacaaaaacatcgacttgaaggatgtccttgccaggttaggatacgtcccttttctagctaatgtcaacctagactcagctccagtcagaaatgcctgcttggttggcagctgctgagagatagcaactcctcctagcaacagatggagccaatcaaaagccagcagcagtgatccttgctgttaagtgcaatgacatctcatttatctggcaactccagtgaagactgtatagtgcacaagataattactaagagactgaaatttacattcccatgcaccagggactattagaatttcaacagcatgattggaattttgcctaaaattagatgtctgtgtgtttaaattatgaacaggtatcagagtgtggtggattacgcttaggttttaaagacacctaaaggtgactgttagttttatcacttactgcccatgtgttctgaggcatgatagtttccctgagttttaatttttccatctcttaaaataagatacatacattgcctggcctaacatatctcacagcagtgttgtgctaatcacaaaatatagcagatctcaaagccctttgaaactgtcaagcttcatgtaaataaatactaactgacattttcctactattagagaaacagcatttaatatagctaatagcttcagctcccatctgggtaatctccagtaagccatttcatctttatttcctcacctgcccaaggaagataatgctaggacgtgattcagggactggctgtgaagactgtagtaagcactcaaaaatgttaactaacaattattatcattccatcatttaatgctgcgagaacttgaggtgttgctaaattggagacagtttttattcctactaaatgacccccaaagcaatattctatagaacccaaaaacacatgtatccaagggatcttgcacaaaactctcttaaccctccacagctttttaacacattcatgcatgctagagattatttccaagacatctacttcccctgttgggcaccgagcgctttacttttgctgtctcctcctgatgacctctccattccatgaaattactattctcctgctctacatataactaaaaacttgggatagtccatggtttatttgattaagcaagtgctaccaagcttatagttcctcacaggtctgtctaaacagagtatctactttttatcttattatcaaaattctctcctgcatagaaaggaaagaccaggaaatttttttaaaggacctacagtagtcagtttctcaattctcactcaactccacttgcttgcggtaatatttaatattaaaaaggtataatataattatcgcatataccatactttacatgttataacacgtgaatctgttatacagttaagaacaggtcacaatggccagtattctgctggacccaaatcagtaagacttactgacaagaactacagttttaagctacaattttaaaatatcctctctgcttcataatgcttattccatactcagaactttagtagatcccactttgaatgtcttaatttttgtactgtttagctttcttgctgtataagctcctttgagagcagaatttttgtttcattgtttgtagcacacacacccaaagcatctagctcactttgtacacagtagtacatgcttaacaaatagctattaaagaaatactcataaaaacaaaaaagaaagggatggagaaagaggaggaggattggaggaatggagcagaaacaagagagattaacagagaagggagaggaaggagggaaataaggagaaaggaaagatggaaacagaagaaagaaaactaaattgttataaatgcatgaggagagatatcaaagatgtttgactactttaaatacaactcttagaccatttttcagatacagtataacactgtttctcattgccactcttgtatgtcacctcttagtccttaggatgactgatgctactacagggtgtcaaaaaaatggaattttaacaggcttcattttcatacaaactcaaaaagctaaatgtaaaaaaaaacaaatttttaaacagagatataatacctttgtttgtgttttacttttcttcccagaaatacacgtcgagctgccctttctctatatacctcccactccttctctgcctcccagccagattctacacgtcagtttgctcgagtccccagctctcacgtcctcaaaccatcgccgtctctcttccagacacacacctcagccaatattctggcttccagtgaaacacaaatgaagaaataaaagtcttaaatagaaattctaaactcctgcacatgatagaacatttacttttctaataagggagagaaaggtggcttaggaaaaaaaaaaaaaatatatatatatatataaatatatataaatcctatgaaaaactgtgtgaaaagatctagagttaagagtcttagtttttgtgtcggacactgatattagtgacccctatttcctttgagaaactttctatttttctaagatagcaataatgacactgctcaatccatctctctggttttttttttttttttttttttttgagatggagtctcactctgtcgcccaggctggagtgcagtggcatgatctcagctcactgcaagctccacctcccaggttcacgccattctcctgcctcagcctcccaagtagctgggactacaggcgcctgccaacacacccggctaattttttgtattttcaatagagacggggtttcactgtgttagccaggatggcctcgatctcctgacctcgtgatccacctgtctctaaggtttttatgtggatccagtgtcattacaaatatgaaaattttaaattttaaaaatgtacacaaaaacacacagttggattaccttttctgaatgcacatttttgtttatatgatttcaattatatgttaggggacacaacaagttggaaattcttacacaaatccatccattatggacgctctaagccactaattcccactactgcaaccaggtatacataaaaacgtgccttaacccccagttcaggtgagttgcaggttatgattctccaatgatggaatactctgagaaggcaaaaaggggcatcatttttctgggtggcatcataatcactaccaaaaaattggtcaaagaagcggggcatggtggctcacacttgtaatcccagagttttgggaggctgaggcaggaggattgcttgagtccaggagttcaaaatcagcctggacaacctaaagagagtttcttgacatatatttctaaggggcaaatgaatgaattctagttctcaaccctgtattgctgattgatatatgttgaccatgaatggttttctggtggccccagagagtcgacaatggtttgtcatcaagggcttatccagggcagaagctaataaaatatcacttgcacagattaaataacaccacatttcaggagaggcagtataaataagagggacctctggataatgaatggatttaaaaggtccagcctgtccaaatcaattttctaatctcataaaatggggttgaacccaataatttatgtttccttccacttccaaaatttaataatattatttacttgttcctttatttatttaaaaatatttatttacttaaaatgagaaaagtacctgtgaaagaattagatttgtttaatattctcatggacactatgatcacacatcatgtagtatttaaatgtgatcaacaaatagttgaaaatgtgttatgtgaaaaataataattttcgcaaacacttttacagcacttaccatatcttaggcatcatttcatgtgatggaagacaaatatatagatagacatggatatggataatgattgaggtaagaaatacaatggagacagagacagaaaaattcttttaatcattacaacaaccaacagctttagaacattaaccatgtgttaagtaattaacatgttatctatgatgccagataaaaaaggcacaataaatagaaaatgttccttatcgtcacctccagggtacgctttaggtaatgaagttctaatatcagagatagcagcaacgacaggatgctaattgtggtgaatattagaaaagaagccactgatgtagtctagccgacctctatgatcacttttatcaactgaaagttaaaaaataaataaataaagctagagtgggcacaatgctagatagcagagacagaactggcatatttggaagatctctcaattctacaggcagaatttttttaaaacaaaccaaacaacaataataacagtttactgttaggggaagcactgaggttgggctttaagagtttgctgagaagctgatttgcaaagataggcaagcttggaccccagtgaagtggtcaaataaataacagtgctcaaagagttatatttactgccacgcaagatgaatcatgcctctttggggaatgctttttctgaaatttcatttcccattttggactactggatcagtctctcagaagagtttggaatgtggccaattacttccctctgcatttttcatctgagacttaggctgtacaactccattttacattttcacaccatacatcttagatagtagggacttcattttgtgaagaataagacaccaaaaatatagtctgtttgtaaatatagatttgagaataaagaccaagaaacgcacgttagaaatcttaagaaatgaatttttactataattatctacagctctatgctccatacttatattttaaattataatactaatgaaaaaaatcactgttgagatgataaattagcagaccattaaaagcttttaagaatgaaaaccactctccaacgatattcacgtgaaaaaccagacagtaaaagaacaaacaagtaaatgtggaaataaccagaacccaatatgcaactgtctcaatcacatttaacctcagtattactagagcactcaaaagtaataggttgttaaaccgtttggagggcaaatgacattggcagatctaatggcaaaacaaacaaaatatcaaatatatttaaaatttaaaatatcaaagaggccaggcacagtggctcacgcctgtaatcccagcattttgggaggccgaggcgggcagatcacttgaggttgggaatttgagaccagcctgaccaacatggagaaaccccatctctactaaaaatacaaaaaaattagccgggcatggtggcgtgtgcctctaatcgcagctactcaggaggctgaggcaggagaatcgcttgaacctgggaggcagaggttgcagtgagccgagattgcaccattgcactccagcctggccaacaagaacgaaactccatctcaaaaaaaaaaaagaaattaataaacaaataaatttaaaaaaataaaagtccaaaccaaataaggtcctttaaaccactgacctacagcaatccattttacttgacggagcattgggtaggggaaagattacagataagttattttaaggaattaaattaggtgaatgttaaatattctagaattatataaaagaaattgtcttagagtaggcattgaaaaattagttcaaggtctgtacccacttacttttcctatgagacaataagtacaaacatgttttgtaaatatacaatgtaaaatataaaatacaatgtaaatattgtatttcatctacagaaatattacttgctttttgtaaattaaagaatcaccctcaatgtatcatgcaggagcaactccatttctgggtatcacataattttaaagcaaagatgtaaccataaacatgctaaattgactataaaaaataacatgcagagtgcaaaggaagagaataaaatgaagagcacaacacagccattagtggaaagaaagactgctgctatgatttagaccattcagggaaaaccaaagcagaaaccatagcttgtgtcagtctcattaagattaaattcacaaatatcccatctgctatggtttcctaagtggctacagtgaggacacaaagcttttccacacatttgaagaaactgtggcaacaaaaaactccatcatctctgtggaggtactgttgggtgggtgatgggggtgagagagtttgcaggaaactggaagatgggaactggaagataagtcggacacagcctttgccttcaagatgctgataattcatttctggagacaaaagtacaaactcaacctaaggtgggagagaggtacaagcagaaagctatggaagaataaagaaaggcagactacttcttcagtttcaacaggaaacacagtgaggatttcatggtggaggtatactgggtcttaaagaagaaacaggacattgataaataacgatgacagagagacatgagcactgactgagtgcatggaaagttgagatatatgaaatgactgaaaaggaaaggaaaacatgtcataaaagtaaatgaaaatggagatgaagccagagaattatgctggcttctagagggaacccatcagaaaatgttattctaggctaaactatgttgaaaatctttcatccttcttaaaactctgtacttctcagtatttattttagagtacttcttcttttactcttttttcttctttttaagagatgggctgaattaaactacacaaggtgaagtagatatagaatatttaaaatggtaaattatcgagcatgaaatctcatctgattcaatgagtgaaagtaatattgattaacccagccactgaccttgagtaacagacataagaatactgtaataaacacaaaaaagtgctggtaaagtatttgtcgcaatgccaagagctacaacctggattaacagtcacacttcacaaaatagacttctatgactttagatgtgcttattatgtctaacgatgaagaaggtgaaacaaactaaactgagagtggaagacacatgttgcccctcaactgtgtgctattttgatatcgtagagatgatcattaagtgatttatcataaaatgtatgaactaaagataaatatttaattatagaaagtatgtcttcatgtgtctttctataaagatttctatgggcttcaaacttcagttagagcccttttaaaatatttatacttaaaactgcaccataaattgcaatttgcaaatacttatgaggaagtaatattctctctgatgcaaggcaccaaaaatgtacattgcagaattgatacatacatttctatatctggttttcattaaatagctcaaaggtgtcattttaaggtacaaaatattataaaatatctcacaatacatgtttaaattgatctaaggacagaaagtaaaaatctgttttgcaatttaatacctactcaaatgtaccacctcattaagagatatgtataatttttttaagtgctgacaataatcatttggaagcccaagctcagtaagtacagttaaataccagtcctaggaaaactcttaatcaggaaaactcttcttgcatagtagtcttctgtggtcaaaatcattgtgtttacagttgtaagacacagcttcacaacgaaaacatggattccactctgtttccactacttcttccacttttttggtccatcaccagagtgttaaaatgttgtctcacctctccaatcgtgaagaaattcacacctctgtattactttaaaaaatgtaattcaattaatgtgtattgaatacataaagaacaatgattttatttcctgtttaatctcaattaaataatgattaaattgacattttagcttttgtttggacaaattatctttctaaataacagaactattaagacataattcccatacaatacagttcactcattcaaagtgtacaactaaatggtatttaatatattcacagagttgtaaaaccatcaccccaattaattttagaatatttttcttcacctcacaaagcaaccccacaccctttagctgtgaaccccttccattcctcccatccccattcagtgctatacaactgctttatgtctcaatagagttgctttttctggatattttacataaatgaaatgataaagtatatcttttgtgactagcttcttccatatcacataatattttcatggttcaatcttatcgtagcatgcatcagtactttactgctttttgttgccaaataatattccattgtatgaatataccaaactttatttatccattcatcagttgatggacatttgaattgtttctacttttaggctgttatgaataatgctactatgggtatgcatatacaagagtctttgtgtagacatatattgcaaattttcttgggtacacatctagccgtggaactgttgggtcatataataactctgtgtttaatcttttgagaaactgccagactgtcttacaaaatgcctgcaccattttacattctcactagcagtgtataagagttcccatttctcacctacgtgtgttattatcagtcttttttaatatagcctttgcagcgggtgggaggtggtatcttcttgtgattttaatttgcatttccttgatggctaatggtgttgagtacatttcacattgctattgactgtctgtctatctatctatctatctatctatctatctatctatctatctatctatctgttttcagatcatttgcaccctttcaattaggttatatgtctttttattactgagttataagagttctttatatattctagatacaaatttcttatcagatatgtggttttcaaaattttctcccattctgtggattgatttttcacttgattgtgtcctttgaagcacaaaagtttttaattatgatgaaattcaacatatcgattcttcttttgttggttgtgctttagatgttatatccatgaaaccactgcttaatccaaggtcataaaagtttactcctatgctttcttccatgagttttatggtcttagctctaaaagccataggttttagggctctaatccattttgggttactttttcatttaggtctgtgatccattttgggttactttttcatatgtcatgtgaaaacttagcctttaattttttttttttttctgctaccattcagatttcttaaggtcttcagacaatggcaacaagatcttttcattgaaataactaagaaagtttgtggaaaacccataagcatataaataaaaaagaaagcatttcaataagtagtacataaatttttagaaattaaacatcttattcttggattatatgtacaattagtcaaaacgcaaagataatacaaatacaaaacaaggaaattcatgagagctaatgaaaacttaaaatgttatgccgtggagcttgccgtgagccgagatcgcacaactgcactccagcctgggcaacagagtgagactcggtctcaaaaaaaaaaaaaaattatgccaagacacaaaatatttaatgtttctataaccctgcttctctctcttatggcacctaacaatttaaatattttattatagtattaacgtatagtgtttgcctttgtcttctaccatgattaaagcatctataatataacttggtacatgataagtaaaaatattcaaaattgaataggtgaacaaattaaaatgaatgaattctagaattggcactttttccctgttttgatgcataattttctctccttttcatcctttatgttttagcttaagtattacatccttaaagaaatttccagagaaattctgtcgaaattagtttcctctattattctctattacagaaatacatttcattctttcatagcactaatcctaaacagtaaatgtttacatttattttttttacatgttattgtgttctcccaatatgggagatggaaggtttttcattttacttccaatgcctaagacaatgtgtgacacattaataattttaaataaataggtggtaaatgatagtgtaaatgggatcatagacaacctgctgatccctggattttcaggaatagctatattgaaaccacaggcacaatgtcattgctatgtcctttttcatggtagagctttcagttcccacacaacctttcacacttccctgaagagaaaaccttttcccatctattgaaatcgaagaataaaggttgaagtagtaatgcttattcatccttgcccttgctacagaaattttagaggtaatatctagcaatctgcaatgaacactcatcaagcaataagcttctgtttccaaatcccagatgagttctaatttatttagacctgaataaaattagaggtaatctctcttccttgtagtctctacagttcaatatttggcttcccagtagaggttcataaacctgtcaactaatagttatggtgattagaaagataatatgcaatctaatgaagagactatgtatgcatatctatgcttcagtctactccctttttctctctctctttcttgccctaaagtcttatattatgcacagttaagtttttggtctagagaggtgtggctgctgccaggtgctatggactgtaagtctctattaccctcagattcatatattgaagcctaatgctcaatgtgatgcaatctggaggtggagacttagagaagtaatcaggtcataagagtaaagtcctcataaataggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagtatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaaccaataccgataaatgtctatctttagacttctgggtgtatgaggaaatccaaacctctgatccctttaaaccattgttatgggcatcactttcctcacagctagactcaattcctcattgatacaggaaagtaaacataagaaatttgttattaataattggtcttaggaaataaaatcagaagaggaaactttcttcttagtgaggttttgtgcacatattgacacctcaaattacccactgagttacatgtagaattatgtggaaggcatgtgtaaggtgactgcataattattgccaaaatctgaatccaggattctttagaaggttaaataggtgccaccaataattatactaagatactaggcataaactagaactcttctggatgaaccaggacatagagttaccccatgggagaatgatgttcacagtggcctcaaaataaagttctttcatttcagttgtagctggctgaaaggtatgtcacttaaattctatatattcccctaacataactactaggttttttgtttggtgcagaaataaccagtaggtataccataaatacagcagactgtgggcttgtggagcatgctgcactccgtgatctatctctgtctatcattgttcttatttgaccccatcacaggtgtttaaaatttgtttcgtcgttgttgttgttgttgttttatgtcttttttctcagtgctatatgttcaaagagccaacttctctacagacttgttcataagaatgacttgtttctgcttctctgctttgccagatctctattcctttcaaatttctactgaaaaatccactgatttcccctttgcatttaggacacataaattctttctcttttcctctccctgaaggttatgaaagtcctggactgtagctttattttatgttgtatacttccctccaagtgagttatataaggagatagttccgagaaggaaaatgcccagaagttgaaaaaccaggtcatcctagggggaaaaaataagtagccaatacttttttaggattttcttgttaaaaacccaataaacattcaaatatgaaaactactaatgtttttacattttgcagactggggtatagaacagcaagagaaagcagaactaataaagacaggagatcttttggaaatcagggtgaactgatttcctacagcaaggccataagctacagcaaggccataactcttcagaaggccattgtgtgatgctttggcaggaacaacaaggaggacatggactaaatggagcttcagctttttcagaacatgttactactctcaaaaattggttcactgctttatcagtttagcagttcataaaaatgtaacccaaaccgatttatgtaaaaagggcaattattggctcaggtaactgagagttttggaggtagggctggctttaaggataagaatgagaacttgttgctccccatgttttgaaccagacctcctgtcctctgaatgttggaatcattagcagaagggatctccctctgtggtattaagatggttagagtccctttatcttttctgctccaaatccagtttaaaaaataataatagatcattgaggtggagcaagatggcaaatagataacactccagcagctgtcctccctctgctaaaacgcaagaatgaataactacctacacaaaaaaaaatccttcataataaccaaacatcagatgaattatcacagtatctagttttaacttcatatcactgaaagaggcactgaagagggtaggaaagacagttatgaatcacctatatcaccactttcccatcccccattagtggctgcatggcatggagacagaacctgtgtgtttggggtaaggagagtacagtggttgtggggctctgcattaggactcagtgcttccctgttacagtggaaaacagcaaagtgaagaacttgccggtgcccagatagggggcacctagaccagccctagccagaggtgaattgtctgtcctagtggtcagaacttgagttctgccaagccttgccactgaggtcctaaatgaacttgaaaggcagcctagacaacaaagcctgcaattcctggacaagtcctgctgctgggctgggctctgagtggacttgtggtgcatgtgacctagtgagacaccagcccaggtggctaaggggatgcttgcatcacccctcccccaaccccaggcagtgcagctagcagctacgggagagacatcttccttctgcttaaggaaagaacaggggagagtaaagaaaactttcccttacaattgggataccagctcaaccactatagaatagagcaccagtcatgaggcctgcattccaggccctagctcccagatgaaatttttagacacaccctgggccagaaaggaacccaatgccttgaagggaaggacccagttctggcaggatccatcaccagctaactaaagagcccttggattgtgaataattagcagtggaggccacaggccttgggtgagacttaaagctgtgctggcttcaagggtgtcccagcatattcccacatgtagtggctataggaagagactccttctgcttgagaaaaggagaggaaagagtaaggggggcttctcttgcagcttaggcaccaccttgaccacagtggagtacagcatcaagcaggttcccagggtagccagctccaggccttggctcctggatggtatttctggaccagtcctggggcagaagtgagcccactgtcctaaagagcgagacccagccctggcaacgttcaccacaagctgactgaggagcccttggacattgaatgaacattggcagtagccaggcaatgtgtgctgtgggccagggatggtagtggccacaggaagagactctcctgcttaaggaaagggaaaaaggaagagtaggaaagacttgttttgcagcttgggtgctagctcaaccacagtagaatagaacaccagcaagattcataaggttctcaactccaggccctggctcccagatggtatatctgaacctacatgggggaaaagggaactcgctgccttgaagggagcaagcctggctggtttcaccacctgctgattacagagcccttgggccttgagtgaacataggtagtaaccagacagtgctcaccacagaccataaaggagacacagtgctgtgctggctttaggtatgacctagtgcagtcccagtggtggtggccacaggggtgcttgtgtcatctacctccagctccaggcagcttagcacagagagagagagagagactgcatttgcttggggaaaagtaagagaaaggaacaagggtgtctgcgtggtgatccacaaaattctcccaatcttacccaaaacaccaagatggtacctcttgtgagtctacaagacccacaacattactaggcttggggtgccccctaatgcaggtatggctgcaatagccaaaaacttagatcacaacacccaagtccttttgaatgcttgcaaagtcctccgaaggaggacaggtaaaacaagctcagactgcaaagactacaagaaatacttaacttcaatgcccagacactgatgaacagccgcaagcatcaagaccatccaggaaaacatggcctcaacaaatgaactaaataagaccccagggaccaatcccagagagatagacagaattcaaaataattgttttgaggaaggtcaacaaaattcaagataacacagagaaataattgagaatcctatcagataaatgaagagactgaaataatttagaagaatcaaggataagttctagagttggaaaacgcaactgacatagtgaagaatgcattaacatctcttaacagcagaattaatcaagcagaataaagacttggtgaacttgaagacagcctatttgaaaattcacgatcagagaagacaatagaaaaaagaattttaaaaaatgaagcatgcctacaagatctagaaaataacatcaaaagtacaaatctaagagttgttggccttaaggaggaagtagagagagagatcagagtagaaagtttattcaaaagaataataacagagaacttcacaaacctagagaaagatgtcaatattcaagcataagaaggttataaacatcaagcagatttaaccccaaaaaagattatatgaagacatttaataattaaaattttaaaggtcaagctaaagaaaggatcgtaaaagcaggaagaggaaaaaagaaatacaaaaaacatacaatggagctcccacacatctggcagcagacttctcagtggaaactttacaggccaagaggagtgaatggcatgacatatttaaagtcctgaagggggaaaaacaaaacaaaacaaaacaaaacaaaacttgtatcctagaatagaattatccagggaaaatttcctacataaaggaaggaaaaatgaagaccttctcagataaacaaaagctgagggattatatcaacaccagaactctcctccaaaaatgctaaagggagttcttcaatctgaaagaaaataatgtgaatgagcaataagaaaccatctgagggcaaaaaattcactggtaatagtaaacacacagaaaacacagaatattataatactgtaattgtggtgtataaactattcatatcctgaaaaggaagactaaaacatgaacctatcaaaaataataactactgggctgggcgcagtggctcacgtctgtaatcccagcactttgggaggccaaggcaggaggatcacttgaggtcaggagttcaagaccatcctggccaacatggtgaaacttcgcctctactaaaaatacaaaaattaggcgggtgtggtggtgcatgcctgtaatcccagctactcaggagactgaggcacgagaagaacttgaacctgggaggcggaggttgcagtgagctgagatcgcaccactgcactctagcctgggtgacagagtaagactgtctcaaataaataaataaataaataaataaaataactacaaaaacctttcaagacatggatagtataataagatattaatagaaacagaaaaagtttaaaggcaaggggatgaatctaacatgtagagtttttattagttgtctctttgcttctttgttagtttgtttatgcagcctgtgttgtcatcagtttaaaatggtgggttatattatttgcaagtctcacggtaacctcaagacaaaaatcatacaacagatacacacaaaaaaatagcaagaaattaaaatatgctagcagagaaaatcacctccactaaaagaaagataagaaagaaggaaaaaaggaagagaagactacaaaacaaccattaaacaaataacaaagtggccagaacaaaattccttctttatcaataataacacagaatgtaaatgaaataactatccaatcaaaagacgtagagtgcctgcatagatttcaaaactagagccaataatgtcttgcctataagaaatacactttacctagaaagacacacatagacagatacaaagatggaaaaagatattccatgcaaatggaaaccagaaaagaggagtagctctacatagatcagacaaaatagatttcaagacaaaaaccataaagagacaaaaaaatcatataatgataaaggagtcaattcagcaagaggatataaaaattgtaaatataaatgcacccaacactgagcaaatattatcagagctacagagagagaccccaataaaataataaccggagacttcaatgccccactttctgcattggacagatcatccagacagaaaatcaacaaagaaataaacttaatctgcactatagatcaaataggcttaataaatacagagcattccattaaatggctgcagaatatacattcttctcagcacatggattattctcaaggatagaccatatgctaggtcacaaaacaagtcttggaaaattcaaaaaaactgagatagtatcaagtatcttctctgaccacagtggaataaaaactaggaatcaataaaaaggggaattttgaaaactctacaaacatatgaaaactaattaaataatatgctcctgaatatttcttactcaataaagaaattaagaaataaatgtaaaaatttcttgaaacaaaagaaaatgaaagcacaatatacccaaatctataggatacagtgaaagcaatattaagaggaaagctgataggtataagtgcctacataaaaaagtaaaacatttctaataaacctaacgatgcattgtaaagaactaaaaaaacaagagcaaatcaaacccaaaattaggagaagaaaataaataataaagaccagagcagtagtaaaggaatttgaaatttaaaaaaatacagaaatcaatgaaataaaatgttggttttttgaaaagataaacaaaatcaacacacttttaagccagaccaatgaacaacaaaagagagaagacccacataagtaaaatcagagacaaaaaaaggagacattacaactgctaccacagaaattcaaaggatcaccagtggctactataagcaactacacaccaatacaatacctggaagacaaagataacttctcagacacatacagcataccatgattgaaccctgaaagagtccaaaacccgaacagaccagtaacaagtaatgagattgaagctgtaacaaaaagtctcccaaaaaagaaacttagttccaggacttagtggattcactgctgaataattttattaaacatttaatgaagaactaatacctactgtaacaatttcaaaaaatagaagaggagggaataatactcactctgtgaggccagtactacccctgataccaaaacctgataaagacattcaaaaaaaaaaaaaaaaccacacaaaaaaactataggctagtgtctctgttgaatactgatgcaaaaacacacaacaaaatacagcaaaccaaattccacaacacattaaaaaaaccattcatcataagcaagagggatttatcccaggtatgcaagaatggttcaacattcataaatcaaccaatgtgatatgtcatatcagcagaatgaagaacagaaatcatataatctttgtaattgatgctgaaaaatctcttgataaaattcaacatcctttcatgatcaaaaccctaaaaatgatgggtatagaaggatcatatcttgacaaaataaaagccatacatcgcagacccacagctggtatcatactgaacaaggaaaagcagaaagtctttctctaagattagggaacaagacaaggatgcccacttttcactgctgttattcaacataatcctggaagtcctagctagaacaatcagacaagagaaagaaataaaaagcatccaaattggaatggaagaagtaaaattatctttgtttgcagatgatatgatagtatatttgaaaaacctaaggacaaaaaaaaacacacaactcttcgagctgataaacaaattcagttaagtttcagggtacaaaatcaacatacaaaaatcggtggcattctatatgccaacagtgaacaatcagaaaaagaaatttaaaaaaatcaatttacaatagcaacaaatgaaatgtaatacctaggaattaccttaaccaaagaagtgaaagaactctacaataaaaactataaaatattgattcaataaattgaagggggcacaaaaaaatgggaaatattccatgttcatggattggaagaatcaatattgttaaaatgtccatactacccaaagcaatctacagattcaatgcaatctttatcataatactaacaacattctttacagaaatagaaaaaaataatcctaaaatttataatttatattaaaccacacgcagacacacacacacacacacaccccagaatggccaaagctatcctgggcaaaaaaattaaaaactgagagaatcgcattacctgacttcaaattatactgtagagatatagtaaccaaaacaacatggtagtggcataaaaacagacatgcagaccaatgtatgaacagaatagagaacccagaaataaattcgtacctctacagagaactcattttcgacaaagtttccaagaacatacattggggaaaggagtctctttgataaatggtgcttggaaaactggatatccacatgcagaaaaatgaaactagacctctatctcttgtcatggacaaaaatcaaatcaaaatagattaaagacttaaatctaagacctcaaagtatgaaactactgaaatctggcaaaagatctgagtaggcatttctcagaagaagacttacaaatggcagacaggtatataaaaaggtgctcatcatcattgatcatcagagaaatgcaaatcaaagctatgatgggatatcatgtcactctagttaaaatggctgttatccaaaagacaggcaacttcaaagcctggcaaagatgtgaagaaagggaaaacttcaacactgttgataggagtgtgaattagtacacctatggaaaacagtatggaggttcctcaagaaactaaaaatagaatgaccatatgatccagcaatcccactgctaggtatatccaaaagaaaggaaataggtatatcaaagagatatttgcactcctatgtttaccacatcactattcacaataccaggatttggaaacaacctatccatcaaccgatgaatagataaagaagatatggtatatatgcccaatggaatattatccagccacagaaaagaatgagatcctgtcatctgcaacaacattgatagaactggaagatgttacgttaagtgaaataaaacaggcacagaaagacaagcatcatatgttcttatttgcaggagttaaaaattaaagcaattgcacacatggagttagagagtagaatgatgcttaccagaggccaggaaagggggacatggggagtagggttggttgatgggtacaaacatatagttagatagaatgtttcagatcaaacgtttgatagcccaacacagtgaacaataagctaatgtacattttaaattacctaaaagagtataattgaattgtttgtaacacaaagaaagggtaagtgtttgaggtaatggatacttcatttactctgatgtgattatttatcattatatgcctgtactaaaatatctcatgtggcagggcatggtggctcatgcccgtaatcttagcgctttgggaggctgaggcaggcagatcgcctgagctcaggagattgagaccagcctgcgcaacacagtgaaataccatctctactaaaatacaaaaaaattggctgggtgtggtggtgtgcacctgtagtccctgctacttgggaggctgaggctgcagaattgcctgaacccaggaggcagaggttgcagtgagccgagatcaagccaccgcatgccagcctgggcgacagagcgagactgtctcaaaaaaattaattaattaattaattaaataaaatatcatatgtaccccataaatatatatgcctaccacgtgcccacaaaacttaaaattaaaaaataataataataaaatgcaactctctttcaacagataaagtcttgagcctgaagctaatttgccctaattagatgagaaatactcttcaagcaatcccccaagaccagagtgactaaagatatttgattaggcaaagcaggaaccagcactaaaactagcagtgagattaatcctacagaaactttatggattgatgctcaggagctgtttgagggtacaccaagcatctttttaaaatatatctactgctgctactgttactgcttatggctaacactgagtgttgagtacataatatacactgccctagggctttacgtgcatctttccatttaatccttacacaattctatacagctccatatcctcattattacccctgttttacacataagaaaacaatctagaaagttaaaaaactttccaattttttcacaaaggaagtaagttacagggctatgattcaaacacagttttatttctaaagcttacattttaaattactacttaatattccctgattcactgatgactaaagaaatacaatctagaaactttggaaatatgactacttgttggcctaatgtggctaatgacaagatggaaaagaaaaatataaaatctggcatcatattcaaataatttaaccaaaggtcctcattagtgctgctctcaaaagctgagccttgcttttattttctaatgaaaaatgtttctagaaacatatatgctaattttccaattaaggttagccctggagctaaagtattaacattttccataagttataaactcttagaaaaaaaaccaacactatttactatgaatacattgtaagttaaaaatggatgcttactgttaatccttactgaaagtataactaataatctgttgtttctgaaaaaagacaacctaatcccaacaaaaaataacccatgtcacatgtttgcaagcgataattgccaggttcttgggttgacagaattccatattttctttctttttttaactgaaaaaatttccagttcatttaataaatatatatggggtgaaaaaagaaataggcaaaatagataatccttttccaagtgctataccccccaatttttttaaaggaatgtgacaaaggtcaaggaaatcacgagcatatgagaagaaaaaattatgtaaatgatctaaactgaatatttaacaatctacctgttgaacaagcccctaagatttggcctttgacttttctctatttaggcatcattaagttcaaattctatgattcatttgacattaatagttaaggttcttgtttctctctctctctcgtctttcacttttctgagacgtcactcacttgctgtcccaagaaagagttgtgaatatgcctcagatttcagaactttccatgagaaagtacgttgataaggaaactcaaattccagagtgggcaactgctttgtacctctactccagatatgcttgttttataaagcctgcgtatctttttaggatggaacagaattctttcactgagagattaactgtaaaaaccaggtggcttcccaggaagatatcatggctaatctttacctctcccttaccttttataaacagtatttagtacagaaagaaaaacatggcaatatcagctcttaaaactacagcaccatatcagcctcaatagggaagcatgaacactaagattcctcgagtaaactttacatgcttcagtagaatagaaacagactactcaaaagtgaactagtcactgaactggaaagtgtgtagggtcatactcaggaaaattattataaagcccattgagtccagacagccagtgaattattgccaaaattaaactgtatgatgcctctatcaaccgattcaactagacttcagcagatgtctgaacattggaattacagttttcagtgccatgagagatattaatctatattagatatgatccctaacctcaaggaatttgcatctgataagatataaaaagcattaagaacaaattctaacaaaagaaaggaaatacagagataaatgtcccatcaaagtataaaatgtggaagttatttggggctgcagaaattgggaaaatgtttactgggtcctaaatgatgggagaaatttggatatctatgatagtgaggaagtaaaagaaattagaggagggaataacaaccactttctcccatcatctaccttgtggacataaaatagtcctctccttatagttaccaatagcggccctttcatttttcttccttagagatcaccacccccaactcatgtttctcaataactcctgacacagcttttcaatataaaatcagtatcgtcatctcacaatcttaacattgtctgcttgcaccaaggcaatactttaagggagaaattcccaatggtgcagaggacatgcatcaatcaagcagtctctctttcatttttgttgttggtgttatcactgtaataaagccatcacaaacaaggtgataggctgccccggttttcaaagaattatgctttttatattatgttggaacactgtagtatggcacatccttaattgcaacagcaaataggagaagcaatattgattaaagaaatgaatattgaactagaagttgctttttcttaacctgcctcacaatgctgagtgacctcattttagtcacatgacttctctgtttcccaggcatacttttgtcactcagcaataatagagttattgcaaggctcaaatgtgacagtttatgtgaaagcacatgggaaaatatgagaagcattccaatggaaaggttttattgcacataaggccaagagcagtatggtattatgaaaagctcatggttgtggacgtgaagacctagatttcaactctagttctattagtcaccagagtgggcttatttaagtcaagcacctcactaagcctcagctcttcatcaatatctactggttcatttccatccctcctcacagagttgcggtgaaattaaatacaaatctaaaagtccttcagaaacaacaaaaactaaaagtacactgtattatttgcactagcacagccattaatattgttaccatgattctcatggttacagctactctgataagaacttataatattacttatttattagaatatagactgactaaaataagcgtctttatcactatttcagcttcaaatataattggtacaggttaaggccctgtttaaacaaaaaactgtgttcgcacaatttgactttagtttatcctttagttaaaaaaaattctcatttagttcataaactacctaattcagatttggacaataaatagtctaagtttataaaaagtaaacaaatcatcgctatagtttgaaaaaaataaaccttttaaaaacattataaccaatattaaccactaaaatgccagcgataagtgtgctaagcacatcaaactattcattaaaaaaggtccaatgtttgcctagttatgcgttctagacatgtttcaaattatacaaattgctttttttgaggaagggttttgctctattgcccaggctggagttcagtggcacaaacgtggcttactgcagcctcgatgtcctaagctgaagcaatcctctcacctcagcctcctatgtagctgggaacagaggtgcatgctaccatccccagctaatttttaaattttttgtagagacagattctcacctcttgtccaggttcaaactgcattatttttaagtgctattctcctagatgcgaatgtcaaggctcctaagttatacaaagcagtaagttatatttttatttcccaagtgctgatatgccagatattacacccataaatttcttttctttcattattttcttcttctgagctggggtaagaaaatagacggtagtcagatgagtgagggcgtgggactggaagcagagtcacaggtacgtatttatggactatggcattcacttcacttggacattggacacataaagaacttgtccaaaaagaggtgcagccattgcccttggtttctggaaggtaatttgtgttttcctgagagccttcggctaaatagagaataacactatgatttagggtaggggctttgggtcacacaatatctgtggagtcagaggctgggatcaagcacatgcgcaatgaatgaatcctgcctacgtaacagacgccaatgacatctcttgacatagaggctcaggtgagcttcctgcttggcgacacttcatgtgtattatcacatgttggtacctgaagagtaacatgtcctgactcaacaggaagacgacaatagaagctcagtatttggtacttctactgaatcctgctttaggtatttcttcccatggcagattttaatctgtccctctctcaaagataaactgtaaccgtgagtataaccatggttttcagtgaggtctgtgagtccttctggaaagttatcaatctaaagatgattctgtgaggccataaacttgcagttggtgccagaagtgagggtggtcttgaggactatgccctctaacttagtagttggcctaaactccttatgacagctaactaattatgattataagagcaaactataacaagataagaattgtatctatttcattcatctttatatgctcagtatgcagtctggtgcctgagatgtggtagactttcaatcagtatgtattgaacaaattttaggtttactgagattgctttgaggacaaaccagcatttgtgcagtggtttgtaagactaccaattaaactttgatcaatgtaatcatagttaattgtgcaacaattgtatgaaatttgttccgtctatacttgaaataggcaattcttcaaaattcaacaagtctttactgagaatcttcctttaccagggaatgtgtttaatgctgtggttgggccaaatatgtggcccagatggcccagatagcaaagatgaatacgatgtaattcctgcccaccagcaaaataaaagtcaagtgctcagatattacagcagaagtagcatctaattctcatagaggatggacaatggagacaggtgacatatcaggtaagatttgagctgagctttaaggaaaattatgaattacataggtacagaagagaaaaaggcaaatataacagtatcagtgatagcactttagtaagtcttatttttactctttacatattttatcacatgtatcattctatcaagttacctaaaatattatatcactagtgttctaaccacaatttgaaaatctagctttataatatcataccaaatgatgtttatctacatttgctttatttatacaaggttcagttcaaacaactcaaatataaaaagatgtgagtcaatttacagaggatggtcgagggcttacttgggttttgtctttcctgtataaaatgaaaatatacctctccttcaccactcccaaccgaaatgcctttaagcactgtgatcatttgagaaaatttaggtggtcttacaagttttgtcaaaaacttttaaaactcaaaaagaataaaacattaaaggatattacattttaaatcaaaactggttaaacagcaaaatttttaaaaggcactgtctatgtataaggtaaaatttgtagaaaaatctgtttcaacagattgtaacacagaatggtatttcctgaactatcgaaaaaggtgtttcagaaacataagtttccaacatgcttaaccttcttttgtttgagaaagagatgcattaagaactttttatttactctattttttaaatgttatttaataccattaaaattattttggtcttcctttctaaaaggcactgtgagattaaatttaatcaaggagttgaaaaacttgtatactgaaaactactaaacattgtcaaaagaaatcccatgtttatgaatcagaaaacctaatattcttcaaatgtccatactaccggagacaatctacatattcaatacaattcctatcaaaatctcaatgtcgttttttgcactaatagaaaactccattccaaaatttatataaaatctcaaggaacctcaaatagccaaaaccatcttaagaaaaaataaataaataaagctgtaggtcgcacaccttctgacttcaaaatgtagtggaaaactatggtaatcgaacagtatggtactggcacaaagagacacaaacaccaatggaacacaatagagaggcccagaaataaaccctttaatatgtggtcaaatcatcttcaacaagattacacaatggagaaaggttagcctctcaacaagtggtgttggaaaaactgtatatccacatgcaaaagaatgaaactggacccttaccttacaccacatgtaacattaattcaaaatggattacaaatctctgcataagaggaggctgaggcaggagaatcgcttgaacccaggaggtggagattgcagtgagctgagatcacaccactgcactccagcctggcaacaaagcaagactccatctcaagaaacaaaaaacaaaacaacaacaaacaaacaaacaaacaaaaaacctcctagaataaacataggaaaaaaccttcatgacactggatttggcaactatatcttggatatgacaccaaaacaataagcagcaaaagcaaaaatagacaaataggactacatgcaactttaaaaattctatgtatcaacagaaacaactaacagagtgagaaggtagcctacagaatgggagaaaatatttgcaaatcatatatctgataagggctttaatagccagaatctataaagaactcctacaactcagtaacaacaacaacacaaaacaactcaattaaaaagtaggcaaaggaattgaatagacatgtcaccaaagaagatttacaaatgactagcaggtatgttaaaagatgcccattactactagttattagagaaatgcaaatcaaaacaaaatgggttatcatctcacacctgttaggatggccactatcaaaagaaacaaaaagtatcaagtgttagcaaggatgtgaagaaattggaactttcgtgcactgttggtgggaaggtaaaatgatgctgctgatagggaaaacagtatggagttttctcaaaaaaaaaaaaaaaaaaaaacaaaaacaaaaacagaattaccatataatccaacaagatcttgacatttgtacgctcatgttcattgcagcagtaatctcatatccaagaggccaaagtaacctaaatgtccatcagtagatgaatagataaacagaatgcagaatgcgtataacatacaatggaatatttttaaacattaaaaagaaggaaatcctgtcatattctacaacacagatgaatgttgagaacattacgctaagtgaaataagccagttacaaaatgcacaaatactgcattttcccgcctatatgagatatctaaagtagtcaacctctttgtaactataagtaaaaaatagtggttgctaggggctgggggaggagaggaaagagagctattgttcaatgggtatacagaattttagttttccaggatggaataaagggtctgtagagattacctacaagggaaagaatattaaactgatgagaaacttctcataattaacaacagataccagaaaccaatgtaatattattttccaaatgctgagaaaaatattggtctactcagaattgtataactaccttaactgcaattcaagaatgaaagtgaaaggaagacattttcatggaaaccaaaagcaagttcaccatccgcacaccttcacacacaaaacaattaaaggtttagtttagaagaaaagtgaaatcagagaccaaatttgatatacacacacaaacaaaagttctatgcataaaattattcaaaacattcattaatttaacgattagctataacataactaattgtgcatatgattttattttaaagtgcaactaatcaaactggcagcaagaaaggttgtgatatttactagcaagaaaacactgtaacctccataagctgttggaaaggaagacagaaacactaaaaaatatttagcaaagtatgtcgtgatttatgtatgattaaaaaaaataagactaaccactacaggaataaaaatacagcctgaggttacaaacttgcagaagaatttaataaaataaaaaaatgtgaataaagcaacagaattttttaaaaaagaaaagagaaacaaaaggaaatttaaaaaaatacaaactattatggtaaaaacatatccagatacatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatactgcttgtgaatcttttgggttctaaattagcttatgtaggtcctcttagtttgcttcagcactctcctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagataccccaataggtttacaaaggtaaactccattacaaaagaaactccctcttttggctcaagattcccaccccctcgtaacctcagaactaagcaagaaggacagaaggaatgcatctctgaaaagcttcagaggatgaaaccacaacccagcaatccctccaaactccctccttcccttatacaattgtctcctgcttacaatactgttgtcaaactttctgtgtttttcttcttcatggacctttggggatcaattctagtctaataaactgaactctatagcttctgtggaattataacctgaattatgactttttaaatatacataatatagtctacatttagctgcttatttaatgactgattaaatctttaaagtaagactaactagaaatattcaaaataacatcctcttgccttttttaattttaattcttacatttaaaatagactcacaataactggacattaagaattgttagagctgtgacacactaagagagcccattattttgactgaaaatgtatttaattgttattttaagcagaaactttgaaaaaaggtatatgtacacatatagcatatttatagtgtaaatacaaaatatagtgtatattttgatctgaatattttcaggagtaaaaaaaataattgtaatacaaatgacagatgtattactaataagcaagtatgatgtacctgttggagctaaaggaaaattttcccttcactctctgtagcttaagtgaaaatcgatggacaaaaggctgattaagaggagaaaagaaatacaaatttattaatgtgcactggggagaattacagggtgattaccccaccatgcgaaatgtggtacacatggttatatacccttctttttagaggaaagggagatggggatgtgtggatgattttacagcgacagcaaatgattttgggggggagttcaatgaacttaaagaacatacaatgagctgggacaaagtcttttgggtctgcagagtaaaccatggtttgtgacaaaatgctgtctaggtgtattgatggacttctgtctttcttcctgtgatacgagttcagttaatgaaaactcagggaagagaccaaaggtaattgttttcttctttggcaggtccgagcttaggcagataagggaactccagagaacaacttcatcctgtgctttgggagagacaggattaagacacaggaggcagacggagttcagaggagacttgaggctgcttcttctgtgcagcatgtaaaaacaccatatttgagagtatcaatttctgagctccaaggtaccagagttttgtttaattgaacattggaagagcctaatgaaaattagtcaataactaatttagaatccagcagacatatggaaacttccaaaataaccttgtgctatttactgagatcataaaaagtaagggtggaaatctgtaatcatgattttcaaggaatttttttcatgaactacaaatagccaactctcttacaagaaagcggaaatacacacatatacacacacaccccattcagtgcagccacattctctcaacgcataaattattatcctgagagtgagacaagcatcataattgtgtttgctactttaaaatatgtcagtgctgataatgtagccactgatggctacctaattttgccagtttgggatttgaaagacatgatacaacattgtgtccaacatgctcatttgaaaagtccaaaattaagccaatgaaggtagataatttgcccaaagggatatcaagatagtaaatgaaatgcaaataaaactcaaatatccttgctcgtaatccagagctcattccataaattcatattgcctttaaattaaagttattctgagaatctgacatattagataaaacatagacctactaaatacaaacaaagccacaatctttcacaaattatgaacgtttttttctccatggtaggacagagactatttccagacaaattgaagaattttcctccctgagccatcctccatgcttaaaggagagataacaagagaaaagaaaaatgtcttgctctttgaattaaacagaaaggtaaaattccaaaaggagagtatcctgcagaaatggaagctagacacaaagaatttatatcgcatggagagtaactgcaatatactcattcaacaagacatggtccttaacactctaaattacaaaacctcaaaataatcccgaaaaacaggatcacaaaatataaaatgacttcaacttccaattttcttgcctaacatgatggttactccattacctctcagtggtagttcacacacatacacacaaatacacactacaatgtacttactgaactgtagagatagccttcaccattcatggccacatagaggctagccttcactccttggatggccactacacgcaggcccacgggaattagattgaagagagctggggggagaaaaagaagggcggaaaggatcagtgaccttttgaataaataatccttcttataatcattcttttgagaattaaaacctattaattgaacttggtagaaaaatggagagagaaataaagagaggtctaaaaacgagagaaattgacttcttgaccctgcaccagcattaattacctatgtaacttcaggtaaattacataaactctgtactaaaggggttggattagaaggtctctaaaggcccagctggatctgagatttcaggatccctgatccttaaaatgatcctcaaacagtgtaatataagataattttttctaacaaacaaataatatggaccgaaaaattctcaacaggagaaaacctatctgtagtcacaagaaataacaaaatactatctttaaaacaggccaaagcttcttgtttttagtattttccttgttgttccaaacattatattgaacacagaagaagaatgcaaaaattactgacttattggtgataacattcagacaaaacttttttcttgatatctcaattttttacatgtaaataaacagagataaacagatggacagatgattgatagatagcttaagctgtaatggatatattttatatccaggtgggaaatacacacacacacacacacacacacacacatatacacacatatatacatactatatatatacaaatatatatacacatatatatatgcacacacacacacatatactcaaaaccattaagaattaatttgacaaaagtaattcaacatcctaagatgaaatggaaacatgcttgcagtctttacatattcgagttgctcatcactcaaaatactcaatagtctatatgtccacttagagaaggaattcgtagatcagaaaaaaagatacctaagagaaccttctatttttcttccaacaatatttttctgtccttgggattatttcagttacttttgagatcacgaaatgagcataaacagaaaacactgcccccaccctgaaacaattcacattgcatatggaagaaaagcaatcatatagttaggctctatagatggcaacatggagatgaattaagtatctcacggctgtatgcataagagaatatctctgcagttcatttcagtatcctggcttaattagaagttcttatccactttttctgttgataaaattcctatcagttctcgtcttcttagtttttaatacaagatacacataaattaacccaagggctaccattatttagggatgcctctatttttctcggcttctctcaacctacaatagtaagctaaacacacacacatgcagacacacacactcacagtatttggctttcagtcaaatgttcaattgacagttgtagaggatcaagtcttagaccacaagtttagtagaacaggattccattcttagctgtcgacatcggatcagtccttttgcctctttgaatccatttccacattttttacgaaaactgagactagataagaaactgtaagtagtttcttatagattaattgttggctcaatttagatttgaactggttttatttcttgctatattcttaccagtgtccttgtgttactgaaacaacttaagaaatacaagaactagacaaagtctagttggggagaaaaagctaagacatatggaataatatgatacagtgtataatttacttctataattaaatgtaatatatgcattctatatatatattccctatgttacagaagttcaggaaaatggaagctctgtgtggcctgaagtattcatggaatgccttacacagaaaatggaacctgagttgacacctaaagaagcggaagttgagaaagccaagaacagaaaacattttagtgaggtggaagttaggtggttttgcagagtaatgtgtgtatgcagaaagggactggcagattggtggatttgatttatattggggggaaatgagaaagaacagcatgtaaataaaataaggataaataaccgagtctgtcactctaatcttagatatctggactttaccaaataggcaacaagacgtgtgacatatgaaaactagagcaacaacacagattatgagatttgcagacacatagtttctaaaccctccactcagtcacttggctttgagctattcatttaacttctctgccttagttttcctatctgtaaaatggacatgataatgcttattgcacagagttgatagaaccaaatgcattgtcatgtttctgaaagtgattcacagagatgtatcctctctaagagctatttgtcatgaatacctaattcttctgtttgtcagataaagttaccataagactattgtaaaaactgacatattacctcagtaatattttttagtttatattcagcagattgctttaaagctttaaaatctaataccttatatttgtgcaagattaattttcaaagtgctgatacattcattaattgtatttgatcctcaaccataaatgctatgaagaatttaggacagaatgattaccttaatttatagaagtacaaaaagatttagagttaacccaggggaaaatgcatctaaacaaaggctttcaggctccctaatgtggttacctgttcaaaacatcatatttcatctttttgttctttatttttcttttttgacagagtctagctctgtcatccagctggagtgcaagcaattctcctgcctcagcctccagagtagctgctattataggcgcctgccaccacaacccagctaatttttgtatttttagtagagacggggtttcactgtgttggccaggctggtctcgaactcctgaccttgtgatccacctgtctcggcctcccctttttgttcttttaatttcctctaatatccatttttgccttcttgcaaataaatagattattcagctacaccttctaacatatcctgcaaccagatgtaggtcctatggacccactactggccaatgagatgtaagtcatcacatcattataagcttgaggaatccttccttaaagacagcataaaggtgtcctttgtgccccttctcaacctttgcctattgctgtttgaatggggatatggtagctggatcatctcaaaccaaaaaaacaaggactactccccagcgggtgttggcaggtgagctggaaggagctgggtccctgagagctttgtggagcagtggcacaagtccaacattcaattacccaggtctggcttttacgtgagaaaataagtccttgttctcttagtctgtgcgatgcagagccaactctaatcctaactgatagagatgctaatgaaagcagaattaatatgcaagatatgaactagatgcaaggtacttcattttaaataaaagcagatactggaaaacgattaagttcactgataattactgtgagaaggagaaaagacttcccaggataaatgctaagaacactggtttatgtagctgaccatagaaggaaaagcaactataaagtttttcctacatggaatgagagaaaactgataatgctaggcagggacaaaaacaagaaacctgtttgaaagttttatatgaaccacaacatgataatggcctttagctggtttgctttgtgagacttactaagcccatttttaaaaatcagtaaacgatttgaaacgagactttattggtaaaagctaaacatagtttctctggaaaggtcctcatctgcctcctaaaagtcccaaaaggtggcaaatgacttactgttatctattaattatcttcagagtagcatactgtggctccagctcacaggagccctttgctactcctttcactactcctcaaagccactgtcctaactcatagtaactgggctgcttgactccacccactctttaagtcccttgcatcctcttaagccattttcctgcttacaacctgcagtgattcctccctgtctccaatgtcctttacaacctggctccaacccacatttccagcttatcacctgtcaccctttccatctgctgtaaccggcttcacagagctttttgccatttcctaagttccccctcgatctttaactaggctggagtttgtcctcttttgtcctctatctctttttggaaagcttatcttcccacttctaaatttggccaactcttttcatcatttaaggcctaccttgttgaactcccccatgaatcttgcccaaaacccttcagaaataatacttcccttttccagatggcttatttcttgtgtatatttcggtaatgatatttagaacatggttttagagttctttgtttatatctctgtctccatccctacaatgcaagactcttgagggtagttgctgtaatgtctagcccaggtacatgtacacagctttattaaataaatgttattatatgggttatgacaaaaacacgttatttccaggaatgtaggttttcttgttagaatgaaagttctttttaagataaaaatgaaattagaaacttaaagcatctcagcctgatactcaaagttaatctacaacatacatttgtgctacatggcactttcactccaatactgagtgcttctagtaatttgatcttcctcctcctaccttctaaactccatctttttgctaacttagctccctctgcttggaatgtcactctccctacatcttcacactgaaatccctgacatgcgtgaaatgacacaccaaatgccaagtgctttctttcacttcttagctgccctattcctggatccagactatatttatcacaatttatagttttattcttctaaaaaatctgtttcctctgccaaccacaaccagattgtaagctctccaaaacaaaactcacatcaaaactacacttgtataatacaaggaagggaggagacagatagagacagagaaaacaagagggagaatatgcagggtagtatatattctgtgtatattagcaatcccagtaaacatttgcagactaaataatactacaattatatgccaaatagagtccaagtatttaatctgacattcaaagatcttcttaaacttgtcctttccaaaaggagtatcttgttctacatctttttgtaaagttgactcttgtattttgaaaaatgaaataatggagctggtactcttggcttccataaaccaagctcattcataaaacttcacagaaaaaaggtaatggaaaaggtaatgaagagaaagtatagtctcttcaacaaatgatgctgaaaaaactgggtattcacacatgaaagaatgaaattgggcccttatgttataccatacataaaattcattcaaaatggattaaataattaaatgtgagacctaaaactgtaaaacccataggaaaaaaacataggggaaaaagtcaacattggccttagcaatgatttatttcttggataacgaaaagcacaggcaaatgaaagcaaaaactagacaagtgggattacattaaactaaaaagcttctgcagagcaaaggaaacaatcaacagaatgaaaaggcaacttatggaatgggagaaaatatttgcaaattgtatatctggtgggggttcaatatccagaatacataagaaactcctatgactcaaaaggaaaaacaaaacaaataagccaattaaaaaatggacacagggcttgaacagacatttctcaagaacaacaaacaaatggccaacaggtatatgaaaatatactcaacatcactaatcatcagataattatgagctgttaacctaaaataaacacttccaagttataaaatattaaaggatcactttgattaatcatgctacaggaaagactgaattatatttctctctacaagaaatgtataataaaattgttgtcatatggaaagacattcaaaaattatatatccataataatgggaaggaaatttatagacttgctgctatcaggcaattaattaaaatgttgtattattttcctgagttgtatcatctttgatagttctcagcttttcaaaatttaaactgttgtggtatattttctcagtctaaatactcaattttgcatctaattttcatttcattatatttattttttcgagggagaaccccacataagataagctttaggacctacaaaacctaaatcattctcatattgaaatttaagtggaaggagaagatgagagaaagtaacaaatgagaaaagaaaaactaaatagataatattcattgactgtctattttttcaggcatcctgctaggtaggcattttgatatgcgaaatgtcattttattataaactcagtatttgactacttaaaatagcttcattgaacagtatataaaagtcctaacttctttgaggggtacaaagtgaaaaaaattgagaaaatgtaaagcaccatcctaacatttggagttaacatacagcacttgtaaaaacctgacttagaagtcatttattcttaccataaatatttgttaggacttactgtatgccaaataccatgcctaggctaaaaaaagagtgacgaacataacagttgtggtctctagtgaaaagacttttatctgtgaatctttccgaggtttccactactttaagggcaagttgaaggtaccagaaacttttattatgatccccaatgcctagcatgatatcttggttttagaagctgttattcaatatctgctgaataaataaatgaattaggagtagtttctccttacacatgtttattcataacttttctcagtcatatttttataattaagcatgtaagaaaaaaatggaagataatatgtattacacatagactaaaggaaagccaaaaaacctacatggtacaaagtctgaaatggcagaatcatgggatgcataggcctggtaagggtaggagtatgtgtgtgtgtagagtgatgcaaggttggagggaattaagaggaaggaaagagtttggggaatctgttacaattgagatattaaacatcttgtcagcaaggcgtggtggctcatgcctgtaatctcagcactttgggaggctaaggcaggagaatcacttgagcccaggagtttgcgactagcctgggaaacacagggagactccatctctgtaaaaataaaaacaaaaataatttagtcaggtatgtgtgtgtgcctgtggtcccagctacttgggaggctgaggtcggaggatagcctgcacccaggaattcaaggctgcagttaagccatgattgcaccactccactcctgcctgggtaacggggcagggcatgcctctgtctcaacaaaataaaataaaaaataaacatcctgtccaatgatactgcaccaaaaaatgtactttctaaaagtgctatgttttactcagcttaatttctacctgtacacaccatattattccagtaagaaaaaggtaacagtcaatccaaaacacataggaaaacaatgtgacaaccaagaaagtttcaaagaaagagaagaagaggaagagagggagagagggagagagggaggaagaagggagggaaggaaggagaaaaaaaagctcattacaaattgtctttggaacatgtaaatccagtatctttccaagtaacttctaaggacagactcattgcttgtaacgaagaaaggtataaaagagtacagttgtatttagaaattctagatctattttgtcaaatggccaataaaaaagattcatcctgtgacccattaaaaacccatgtggaacatactgagagagaatggagatatttgggtttataatctgtgcattttcaatgttagatttccttgaaaattcaatatcatttcccacatctcaaaatgttctcaatcaagatattttattagagtgtgaataagatcatatcctacaaaatcttaaataaaaagttaagttagtaccaggttattttctcctacaataaatcctatagtctctcacaataatatctataattataatattcataatatttgcaggccactcaattggtttttcctcagttatgaaattaatatttacttctgttatttataatttacttaagtcaattattcaccctccccattctcaacaggaaaatgctattattgaatatacagcaaaggagtgagctcttaaatcttccaatacaaaagtggttatataaattatggtacaatggaatgttcacccaggcaaattaattattcattcccttaccctaattccacagcattccatacatagcacttatcacagtgcttattaatatttatatgtttgtctgagtttccctgaaaactagggattcatagaatataacatgtttttgttgttgttttgcatccagattgcatttcaaaataaagcctaaacaattgttgttactgaatttaaccctctaaaacagcatttcttacagacattaaaggaaagatgtaacttgccgtattcttttagcttttaagtcaaggaaataagtggtcttggtgactccaagtaatttaatgaggttgcaattttttgaatttctgcaatcagaccttggcgatgactttgagcagtaggatataaataactcccacatgcgtagtgttccaataatggaacactaggcataaatgagttaaccactttgagtatttcttggctctgaatgcttcactggattgttatgaagatcaatgagataataaaaacaagccactttttaaaccataaaggatacaaagcatcactatcagtgttgtcagtgtttttgttctcattgttgttttcatatctccacatctggagttttcatagtaggaggaacatggctgggtggtcattattccatagttcaacttaaattttttaaaatgttatgggagaaaaaaaaaagcatgtattccatcttctattattgaagttcccataagcaaaacaactatgtggttaaaataaaacactgttaagaatgtaaacatcaacatactttaagttatattggttcactgctttaagtatgatgtcctattttataagcaattggccaaatagtccaactgactgatttattttctcactgaatttatcgacttacagagctgactagtggtttgggacttcagagactaaaatttttcttctaagcattggctgacagcatacactgtgggttttcagcataacaaaaatgagcagcattgtgatctctttatttgataaggtagtagaaatatttgccttagctctggtaaaagtcctgtcattgacttttaatcctgataatatcatataacctttcctatgatagttcaaaaatgttcaaaaatttgcataattaacaagtcaattaaacgtgattattttttcattaagatgaaaaatgaggcatatcactattgataatgaaagcaaatgcctgtcattactcattctctggagccatttgtcttacacagacttgtcttggagcccgtctggtctgaagaattcagtgaacagcacaggtgacggtccataagatcaatgggcagaaacatcttccaagaaatctttgcatgttttgaagcttttagatttgcatcctctataaacctttcatcaaaaactatgttgccaaaatcaatactatggcctactaggtttattcattaattcatcacatatattccagacattgtgccaggcacttgcaatacagtggtagaaaggacagagatggtacctgccatcatagtagttaaagtctaaaatagataaaagtaaccacatgtgtaatatgtatccatctttacagaccaggaaactgatactcaaagatactgttttcccaaggttataaagtcagctagtgaaaaagctaagctgtgaacctagattctggtggctacaaagctgtaaaatattgttgctcttaagatataacataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaaagatataacataaaattctaatgataacaattcaagtagttgtgaagaaagtaggaaaaacagactataataagaaaatgtgaaaaccttacaaggaatgttttagccaagtagaaccatcctgctcaaaaggtaaaaaatctttagtttttcttagataaaattacacacaggcaacacaagcacacttatttgagttgatttagatatgctcaaagctttgcacgttgttatcattaatacctaaataagaaaatatgactgcctaattccaaaaatattaagtggatctatagaaataaacataatgtggaaagattttttttttttagaaattagggataaaaaaggacttgaaaaataaaatgattattttgtccttactattctctacttcaaaatctctcattcaatccatgtctactataaactccagttagaaaatttttctaaagtattgcattttactcattgctcaataactttcattggttccccatttcctacaacataaagcttacactcccttaagtgtcagttaagacactctaaaatatggccccatgatacttccaaataatctctttgcttcatgcaagctagtgggttaatttttcccttacatggtgggagctttctccacttcctgattttgtgcctccttacctgaaatacaactgtcctaatcttaatttatttattttgttcccattcttcaagaattgggttaaaaccaaacttgttgatcactatggcttttgaggatctgttagatctctgaaatctggtgattcttctaatcacttggtagtaccagtgacaccttttgttttacattaaaatgtaaaaccttttatgctctgggaaaagctagaaggcaggaattgtatcagattcatttttgtaatccagtaactagaacgcagttggccttcaatatgttggtattaatgaaaataaagcatgcatatggcaggcatatgtgaaaactcaatcattttgtggtagctgcctgaaacaatgtcttaaggagacatttgaagccaggcaacaatgaatgttgtgagaatttagtgatgtctgcagtgaacacaggaaggggtacttcagccattgatttgtcatttcccacttgagggcctccttttataataaaatagcatgaaacattccataaaaacagcgatgatttgcaccgtactttaaaatcaatatcttattgtataactttgactcaaagttataataatacaaatttggaatgcaaactttaaaaattgaagaaaaaaaccaactctccagaggtaatttagcttaatggttcacagactttgctgcatattaaaaccttctgaaaagtttgaaaattctgatgtccagactacactcataataattaaataaaattgcctggaattgaagacaagtactttttaactccccagattattccagtatgcttcattgttgaaaacaatttaatattcaatagtctgggatagttctagcaagctcacatgcgatactgattcttcccaaatcttaccagtcaatgaaccaaaccttgctgctcaaagtgtgaacagcatcaccatcatctggagcttgttggaaaggcagaatctcaggctgtatccaagaattattgaatcaaaatttgcattttaacacaattacaatgcagttaaagttttgagaagtgctgtgtgcttggttctcaaagtgtggtcctcctgcagacttcctgattcaaaaacaaagattttggagccattgttgagaacctggatctatgaggagcggctgctgtcttcctttacgtctcagtagggcttttctgcccagatcatcagtgtcaaagactgggaagagaccatatgtaactgtatattccaaccccttcagagggaaactccaagtgcactagatgttaatcttatctaaattagacttcgatcaattcttccaaagaaaagaaggttggtctaaggcctaaaagagtgctgaaactacagatgtggttcaaaaatggcttcttacccaatttgtcaaagctctgctcaagtccttcattttttctgaaatggctcttgatcactcttcagtcagcattgatttcccctgttgagactttccaaggcacttccttccataagagtacattttgatattattaacttaaatctcctacatattattcccattttgcggatgaggaactctggtttcaaagtgttaaactaattgcccaagtttatccagctggcaagtggagatactcatattaatatccatgattgtctgtccctaaaatcaaatggactatttataacactatcctgcttcctcaagtatgggaaatgatccctggtatatactatagaaacaataaaagtgatgttttctgctcgtacctaagtaggaaggagcaaggagttctctttaggatatttgtaaaaattcaactgtaatactgtggagtgggcttaataatgctgtgcatacatagtctcacataggtatgtgttccagattcggtctcaatgtcaagggaagcagatgtactaagtgcaacctcgctagatcttggctggatgcctgttcagtaccactctatctaggctgctgaataatacatgaaaatatatatccacataaagacacacacatcctacacacctcaaacttctcaaatcagatatatgaaataggcaaccaggttatttaaaatctttaaaattattgtataatggtttattatctctaaaaaatgttttaatatatattttaaatacgtcaaacacattgaagaaaaatccttgcaagttcactgtttagcctgtctaaagtaaacctccataatattttagaactaaaccacgttgccttcttaatgccttttgaaagtgttgtcagaagaatgcagaggtatgatttaagagattgtttattatacactgggaaatattaaccaggaaagataaattcgagatacagtgtaaactgggtgaaggtattaacattggaactaaacttgctgaattcaaatcctgggtctattatttaatatctttaaggccatggactaattatttaaccttcctgtgcctcaatttactcatcttcaaaatagaaatgattacagtaccttttatagggttatcacaagacttaactgagtacaattttgaaaattttcatagctgtactgaacatttagaaggtgttcagtaaacagttactattatctgatatgtccccaagtcatagattaagaaataatgcttgacacgtaggtgaccattttattttccaaatccttcattccaaatatgtagttcttctttatgcttcatggtagtatgccctagaaaatgctaatccatatgagtatacatttataatttataccttatttagctggtggctaaaaacagtgcttaatcaaaccagagacatataagaaactacactgcaattcattaagaatatggacaaatctatacaaccttgcaatcagtaacttatgttgaagacggagcacaggatatggatatagtagaaatgaattctacttactgtacttagagcaaatcaactctcacttcagagcctcaaagtaaggtaatgaatttcaggaattttaaagtgatctctaattctcactcatcaaaattttaatacccttttccactacttcaagaaaccctctctttttagtttcttattcttaaaacacctgagtgtgtattttctttttcctgcaacatatgtttaaatttatactgctgcccttagatgaataataaaagcaatgactctctctcttatgggcaaatataccatttgcttattttaagaaaatgatgtctctataattgtcaacatgaatatatatattcatgtaacactttgagaatatatgtaacactgcgaaagtgtcttcttttactattattgctatagaattcacttttccagactaagcatactcaattttcttcctattttcaaaatggaaataatttccttactcatcccttgaattctcttaaatcatctgtcattctcaagacaaaatgcaagcatggtcccattagcattaatttttcaagctgggcattgtcacgcaaagtcatattcatttttgatggggttgttctgtgaattcactttcattcatttattcaacaaatactgaatacctaatatgtgccaggtattcttttaggtgctggagacatagcagtacaaaatgcagataaagctcattgcccccatgaagcttatattctaattaaatcttttggtttcaatggtataatgattatactattgctactatcaatgaacttatccatatccattatcaaggcgttactcattattaagaatttattacaggccaacacagagataaagcaggtattgtcaatgcccttaagtagttcataaccaaaaagaagtcagccagtcatatacacaataaatacatacagatgaaacagcataaaatcataagagatgtacagtttgttcagagaaaaagtagaatgtacagttaaatcagaaacaggcttcaaagacaaaaggcttttagaggatggcataattagtgaaagaaataacataagcaagtataggatagaataaaaaaagtatggtatatataagtaatattttagtagtaagaagacataataaaacaagtaggtatattagatagtggtaagggttctaaagatgaaaacaaaattcaagtaggcaaaggagactgaaatattgaggatagggactgagatgtatatagattaactagaaaagatctttttgagaaaaggcttcccttttgagtggagtatgaagattatgagggattgagctatttagatatttggaaggacattccagaaagagggggatagctggtcccaatgccttcaggcaagaacatggttggtgtgtttgaggaacagcaagatggccagtggaaagaaagaggagagataatatgtgaggagggatgaaggagacaacgggtgagattatataaaacgttattggtcataggaaaaaggtcattggcttttaccccgaatgatatgtgatgaaagggattgagcaaagaagtgagtttatttcgttttatcttttaactgggtcactctggctgctgtgtggaaaataggctgatgcggggaagctttaagtaaagagaccagttagagagttattgcaagagtccatacaaagaggatagtagcttggactagggagtggcaataggggtattgagaattgctggaaatctgtatatgtatacactgaaagtagcagtgaattcactactgtgttccaattcaatgcaaaagctattgtactatttgctcttacaattttgccttcttttgtaatgtgtttaaaataaaaagtttcccatttttcaaaggtgaaaacaaaaatcattgtcatcttgtaggcttgcaaaatttcagatctatcagagatactggatattatcttttctaaacgcttcattttacagagtagaaaacaaaggattcattcctcagaggagaaatgaggggtgggggaagtaaaccaaggaacagaaagtttgtgggacttaaataagttcactcagctatttagagaaagaacctggactggaaaccaggctgtctgactcacagcccaagctactttgtcttacaatcggtgatatttaaggggtttgtactgttcgtttaaagttctgttctgttattttgatttaacaaacattgagtgaaagccacaggtatctcaaactgaaaagtcttcaggccctaggcaggtaggaagaaaatgtggggaaaaaagtagatgcatctgttgcttacatacaatcattcccccttcccaagcatgccagctaaatgaaacacatttgtagctctttggattttggaaaatctccattgcttggctaagcagaagggcaaataaggaagtcatactctaatagggaaaacacaaaagcagataaggaattgcagtatataatgtgacttgcgcagctgtaaacaaatgcataaccctcaaatacagcagagtgaagtgagtgagcgtggggttctgtatgggggtgacagttgagacaagatggctaaagaagacctcacatggacaaaagaaacaagagttgaggagggttttgaagggtgagagtggcttgcctcctggataagattggcaaagacatcgcaagcaaaataaatttgcatatgtaaaagctccaagacatacaaatctgtgatacaggcttacctatatcactacatatttttcatatttttttcttttttttttgtaatcctccaaacttatatttgatcatatatctgtccagaattgagccttgactctcttcaagtaattaatcaaaatgtaacagatttcacacattgtttaagatgatagaaagtttgaatttcagtgtctacagacctctgctttccctattatattaggagtcagatccccatagaaataggcttcacagtcccagaacagagattgctttcattagcaaatgtgagcacttcaaatcctgggggcagaggaaagatgccagttgtacttgctgcagtgcatcagaataatctggatggcttgtcaaaacacagattgctgggccccagcctcacagtctctgattcagcatgtctgaagtgatgctggaaaatgtgtatttctaacaagttctcagatacatagatgctgctggtctagggactagacattttatgaatcactgacttattcttcaatacccaccagtgtaaacaccttcaaattcttccatataataatagctgccactgctaagaattctatttctgttaaaatggtcactgtgtatgagctccttgaaaacaaggggtctctcatccctgttgatgaaaataatgacagcagatgacatttattaagaattactgtgttctaggtacttttaaggaatcaaaccatttaaactacacaacagccctatgatctaaatattattattattgtcatttaacaaatgaggaaatttaacagagaggggttaaataactaattcaagggcaaagaatctcaagtcagattacttggacccaaattctggttttagcatttatgtatttaactctctagatctttaaacacactttgagactatcacacagggatttgcaaactgatgatttcctgcctgctggtaacatatctttcagaacaaagggtatttagggaaatggaggctgtcaatcagtttttctgagcatacctttacttctatatcagaagtaaataaaagactatcaaaatcttagtgattcttggctcctctaatgttgtactatctgaatttgtataaatcagagaatgtttatgtgacttgcccacggccaaagcactagtcatcacacagagccaaaaacagatcaaagacaacctcagtcctcagctctttctaggaatacacttggttaaggagctccaataagatttttaaatactatgtattctgcctagaaatatgcccataaaaagtcacagagtaaataagaaagaatatcatttcaaatgactcgttttgctttactgaccagaaagatacatgggagcagaagtctttttttttttttttttttttgagatggagtctcgctctgtcacccaggctggagtgcagtggcacgatcccagctcactgcaacctctgcctcctggattcaagccattctcctgcctcagcctcccgagtagccaggactacaggcgcccgccaccacacccgcctaattttttatatttttagtagagacggggtttcactgtgttagccaggatggtctcgatcacctgaccttgtgatccgccagcctcggcctcccagagtgctgggattacaggcatgagccactgtgcccggctgggagcagaagtcttatgatcaaaaatatatataagatcaagaagaaagtgaggagccaaggctgaagaatctggaggagttatccccttatgattttatgtaagggggtaagccattcaagaaaataactagtgtttgctaaaattttccacaaatattatttggaggcactatctttaaaattaaaacacagtcaatgaaaacaaatttctaacaaatttagaacatctgtttaattttttgtagtacctgcatgcccttgtgataagaaatagatttccttcataattttcctcagctaaccatttggatcatacttctgttcatagtttagcaataaaagcttctgctgactttggctgtgtctatatacttgtgactggtggtatcaaaacatcatatgtttggtattgtatagaaaacataacgagtgactaaacttttacatttccaattggttttctgaaaatcagacacagaacattttgaaatgtttgttgttgctaaactcacagtgaatttagtacgttcataaaatctaatgaaagtgtatttgtattcataactgataagaacataaagtattagaagtctagactgagagaatcttaagaaataaattccagattaactaaatatcaaatataagaaaagaaagaatacgttacaaaaaacaaaacataggagactttttaaataattttggataaataaaggctttttaaattggaaagaaaagctgacggcagaaaagcacatttaaaataaacaaaaaagaataaagcatggcaaaaaaaaatatcggaggcaacagaattagaaaaaaaaggtaaatcacaacaaagaactgattttttaaatacagatttcctaaaaataagaaaagacatttcatagaatcagatatagacagacagttcatagaaaaggaagtaaagatcacccttaaacaagtgttcaacctaactcataatttaaaaaaaattaaaatttacattttaaggtaacaaagaaccaagttttttgtttgcttgtttgtttgtttttagttttcgagacagagtctcgctgtgtcacccaggctggaatacagtggcacaatctctgctcactgcaacctccacctccctggttcaagcaattcacgtgcctcaggcttccgagtagctggaattacaggcatgcaccaccgtgcctggctaatttttcttgtatttttagtagagacgggttttcaccatgctggccatagctggtctagagctcccagtgtcaggtgatccacccacctctgcctcccaaagtgctgggattacaggcgtcagccactgcaaccaactaaaaccaaaagtttgataacacattttgttgactagatgataaggaaacacaattttagagtaaatttgcataatggagagcaattaggtgacatctttcagaatgaagaaagcacatacccttgacccagcaattctacttctaggtaactatcctataaatacatttgcatatatgaaaaatgacttatataggaggatattctttataggattgtttgtattagcaaaatacctaataggaaattaagtatttaaattatccatttaaatatgtattatatgaaaaaatcttgcagatatacattttaagttaaaagaaggtgctgatagatcaatatagtagatagataaagacagatggatggatggatagatattgtacatgttgataagtgcatagactatatcaggaaaatatcaagaatgtgcccaggtggcaatggagggtgtgaatgaaaattgcttttgactgtgtcaatgacttccaatgaatatcataaacacacccaaggttgaacaaagtttgttttaataacactcggcaaggaggaaaaatacacaccagagcagaactggggtttcttggtaagaggatgtaagaaaagatttacaggatttgggtgtgtgtcaagtggttttaaggagggctcaaagatatgtgaatctgccccagattggatgctctaaggatgtgggtgtaattctatggctactatcttagtaattcttttctagaaggcaagaagaacagagcaaggttaaagctgtgtttggtaaagaagcagcagccacccacataatctaggacagagacatatttgttcattttgtaatttaggaaacatttttgttttcgtcgtgttcagacatgattacagggtcttgcttttatcttgacccatcatgtctcagtggctttgtctaattgcaaatgtgaaattgtctatattcaacagaaggagaccaagtcttcttgggagtgtcaagccacctgctggctgtcagggactgttttgctatttctcaactatacgcccttttgtgcctttataatttggtgccacatacttatcttacctattcaaaataatttttaaaagaatatcaggactaaatgagaccttaaaagtcactgagttctgaaaccatgcccctcccaccaccactctgcttcctcctcccacaccaagggggttttcttgtaaacctctccctttgcctcaagtgccaggacagcatctgcttcagtatctccagtctttccaccgtactaacttgtcaggcagcccattccatatcaaatgctcttaatattttattgttcagaggtaaagagaacaatacctttggttataatatctttgttgttttctccctagcgtttttgacctcttcaaatgtatcttgtcctatggtaactcaggaaacaaaataattagctttttaattttatgtaaaatattcctattaataccctccaaactgccattgtcttttttgttccagtgttccaacacagttttgtgctttttatcattacatttgcagagattcttatctgttcctgccgacaaatccatttgtgttttgtactcaattacatataattagtcttttcttcatgaacaaaagaacaggtgtctttatcaattctgtgaaatataccatggtaaggttggttagacctaatgatgtctagtgaaccaaacaacacatttctgacagatgctcatagtaacaagattcttttttcaaacaatcaactgcttctactcctacacacacaaagtagagaaagaaaagacattttaacaacttagaggtttataatttttctatgaaacaaatgagtagaatttaaatccttcttcgatattttgacttctaatccccactctgacaaagtatatgtaaaattatttgtttttatttgatattcttcattaaaatatgtggggaaagtgtcagaagaaagcacattagttgaaaaactggtaacattttaataaaagctatagcactctgtaaataatattcactagtgtcaattttctgatgttgatcagtatgttgttacgtaacatggtaccattagtagaagctgggtaaaaagtataaaggaattcacttttattactttgtaatttttctgaagtcttaaatgattttttaagttaaaaaatatgtggggccaggcacggtgactcacgcctgtaatcccagcactttgggaggccgaggcgggtggatcaccaggtcaggagatcgagaccatcctggccaacatggtgaaaccccatctctactaaaaatacaaaaattagctgggtgtggtggcatgtgcctgtaaccccagcaacttgggaggctgaggcaggagaatcacttgaaccagggagtcagagtttgtactgagccgagatcacaccactatactccagcctagtgacagagtgagactccatctcaaaaagaaaaaaaaaaatgtgggtaacagtattttagccaatgacctacagccactgaactccagcctgggcaacagagcgagattccgtctcaaaaaaaaaaacaaacaacttttctacatattgacggagacgttcatgcacctagtcattcatcattcactttgtattgagtgcttactatgtattacagaccattcattctaggttctaatgatgcatgaggcatcaatcaaaatcttttcactcatggaacatacattcttctgggaaagaagatcaaaaataaataaacagcaacaatacatatttcagaaagtgggatatgaaaatagagttccaaggtgagaagtgtaatttttaaaggactgttaaggaaggcatcttcaacacctataagacagatcttagcagcactatttgtaatggccttaacatagaaacaatgattatacacaaaaaggaaaatgaataaatatgtttgtatacattcatacagtgggatattttacaaaaatgaaagaaataaagcaaataaatatattaccatatacaaacctcacaaccataatattggggattaaagtacataaaatatatttatgataatgttctaacttataaaatattttaaaatatgcaaaacaatattatgaattaaaattttttcttaaattagatatatatgagacatacaaaattccagggagttattatatctggtaatgatgaaaagtaagattccatgagggaaaacacaacaagaaggttaaactatattgatatttttaattaattttaaagctagtggtaggtatccagataaacttgtattaatctatatattttgtacacctaaatgattttaaacacaatttattaaatttatcttaataaaatattaagatagtttatcttaataaaatattagtttaaatttgggagttcagagaatttttaaaagtacttatttgacacaatgtgtgccctatggtgtgtgtgtgtgtgtatgtgggtttgtgtgtggtatgcagaatgacattatgctaagatatatatatgcatggaggaaggtacaaatgtacacgtgggtgtagatttacactagcagttcacccagcgtcagcagagcaagcgttgtcaattattttcctagaaagagtgaaggaaggatttgtcctagcttgaccccacacttgcacttctacccttctgtctctgccccatgataaatgtcatgcatttgcaagatagttggctgggtaaaggtagcattttgtagattgaatatggctaatcgtcttacttggggattgattctatcttcatcaatttataatttttcaattttttttaaagttagatggacgatgctgacagggatgttgatatatcatcaccatctccagccattagattttatagaaattaaacctgagaactagtaatatcttggagttagtgcagataagtgacacaaataagtggttccctggttcttgcatctatatttgtagcctcactaaatcgacattcagttacagacgcaataaatgaaagtacatggagagaaaagtatcctgattcttctacactgagttgaaagctttaatcatttaaagaatgctttcacaaaaacacaagccaacaatgcaaaccaaaatcagccaatcaacaacttagcaaaaaatctgagagcaagaaaactgaaatgaaattctttataataagatcttttatttattgtaaattatattttaaatgtgtaatattaactgaacaaagaataacttagaaagggtggacaagggcattttcattcattagggattttaaatttttcctcaaatagttcttaataatttaaaagacgtttcactacaaaatatctagcttcctaaattactttatgcagtttggtagattatcagcctgatcacaaaattacatccatcagaatcacaacttgttgggacagatatcagtgagcatttattgtgtgctcaacactaaagatctagcagtgaagacagacaaacattaggaaacaatatggcaccatacataattttagaatgacatgaatttgccctcaggtatctgtatatgattatgcagaatttgaaagatatgacagctatcaatcttgcctctggagcttgtatttgacatttttctagactgcaaattcattttgtcataccgtgatgattgcatttaattttttaacttgtcaactctaaagttagagcacttaaaaactatatccagagaaattattattaatctttgaatgcccagcatttttatttccccccccaaaatttttaaattccatttcaggtctatcagtcttcattatcttcttactattatatatatttattatatgtaccatatgtaattataatatttaaatatattttccttttaaaatcagcaattttgcctttaacataaaataacatatatatatatatacatacacatatatgcatgtactcagtgtttaccttaagaggtaatttttgtctgtcagaaattgtgttctaagaaatatagaacttgttcattattgaactataacttgttcatcacttggttccgggatttaaataccatcttgtgttggaagatgtgcttgtattgttcctaggagtgtgtatcatcatgctgcctaaaaacactgtgatgggagtatattcttgcccattgaccaaatggacaagcctcttaccttctcttaagtgcataacctctctcctatactgtctttgctgtaggaaatcatagcaagaaggataaaggaaaagacactagcttactaatagttaaatagtttgaaaggcatagtttggtaaggcagcttagcaatgctttaagtataagatacactgggccctacatttgatttgtaatcagattgtaagaagctaatgtttcttactgtagtcgctgttttcgtccttggtcccatcaatggtaccatctgggtgcatctgcaggaagtatccctgctggctgaataaccttgtcacaatccctttgagctggggttctgcaaaacaaaataattattcaaatttttatttggcttacacaaatgcacacttacagattgttaaaaacatcctgtaagtaaatacgtaaatgccaatagcttaaatattgaattatgtatttgggagttgggtgtttcagtaacatatctatgcttttttttttccatttagaggtagagctttaacacttttagcagtaaactaaatgcaaataaataaaagctaattatgattgggaaaatacagagacatgctaaaaagtgagttattttcctcctttgtgcatctggtgtctgactgcaagatttcaccaactttatagtcccattccagaattattgtttaggccaaaatgcctctgtaatttctaagtttctagtagccataaccaggtccataagacttctatctctgcaggatgtcagctctccatcagaagttcctgggttttgaatttgtgatcaagttcagccagaaagaatagtttggagaagaaccacaggcaacagcaaaaacttccacggccatgagatgtcactggcaaatatgtggaaacgcaaatttcaccttcactaaatacttcatcagagaggagcctcagtgttccaaagttcatttctccagtacaaaaaaaaaaaaaaaaaaaaaaatcaagtcatacatatttatctaagtatttcaaaccagaattgctcaacttttaaaaaccctctaaacacaaatactttcaaactaacctttgtataacacatttgaatttttgtgcatcagctaatataaatatttaaagctttctcatcgcagtgctggctgccagcaacaatctagtttccaccgcatcaccatttttgtctctattgttgagcaaaaatgaagtattctagtgcccttatagctctaattatttcattaaaatgaggagaaaaagaaaaatgctgcttctggtgataaaaatggaggcaaagatggaaatcatatgattgctgaagtaacaacatggtatcctcagaaggacaatcgctgaatttaagctagtcaacttcatccttcatccatttattcaactaatgtttaccaagaatgtcttttttctgccaagcaatatggcaggcactgtgtgttacactgaatgcattattgatatttaggtctaaaagaattctagttaagcatttaatgtgattaattctttgagaattggcctacaccctataacaagtgtctgcagttgggacttttgcacatgtgacttgatcacattcacattatttgggaatatggggcaatgcctctatcaacacatctttttcaaagcagtcctacaaagcaaaagagatgtcaagaaaattgggaatgaggaagcagactaatgagcaaagaactgaactggaaattaggtattctaattaatagatatgtattatctttatgagttaaataaattccgttttttaaatttgtgaacctcaatgtcctcatcaataaaaatctggaagttaagctgaatggttgtttgttccttcatatgagtctctattcactttgagcacattagaatcctctgccttgaatggtgtcagaaatagaagaatggatttgtcttcaatgcatttcctccataggctcatctaatcccacaactatggacaagtcagggacacacttggctagctaacgtcactgcaaacaactctctcttttttttaaaattatacttttagttctagggtacatgagcacaacgtgcaagtttgttacatatgtatacatgtgccatgctggttggctgcacccattaactcgtcatttacattaggtatttctcctaatgctatccctcccccacccctccaccccacgacagtcccaggtgtgtgatgttctccgccctgtgtccaaatgttctcattgttcaattcccacctatgagtgagaacacgcagtgtttggttttctgtccttgctgtaaacaactctctgtgtgcctctgcctttggctacctggctgacaggcagcttctgatgtggtagactcacctatagatttgaacctcaaatgctgtgtggccccgatcaactcatctaacatctgagtttcaagtttttgtatctatatagtaagatttttaaaaagtcctactctataatccttgcaaatttcaaatgaatagtgacagagtacaaactagaaaacccataaaatatacatcctaattaaagtctaatgtttcaactatgaaaatcaaggacacggtataagggaggtaaaagaagcattctgagaaaagagtatgtctccagcttctgctttagtaaatattaactgagcttgtaaagccactaaagtaaacagtgggctaaaagtacaggatataaaacaatagaggggaggaagagggcaactgtcttacaattcacactgtatttctaataagcttgataaagtcactttaagaagtcaccacatgttctcactcataagtgggaattgaacaatgagaacacttggacacaggaaggcgaacatcacacaccggggcctgttgtggggtagggggaggggggagggatagcattaggagatatatctaatgtaaatgacgagttaatgggtgcagcacaccaacatggcacatgtatacatatgtaacaaacctgcaagttgtgcacatgtaccctaaaacttaaagtataattaaaaaaaaaaaaagaagtcatgtttttattggtaatgagatgcatgccagtttagtcgttaaagcctgtgaatgattgtttgttttctttgtgctcctctttctgtacctgtaattaaacacttcttttgccctggtggagccatcccctgttggagccctgggaattcgggttggtaactcctgctcaggataatgagcatcagactctgagcacccatctctgagagcagtgccagaacaggcccagagtctgcgttttaatcatgttgtgatatgtgaaaatgaacatcctgcattacagaagtttcaaaggagacttgatcatctattgaaaaaaataccctgaacatatataatatagatggggcacagaaagctgtgtagcctgagtggcatcttgtatgtctattaccatcgatcaagtcctaccaacctttccaggttcagctcaacatcaccttctccatgaagactcagctatcgtaagtgagaatctcctttacgatgaggaaaaccagaacatgttttgctctattttaaagaaaggaggtataaaatgagaccacttttcagcatatccagcatcctgggtacattcaactaacacacgtttatttatcagactatgcttggggacccaagatatgaagaaaacgaaaacctttgctgtcctcagggagcacccagtctaatgcatgaaacatatttgtgtataataccagtgtgggagagctgataaataaggaagtgaatcacagtgatgtgatgtcaccaaggagcaagggaccagttctgcctgaaggttgggataaggcacttcatctgtcacttaaagaatgagtaggattgccataggcaaggaaaccagagaaagggcattccacacaaaacatcacaactctgggaatgatgcagcctggtatagacagaatagagaaaagggttctcaaatgcagacatacaagtaagtacctgttctcaacaaatgttctagcacaacagtgacactaagacaaatagggtcaatggaataggttttctatgaagctaatattttccagtttatatgactccttgattttaaaattatgctcttccattactgtttttctttttcttaatgaaatgatgactatattattagatggtaggggaggaagggttggtttgctcccttttgtgctctaaagtggtgtggcaaatactgcaagcatttcactgaaatccatttcctcttttttctgggcacccagctagaccatatgtcctagcctcccttgcagttaggtttggcagatgaatgagtgtcatatggaatgtaagtggaagtgatgtgtgccattttcaggccaaggtttttaaaagcaaacattctcctccacactctcttttccttaacaccggccagattaagataacatagccctaggggctatagaaacaacagaatggaagaatgttgggtccctgaataacaggtaaaggaaagatgactgccattgaaatacctaccttggaccgtgaactgaataagaaataaacttccattggctgtgcataatgggctttggacttccttccaaaacatacagtatgcaaagggaaggagagagtaatattatggtggagaaacctaacaaacaaagcactacctcagtcaggcaatcaaggctaatatcatcaattataaaacatgctgatagtatgttctcttgagattatgtgatgagaatagcactttacctctgtgatcttcctccaaaaaacccacaaccccagtctattcatgagaaaaaaaaattagacaaatgcccgttaaataatgttctacaaaatacttgaccagtactcctcaaaatggattgttcatcacacaaagaagggataaatgcttgaggtgagagataacctatttgccttgatgtgattactatgcatcataggcccgtttcgaaatatcacttgtaccctacaaatatatacacccaccatgtacccatacaagttaaaagtaaaaaattaaaaaaaaaaaaaactatcaatgtcattgaagaaaacgaatgtctaggaaaaagtcatagataaaaggagtctaaaaagacataacaactaaatgtaatggggtattctgaatgagatcctagagctgaaaaagaacattatgtaaaaatgaaggaaatctgaataaagtatggattttagttaaacatactgtaatgatatagattcttcattgtgacaaatattgtacattaatgtaagctgttactatgggaaattggatatagggtatatgagaactctgtactatcttcacatctctataaattaaaaaaaattctaagataataattatattaaaaatactaagtacagctaaaaaagcaagtaataaatgttttcctcaaagaggctgagtgacaaggaaggtaaaggatgggacctcgggttcaatactgcttcccatcaggatgacatggcaatttcagcagaacgtttgaattcagagccactcagaaaagctgacacatgctggagctatctagacgttcctgccggcttgacagtccatctagtgctatgaagtatttcctaggtacacgatggaaacccagaacagagacagagccaaggggtcctggtcagaaatctcaggatgaatattcaattacaggaaataggatgaattttagacgtggaaaggatcgacactttacttcattagcttcaaaggtaaaaaaaaaaaaaaaaaaacaacaacaaaaaacaaaactctggctcggagagacagtgtcttatccaaggtcacacagctaacacactgatgagttcagacaagaactcagctcctatatactgaatggacatcatcctttcctttccaaagagcaaaatccttaccttaccaaaactgagggttggggagcaagaagggagaagagaggagagaataaggaggggagagtatctagctgtgaatcagttattaaagtacgtgttgatagaaaagcagttacagaaaattgtgcaagaaatatgtatctatataacctttgatactaaaatcttctagggccagcgtattcacatatacccaaactttagagaaaggttctgcatataaactccaatctaaaatgaaaactattataacaataatgaaaattatgtaatgggggccatatctagagaattaatagtacttttgataacaatggctgtatattgaacccatctccttcgtggcaggcacacttctgatacttttactgttgttttatttattatgcataacaactaactgtatgaggtactcttttctcatttttcattttttgttgagattcaaggaagctgcaccactttgacccaaagtcacagccactccctagtactgttcagtcactttaaaagagtactggcaaaacaggaacctgtccagaggaaaggagccaaataaagagggtataaatgactgtcatatgaagaatggctgaattaacagtggccgtgcagcctagaaaaggaagcatttggagggatgtgagagcctagaagagggaggatttggagagctgtctccacgttcttgaaaatccaaagaaataagaagcagccaatttgttctgagtggctccacagagatagacctagggccaatgggtgaaagttacaggaatatgcagattaaaaagaactttctgtttattgtattcaaagacagaacaggtcgcctaaggaaagagtgagttttctatcactggacataaccagaaagaagcagaaaaactacaggtcagagcagctgtgaaggacgtggacgtctccaaaggcggagacactctgagtgagaatgaaaggtcttttctaaccctgatgtcctggaaagctttgagataagccagatggtccactaaatacaatttcacttttctgtttccttagtcggtgcttaagacagggaattaaaaagactgtttaccaggcatccagaaaatgcaaccttctttataaatgttaaacatagattgtggagtagtttgacgggttcttttaatcagcctctttgggtttacaaatgtgccttctgtattaacatttaatgttgtccacttaagggaaatgagattgaagaagctgttaaatgtgattcttgtcaagggcttcgggggcattacattgatgcagacttcaaaattagactattagggttagaaaatgttcataagcaaatacatttctgaccaatcataactaaagggtatagactagggcatatttacataccataaaccaaagtcccaggcaaatcagaaatgagctacagtaagcatttgaaaagggacagaacttacctggacttttgaacacactgaaaaattgcaactctactgatctatggggattcagtaaaaatatatgctatttagtaaaggagaagcaggcctgaggcccctcattcactcaacagactgcagtgaacagacctggaggaacaccttccagaactgaaaggataaggctgaagacgtgtcactctagcctggcagaatctgctctgtggagtaaagtgagtcatgtcctgtccctcatcttcgatctccccattggtcaaatgaagacgagagacaccatcagcagctaccttgctgagggccgtgaatcaaccccaaaagtgctgatattccaagaggattctgtaactaagtgcattctatttcagttatcaatagatactaatggcacgttttattttttaaaaatgaatatttattgagcaacagcctttgtgacagttattcttctgggcaaaagggataatcggtgcatgctagtaaatcaactctcccccacctccctccccttccaaaaaaaaacagagcagaaaagaaaatccaaaaccagactttcatgggatgatttccacagtgcaactacttcaactatgactgctttaaaactactacttgacatcactgaacatagatgtgaagctggaaagaggtgagcaccatcagctccagctcaccaatgaatataactgaggataaaacataaagcgtgcattctagtaggaagatggaaaataaacatgtaaacaataaagtatataataaaatgttagtataagtgctatgataaaaattaaagcaatataaaaggatagagcatgcaagggatggatgtgctattgtggacagaacgaatagaagataacatcacagaagcctaaagaaagagaggaaggaaaccattaaggatatctaacagaaatacattccaggagcagggagcagcaagtataaagcaatcctaataatggtaaagattaataaccaacagattagaggctctctgaagatccttcctctatgccaagagtccacaaactatagccctgtggctgccaattttgttaataaagttttttttttcattttcttgctcatttaatctgaacagtattagagcatgaccatgcccattcactcatgcattgcctctgctttcatgctacaacaacaaaggtaagtagttgcaacagataccctatatcctgcaaagactgaaatctttactaacagaccctttaatgagaaagtctgccagccctttctctacttgctttctcttgcttctgtagacacctctgcctgaaaagcacaacccctgccttcctcctctgcccaggggtcctccagagccttctaagcacagctttcttccacagggtcttccctgacaccctgaggcaaaattaatcacttcctcttcaaagctccattgtgcataggttaggagagctgtgcactattttagaggtgcttgtttacacccctgtctctgctgctgaactatgaacctctcagggcagagaccttattcatcaactctatcccagcacctaacacagtgccaggcacaaggtagatgaggagtgtttgtatgctgaaggaatgaaagtaataagatatacctggcattttcctttgtcacctgtgactttcaaaggagcttctcatttgtacaaagagctgcttatagcctttgaatataatgcctctggcctctaatgcgtttcttccaattttgtcctgcacactgaacacagtctgacaagcacagcagcctcctccataaactgcacagtctccaaagccctgagttgcctcacatttcaacaggaatcgaatgaccttgagacaggcaatcctcaatcttcatattgtctcaaagctacatggaaagaaaataaccttcatttttggagtttcctcttcaccaaagcagtctgagctgtagaagacatgagacggagggcaggaaaactgagctaagatgtgaaatgccaatagggacaaggtttttgtactgagccagttttattcctcatagcattagcccccttcctcctagattcttctttgtaatatgctcatgaaaatttaaaatagttccagcaccatttattgacttccaacatgcactaggtgctgggtacaaagatgagtaagatgcaattcctgccttgaaggcacccacggcctgatcaaggagacacatacacaactaatcattatttccgtgaacatttaaagtgctgtcataaatgaacaaataaaatgccacggaatcacagaatggggatgctaattttacctgggatggcaggttctgggacaagaaacagttgaaaaaagctttaaagatgaagtaccactttatagttagcctagaataggcaggaggattttgctttgagcagcaccagcaggagcaagggcacagacagatgcatgtgcttagcatgtgcagggaccaggtatgtagctgggtgtggtcagggtgaaggaaatatgggggtgcatgcaggggctggaggcgacagcagaaaagaagcagggtccaggacacttgaggatctttaagcaaagctaataacaagttttactttattctttaagtcaatgatgtccaaacttttctaattatacatctctatcagtaaaatattttaaatctacagccttcatatatgtacatgtataatttatgccacgtgtatgtgccactctgtaaattttgtgtataatataacacaaaataggaattttaaaatgagatcaatgaaaaacacaaacaaaagttgtaattgccaggcatggtggtgcacacccgcagtcctagctgctggggaggctgaggtgggaggattgcttgatcccagaagttcaaggctgcagtgagctatgattgcatcactatactccagcctgggagacagagtgagaacctgtatctaaaaaaaagttgtaatagttttttttcatagccaatggctgtcatgccccacatgcttcagaggccaatgcattaagcaatgggaaaatttggaaggattttaagtctggggctaaaattatgagggtagtattttacaaagtcaaaggatactgtggttatgggagccagttagggagctattccatataagaaggaccttagataggcagtggcaatggggatggaaaaagctgtcagccagaggactgactgtgcttggtgtgctaacgtttcagccaccttaagaatgaaagtctcatttcagttgtaaatccaaatcccaaatccgaatccgaatcaatcgtcatcttcctaagggagcactatttaaatgtagaatattaatgaaagtgtgggtgaagaaagcttaacgcaggcattcccatgaagccaaataccttcttgccttttaagaatctctgttcatggaggggagtttgacactggtcaacctcactgggttacaactccctggtctttctcaaatgatcacccagagaagtagacctggaatgaacatggctttccaggcagctcaaaaatgattgctggagaatgccgaccacaagacacttcaaacatgaagataatcctaaaatcttaagatttcagagccagacaagccattcaggataatctaattcaaagctcatgttacatatgaagaaacaaaacaccagggagaggggaaagtcgcgtggcagcacatcttccaatccctggagtcagagctctttaatataccaggatcttccagttctgtgcctcccagaggtttcctgatcttatcccaaacgagctgcatggtatccagaaagccatttcatttcttcatgcatagccatactttgcttcttgtgaaattgtttagataactaagacccactgaactaaagcttgttctaagaaattaggaagacacattatagtgtgctctatgactaggaagccacgcttatatggtagatttaactttcagacagaattaatgtagataggaaaatccacggttagttaaacagtagcaatgggcaaattctcctgaggttcattcacagaaaggaaatgccaagcagttaacaaatgccaggcactttatgtggattatctctgaattttcactgaaataatttaaggcaggtactatcattgggcttttttttttacatctatattagggaactgaggcttacagaggtgaaatcactagtgctaaattacagagttaatccatgccagagccagggtggaaggtttttgctttacacctcattgttaatcatcagttgtcttttgaagaactctaacatgctaatacatctctctacttctttaactgtgatcagcccacaaaccctgtggaaatctataaagccaggggccaggaataaaaagcaaacactaaactggagttgcagacatagcttttggcctcctgtcacaaaaaaaagtggcggggctgtagacacttctatgcacacagaaagtgttctgtaataaaagcatcctcatttggcatagaaaaatcttctcagtgagtctcttttctcacagacacatcttttggcaccagaaataaatgaacaggacacattatttgggcgagcacaggcatgacagttccctgacatcaggggagctgcacaaatgttggacttgtcctgaaactgccttggatatcagagatctgtttatccaggttggcaagcctgaggaattccctcatgcagcccaaatgtaaattaccttcaggtatattattatggttgttaaatgtgacttttgtctatcatcttttcataccatcacacacacacacacacacacacacacacaatgctttgcctttgcagagtcaaccagagtgagttctagtggtgtaataatactttcggcaaaagagcagttgagagctccaagaacacatccatcagccttgatcctggtaaattcaggcaccgtggtgcaggggcatatgcagggcagtgggatccggacatttggggtctaattccaattgtttgcttctctccatccgcactgcctccacctttgttcaggccatcgagtgctctgggctagattccactaacagcctcctcactaacactctttctcttccaaaccacactacagtcaaggtaatattttacaatataaattggatcatgtcactcttctgcttaaactctttaacagcttcccatttcatttacaagaaaacgtcagacccttagcatggccgggagagctttgcaccatctggctcctgcccacagtttcatcatcatcttaattgactctctccctggctcactaagctctaggcacatgtgccctctttctattcagacctagggatttttgtacctgcatttccctctgcctggattgattttcttcctgaaataaattcaagtcactgcataaatacaatttcatagaggtcttgtctaggcctccaacctaaatctgccgccacgtttgtacagatattatctggcagcacactgttttttttttcacctcccttcattgcacgtagtcgaatttgtaactagatagctatttctctttgttgtttattatctatttcccactctagactgtagcatccctgagggtgaggccatgtaacttttatttattacagaatatctagttcttagcatagtgcccattaacatacaggaagcaaacattttttttttttttcagtgacctagtttcttctctctgggcttcaggtttcatctataaaacgactgtattggaagagttccgtggctccaagtctaggtcccagaaacctgagggactctcaggtcaagatagatacttacaagctatttttaataagttagaattaaaaatggagaaaacatttttaatagatatatcttttaccactgtaaatcaatgaagattattaaaatttcagttaaattataatctagacaaactatattaatacaattaatttattacttgatattacatcacacaaaagagcactgaaaatatttatcaaatgtggataacacatacactgtaaatatgtaaacatgggttgggtgctataacttagattcattttgggaggctcttagggacaagtgaaacacagatacagggaactgccactgtgactgataatgatggactgtgacatagaggctaagatctcatgaataaagaaatgaaccagtgttttcagacaaagtgccaggacaatactttcaagggtggctgatctgactgtagacatgatcaaaagcctacttctctcatggccgactccaagaagcatatttcaggattcaatacagcaaggattgatctacccctagctaaggaatctctcaaacttatggagacggtcagcttgactttaacacctataacctattttaaaaattgaaaacagtttcccatttacatgtgacacattgtattaagaaaaggcatgatttgtcaacaaataatttttaaagggcacacgtttgggagaacaattaacattaaaatgtatgttgcattttgtttaggtgttacagaatcaaaaatacaaaaacattgggttttttatctgatgcttcaaaatcttgcactttgttttataaaaactggtttaattttagaatctctgtgttttctttctagtgaccacataagatgaaaaaattgaaactcttcccaagtatgtatccacacataatccattctttccatggatcacctgtgtagtcataaatgggaaaacaaattagatacaatggtcataagattttcttctttaactctgatattgaggctctgaaaacatctatatgtaccacgtaggaatttttattcgtaattttaatttgctttgatgaagattatcttgattatgatttgaagatttattatagttttacctatccattaacagttttattaatttgaattatctttttagcatgaaatatttcaaacatgcagaaaacagaaaactaataataacctttttaacagtgcttaccatgagccagggactcaaatgatttctatgtctagtacttactcattccatctttgcattagctctatgaagttagtattttttttctcattttatagatgttaatactaaggtgcaagtgaagtgactgcccaatggctcacccaaatttcataagcagaagggctgtaaagatttgagcgcaggcagcctggctccagaacccatagaacagattatcattctcactgcctctcaaccaggtactcatcacccatatttaacaaatactagcattttccataattgcttcaaatcgttttatagaatcaaaccattacagtcatctctttaattccattccattactttgctaacgagatgcagacatatttctgaatttgggaggtagccttcctattcatatttttgtgcctgtactccctctgtaaatatccacaaaaagtacctactgccctttgtgtgttgtgcattttaacataaaaatatgccatgtatattatcaagcaatttgattatctcattcaacattgtattaacaccaaatatttggattttgaatcttcatctgatttgaaattcccataatagatggctataatcattttgctttaactttaattttctgatttagctgtttttatttctatcatcttcgtttgtggtttttatttattatgcatttctttgcttcattattttatccttatgttccttcaattagattgatttagtctcccttatactctctccaatttttccctttatcttgaattggaaattacagttctgtctctattattttagtagtaatccttacatatctaacataaaggtgtagtttaacaaaatccaagtctaactgttaattactaagcttttatcaaataatgcaaacggctaaaaactcaaatccacatattcctattactggctagtattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaaaatgtctcagtgtttggcattacatttgtttatttatttctctctctttcttattgtaattaactggacacataacatcaaaaagatgcttactttccctcagcattctggaaaaaaatttcatcatcttctagcaactattattgctgacaggtctgcaatctatctttcatttgtagttaatctgtcttttctctctgacttcttttaaaatattgtatcttcatcataatgtgattttataacattactataatattcccaggtgtggattgttttaagaatccacatgatgggaaaagcccatatgaattttggggttctgcaaattctctatcttaatctctttgattatagatgatctgacattgtatcttttcttctttcccaggactccattgaaatgcatgttggagcttctttatatatatttcctatctcttaaaatctcactcaatgttttccatctattaatctctcagaagaattgatttgtctgctttcatctccaatttaatcattttctcttctattatttagagcttatttttgaacacacacataaactttctttcttactattgtcattgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgcccggctaattttgtatttttagtagagacggggttgctccatgttggtcaggctggtctcaaactcccggcctcaggtgatctgcctgccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattcaacttgttgagctttactcttctttttgatggtttatatccttgtatggtttcaattatcagactgagattttcctcagagaaagttgttttgtgtttccctggactgtgaaacacatggaaagcttttgtattggcctcttgtagtatttcacggatttccccagctagagagaagttcttacgttaacttctcagactggaattccaacttaacaaggagagtttgatattgaacctcacccaggaagtggtccccgtttgggtttctaattcctcatagacaacactttccacccattgccctaggtggacacatcaagttccttttagttttccttggcagatagaaaatttttctagatcaccatctctcagaaggagcactgtctctgtacaggcccctgcctgcctcacacgggtctgacacccagtctcctgtgcccacataaaggttaagcctgatgctcacctgttgatgcctatgccattctagtaatcgccacctgaagtacagaaactcagttcctgctcatctcgataaatataaattccctcttcttttctggcacatagagatttcccctttttggttttgagcgcaactatgcattttaatttttgttgttatattttctccagcagattcacctattttaagtgggaggcagagtcatttcgtaacagctcagattacaatagtcaaagtcttattttagcgtcaatgtttattatgcctctaacaagtagaacattatgggggtaacattaaaactataatattcaaaattatcattgtggttagaactgtgcaattaggacataaaaacactctgaatgactgagtcacgaacacatctgcctgatcccttccaagtgtcaggtatttagtaggtgagagtctcccagggccagacactatgcaaggagcttgggatacaataggcagcttattagtttatgttcccaaattttaaatcttaaaggaaaaataatttttaaatagttcattctattgctttaaggagaataatatatctgaacagatgttttccctagagaattgaaaaccaccagtgaggaaagctgttcttattaccactccttacaagagaaaaatagaaccctagtgcaggaaaaaatgtcttttctggtattacgcattgatcaaaattagacgagatccctttcttctgactctttcttttctttctttctttctttctttctttctttctttctttctttctttctttctttctttctttctttcttctttctttccttctttctctctttgtttttttttctcagtgtctcactctgtcggccaggctggagtgtagtggtgagatcacagctcactgcagcttcgaactcctgagctcaggagattctcccgccttagcctcctgagtagctgggactacaggcgtgtgctatcatgcctagctaatttttgtatttttgtagagacagggtttttgccatgttgcccaggctggtcttgaactcctgggctcatgccatccacccacctcagcctcccaaagtgctgggattacaggtgtgagccactgtgcctggtctcctctaactattaaaatagctttcccaaaaatgcaaagatatagacacaactacttttgtaactggaaatttaaataggtaaaccttagattattcataaacataattttagtaaacttaaatttaagatttccaaaagtaacggaacagggattcattttcgtcattttagcaaacagctcttcaagaatattctttggtataagtttacattctgatttaagaaaatcacatttatttgttgtttcttgttccattttaatcctttttctccaaactccaagaatcaaaagcacttttttttagggtccgggggtgcaggtgtggggttgtgggctatatctatattttaacttttattttaggttcagggatacatatgcaggttttttatacaggtaaactcatggattggggggctgttgtacagattatttcgtcacccaggtactaagcctagtacccaatagttattttttctgctcctctccctcctccgaacctccaccctcaagaaggccctagcatctgttgttcctttctttgtgtccatgatttctcatcatttagctctcacttataagtgagaacatgtggtatttggttttctgttcctgcattagtctaaggataatggcttccagctctatcaatgttcctgctaaagacacgatttaaattttttctggctgcatagtattccatggtgtatatgtaccacattttctttatccaatccaccatcgatgggtatttaggtcgattgtatgactttgctattgtgaattgcaaaagcagttattcagcttccataattcatacctacatttcccaaatgactgtgtgataaatacatgtgtatatgactatttaataaaaacattaataaatacaaataaaatcatgtattctggagataacctaacaaattgtcactgtgtatagggcaagggatacataagaaatccctacaccttccactcaattttgcgtgaacctgaaactgctctaaaaaaaaaaaaaaaaaaaagcctatcttttttaaatgtccttttgtactctgttatcttcaacaataaaaggaaaaaaatatataaagacatgagggacactaaaagagctctcaatcctttggggaatctttaacaaagcaataatatttacaaagtggctatttcccagaatgacatcgaaatttcacatatacgcgtgcacacacgcaatgcattcgcacacaaatagataattgtggatttttattaagtttaacatacctaaagatgctgccttatttactcaatttaacaataataagtcaccacactttggaagcaatatactctcaggagaagtccacagaaagaacactgctccaggattcaggagacttaagtcccagtcccagctttgccattcactccattactcagctttctaaaggagttggatcatcaagatcttttttacctcttttgttctatggctttaaaacaataatggtggtagtgataagacattgacttacgattttattatgttttagttattggataccataaagtacccagatttgaacacattcaaacaccacagcgttacataacacactttttatagctcactgcttggggaaataaataacaggaaattaataacaatatttaaattaaaggctatgccagaaatctctaagaacactaaatcagatccaactttaggcagtaataattaatatccactaataattaaatagatgatgtctagtttcagttccaggtgtccaagtttcccttccttgtctcattaagaattacaatttactgcactgcagataaacctttaggcaaagcatatttcatctgtttgcttaatggactggtgtcttcttaaaattcagagttctagacttaatattggttgtgagataatttatggttgatttcaacattttctatctcattggaaaaatttccaggcttatttcaaagcttgaaaccttaccaactttcatttgcctgaatgaaaacataacaaaccacattctagaatctagcaaagaaagtatagatggtggctaatagagtataagttcatgagagagaaaaaataatctaactataaataaatgctctacaccataaaacactatcaaatggtaacaattatgttatttcagaaatagtgtttatgtacagaaattctaatttctgatagcaagatagtaaggcaaaatcagaaaaacctgcccctgattgtccaataaaaagtagagtacaacttgttagatttcatagcacattgttgacaatagtcacctcatttcaccagaatggctttctctcccttggatctaatagcaagggaaagaatgctgagtttcatgcctaggccagtactatccaacagtaatataatgcaaaccccacgtaagtattttaaaacatttctagtactcatttttaaacaagcacaatatacaggtgaaagtgtatattctatttatatagagtatatatttatatacagtattctatttatatatagtatatatttaatgacttgttctatttaacataatgtatcccaaattagtagtgaatatagaaattattgcaatatcatacattcattttcttcatgctaagtcttcaaaacacactgtgtattttgcaatcacagtatatctcagttcaactagccactttcaagtgctcaaaagccacatgttgctagtggctaccatattatacagcacagacctaggtggttggacatcttgacagacacatttctccaaacagcacccgaccatctattatacaaagcaacaatgatcttgaagactttgttaatactgataacaacaaggtacaggtaatcaaagaccacgtacattctgaaaaatacgcaccaaataaggtgcaagcaaaaattatatcctaaacctactgcctgcctgccttcattccttccatcctaaccttgatctttccttccaccaataccctggtcttgataccacgccaaggaacacaactatgaacaaggcggtatggctagtgtcctcgtgaaattgaccctcttgtcagaaagaaactaaataaataatgccacaatcagttattataattacaaatatgagaagtgttctgaaggagtcctggctgctatggaggataaacctcaccaaaccctagggcgtcaaaaatggctccctcaggatagaacattgaagatgagtgtaaagaaaaagaaggaattagctagaggaagtgagtacgtgtcagaaaaaatgaggagtaaaaaataataacactccacacaaggacagaagtaaaagaaaaggttcaaagtcagaaacgactttttggtgaatttttttggtgaatttaaacaactgaaagtgtggagttcagagaccaagagtctggacagtggcccaaagaggagttcagatcattcagaatgttacagagcaaggcggaagaagcagtgtgaaagcaagggtcatttgggaaattctgaatggaaaaagtcagacacataggacatatagggagtgttatgtagactagcataacactttttttttttttcttttttgagatggagtctcgctctgtcacccaagctggagtgcagtgctgcgatctcagcccactgcaacctccaccttccgggttcaagccattctcctgcctcagcctcctgagtagctgggactacaggcatgtgccaacacgcccagctaattttttgtatttttcgtagagaagtggtttccccgtgttagccaggatggtctcgatctcgaccacgtgatccactcacctcagactctcaaagtactgggattacaggtgtgagccaccgcgcccggcctagcataacactttttattgagcttgtacatcaatcaaatgctatgctatagtccatctacactcaggctgatcaccctgtacccattttgccaatggtgtagaacttcaaatatatagccataaaacctaaacaccattgcacaaatgtagcctttgattttatctacctttgtcctagaataatggcctttcttcgcttaccaattcttagtgtggtcttctctattacctatagcaataaaaaaaaaatacgttggtataaaaaacaaagtcagtcacacaaaacagctggtttacccaagcaataacatgttttttccttcctttgctataatatagagcaagtaatcaaacaaaagagattggttctaaataaattaaaattgtgtgacagtcataattcataattatataaggtatattcatcatttccctttaataagttgtattaccccaaaatatataattattaaatttgaatgtaaattaccctgtaaaatgaatgcctatatttaaaacttttcacttttatgaggagtaatggcaagtcattgaaaagttttaagcataagaatgatatctaatctgtattttaaaagctcagtagagactgataacgagagaacagataggaggatgagcagggagacaagtgagaaagtaacaacacggccagtcaagagatgccagtgactagtttgtgaagatgtaaaattgtcttgacttagttattaattgcatgtgggcagaaagggaaatgtgtgggagcacagtaaaaatagaaagtggaagtatgtaatcatggcacagacagaatttccttagaagacagcaaagtagatccttcactgatctatttcccccaaactaacatatacaccccagcatggcatggaagacaaaacccagagtttatacttttctgagctaatgaacatacttctctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgaggtcagaactcccttaaaatgacatggttccaaggattctgatttaaaaaaaaaaaaatctgattaaaaaaaaaaaacctattgctataagtaatagagaagaccacactaataattggaaaagaaagaaaggacattattcttggacaaaggtagatgaaatcaaaggctaaatttgtgcaaaggtgtttaggttttatggctatatatttgaggttctacaccattggcaaagtgggtacatgcttgtttaaacatgataaccacattatttgaggagggaaatattagaagaggaacagatttagaaagaaacctacaaattaggtttaggatattttcagttggaggcaccaagtggaagtcggatttacaggtttagaactcaggagagaggtcttgcctgaagatataaatgtggcagtgttgatgttttgataaataaagccatgaaagtacaatgtgagtgtttaagatccaggactcagccttggatctctaaagatggaacagaagagtataaactgcttaaagagactaaggagaaaccagaaaaatgggagtaaagactgtttcaaaaacaggaattaaccagcaatgttgagtgctatcaagaagtcacataaatgagggctgaaaagtatccattagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatattttataaagacttaagcatattaaattgaaaacagcaagaagctagagaagaggggatgaaaggtgatgtatcttccctacgaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatacttatacacatacacacgcacatatacaatctctctaagactacactgaatatctgctgaggatgacttttttcctgagccaccacaggtttcccactttcaggctccgggggtgacattcactgatgtttgcatgagtgacacatcccaagaattgtacaggcaccatctgcacagatacactggatggtcagttacctctgtattccttaggtagagagagggtgaaaagtgactgttatgagggtcaggagaacttgcctcaattcttaactctgtcactctcatttgggtgacatctgtttctacaaagtcctcatgtatatacagtagcaacagataggtaaataagtagatatacagatatatagatagatttgagggaaaagggagatgacctggcttttcaggaagcaggtacatagactcggttatgaaattgcttgtcatatttgaatgaatttcagtgtgtctgtggcagtgcctaccatgtcctgagcactttgtgctgaggctctacgtgaagtaccaagtatctcttaatgtggagttctgttagtatttatttatatataaaaataataatatgttacaacatatcctaaatttatgtagattttttctaatttaaatgaaattttaacatatatatgttgtttgttccacagcacacacttttaaggtaggtagtattcaaactcagccctaatatttgtagggcttaaagcaagagaacaaatggagactcccatatcatatgtttaatatttaaatttataaatcaaggtaactgtcaaatattggatatttagttctgctacttgaaaattatgttttcctaattcaaacagatctcctgggctcctcagatctgatctttcacaaaacaaagcaggactgagagaattcaccccccccagctcatagttcagacctcttctcttcccactctgggctccagccaactgacactgccagggacccatagggattcacatataaaccatagtttatatgtccaagcaacatccacctccgtctaacagccttggtgaaccttcaggccaggggcgaatactctctgccatgcaatttgcccttggaagtacagccaaggaagacgagcacacagctcctggaagcaacctcagtaatgtctgggtaggaacttctgggatgccagagtgtggtacagaatagggaagcccaggctccaggtaaacatgcccccttattcccgtggactccttgccaccacagacgtggacatgcctggaggaaggcctgagtagagtccaggacaaaggcccctacctaagaattaaagcaatcattagtattctcattaaactattttaacatgaaggtaactggggctcagaaaggttaagcaactgttacttagcccaattgctagaatatggtaagttttcaatatggggtgaataaacgaggaataaatgacacacatctaattagtgacattgtctccaacatgaacacagtcttctctttctctctccagagctaattccacagttccacgctgacttcaatacatactgctatgctagtttttcatggtcttgaactctcttcttgatagctcattcactcatacatttatatctatgttggtgtgtaattatacatgtgtatgcacacatacacacactgtatgctagctgcagcttatcttgggaacaaatcttaaatatggcttgcagaaattattaagtctcatttcattatttgatttcccctacacaaatttcatctgtcataagttctggctgatttatgactcaggaatgcaatacttataaacctcaccatccaaaacagcattcaaattccatcaaaaattacttttctcactttaaaaaaaagtattataatttaaagttctgtctcccagctggaatccagaagaataaatatgagtatgaaagttaaaggaaggctctgataaaataattagagtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaaggcaattgggagaggtaacctctggtaatataaagaacactggaattagagtcaaaagctggggaggcaaaaaagaaactaaaattcattgaacacttacaatgtttcaggtacagggctagtgcctttatatactttattgttaaaagtgtcaaaccttcgataaggttgacattcacctgtctgttgcttccttacctagaatatgaatatctctatacattgtacaatataaataacagtaatatgaacaaaaaaaggggcaattgctagcatggctgtgcactgtatttgagaaagaatatagagaaataaccatggtattcctgtctcactgcactgcaaatcctgggatcgtaatcagatcccgttactatcagtgaatcacaatgttccctggcatgcctgcatctgggaacaccctactgaggagctggttaatattctattatatctcacaggaagaattcaaatgacacctccttgttggcccttttatgatttcacagaatagatgtgacaaggggctattcggaagctcaaaattttaaggtttagataaaccaaaagtatatctagccatctagttatagaatagacatccaaacctgtcttctattttttaagttgggagaaagaaaatagcgtattaataaaataactcaaaaagccaggtatgcttcaataatttttagtaaatgtctaaaaatgatttctttttattactaatttcattctttcaataaagtagtatagttattttcagtaaaacaataacaaaacagtttggatgcggtggctaaggcctgtaatcccagcactttaggaggctgaggccagaagatgcttgagcccaggagttgaagatcagcctgggcaatatggcaaaaccccatctctacaaaaaaaatacaaaaaaaaaatacacacacacacaatatatatatatatataaattatctggttgtggtggtgtgtgcctgtggtcccagctactcagaagactgatgtgggagcatcacctgagccaaggaggttgacgctgcggtgaggtgtgatcatgccactgcactccagcctgggtgacacagtgagacactgtctccaaaaaataaaaagtaacaagatagaaatgtcatgactttgaagtttgattatagccactcttagttattttatataattgaacatacataaggccggaggggtgtctcacacctgaatcccaacactctgggaggtcaaggtaggaggattgctagagaccaagagttcaagaccagtataggcaacataaagacacccccatctgtacagaaaattaaaccaaatagccaggcatggtggcatgtgcctgtagtcccagatacttgggaggttgaggcaggaggatcacttgagccctggaggtcaaggctgaagtgagctgcgatcggactgttgttgcacaccagcctgggcaacaaagcaagaccctatctaaaaaaataacaataatacataaaacataagtgtctataaaaataagcaaagacaaagacaatccaaatcgttataatacaatgtaatatcagctacagtaaatgagtcattatattgaaggtatcataatttatattgcattttatttaaaatttctgaagttatagaggttgacatatgttaggtgctttttatttattttttgtctacagaaatataattatttgctagatattttctcagatgttgtagagatcacaattagaaatcatatatgtatcatgccctaaaagaattcagactattaagaaagatatataacttataatcacataaattcaatacagtaatacatggaataaaagttgaagatagaatatagaaggtaaaattaaaatttaaaaattaatgtcattttcttaaaattaaagtcatcataaattatattttaaaaacatttcacatttttgaaagcaacttgctatatgatgccagactgtggaattctataaataagtattcaagtttgaaaaatatattttaaaacatattcaattttaaaaaaaaatgaaacatatggaaaagaagaataacaaaataagcaaaaactttcactatgtcttatgaaatataaagtggtgccaaaattttgtcacttatttcctgatactgatgcctgtgataccaaattactgaaaaaaagaagccaaaaaataaaaaggaaactaaggtaaccaagaaaaaataaaaggatactcttacaacgaaacataattaatggctaaccaatgtgaaaagacttaaattaatacatggccgggcgcggtggctcacgcctgtaatcccagcactttgggaggccgaggcaggcggatcaccagatgtcaggagttccagaccagcctgggcaacatggcgaaaccccatctctactaaaaatacaaaaattagccaggcatggtggcacatgcctatagtcccagctactcaggagtctgaggcaggagaatcacacgaacctaggagttggaggttgcagtgagcagagaagatggcaccaccacactccagcctggctacagagtgagactccatctcaaacaacgacaatacatattccgcaatcttcccctgaggtctgggacaatctagatcaaacacttcctcaaggggaaagttgggaacagcatacgtgcattttaacgctatcctttcagcatgagcatttccatttgtctattccagattttaaaacagaaactaaacattcctaatctttaatgtttgatctagcaaaataaaaagaagcaaaaagcaaacaaaaatttagatcaactcaactttattttgattctacttaaaattattttaaaatctttatttgatacaaaacgctaataaaaaggcattctcttatgagttattaagtattagacccacttttcaaaatgtataatttctacaagagttgattaatcagaagtgtccaatataaactacagttagactagatgatggcacaaaaagtcaattcgaggaacaaatggtgaaataaatattatatgtctgactaagaccatcatccataatatctggacaacaaaaagaacttcctttacttaactatcatgctctaagtttctcttttcaattttaaaatgtttaatctaaaccaagaatggcactatggtaacccaggtatataaagaaaaagctgtcctgtaggctgactcatagtcgctgacttagttcacttagtttatgaaaaacattcaaatgtccatgggttttccttccttagaacatacaaaatggctgcttagattctagcacactatgtgaaaaatatcaaaatggagggatgtgggaaagcccttttgtgtcatatatttctgagtttcagtaactgctgagacatgcagccatacagtttcccatctctattcatttatttgttgatgtgtttaccgcctacacttactgcctattgaaattcttctcatcttctccggcctggctcaaatgccatactcagagtgtgggggctgtggatacagctaagagagaggatggagagattgaaagagataagatctcaccaaagtacagtcattttaaagccatttaaaggtgctcttgtaaggaactgggaacctttgcaaaggtttctataggaaagtaatgtgacattaaatatgttttgaaaaattatgtgtgaagaataatcagggattcaagaaaagggaggttgaaacaccaggtaggagattctacaacatttcaggttggaacaacaagccccttaattatggcagaagggatgaagaaaaggttatatgaaacagaagctgatagctatgtgatgaccatgaccatgctaattcatcttactgtcccttatagttcccagaaagtcctcagttagtacctgatgaataaacaatagagtaaaacgttacagagatacagtcaacgaggcgtgtgactgatatgaagagatgagtcaaagataagtggggtccccaacgtggcaaacaagatggtcagtatcagaaaactaccaatatttgctaagtgtctactaggtatcattagtagtgctgttgactaaaggggaaactcaagacacaaagcagattgggttctggaggaagataatacattcaaattaaggcaaattgcatttgcgttcccagtggaacaactaccaggaggtatctagcacgtagttgaaaatttggatgaggagctcagatgttaatctgtggctcaaaaatatagaggagacaagtgaagtcaataaaaatgagtttatccaaggagaaaccatagccgagcaaagagaaaagcatgagccgaaggaggacaaaaagatgcaccgcttggggattagcaaaatgtatatctcttcattatgatagttttcagactgtaacagtgaaattgtggacaacaatatgctcagaactcttaaaattaaacacaggaatgcctttgagcatatagtttacatgctgtgaaatctacctgcaaaagtgcctgaatcagttcagatgacgtctagaccaactggtgatttaatttagaatgcaagcaaaaatctcttatgaaaatcctaagagtttggttaacgttaaaaaataataaaatccctactgtgaaattatgaagttcttttctcaaagcacattataaacagcagttgcaaggattattaaccaaatattactgtgcagagggataaagtgatctcgtaaaggcctcacagaaattctaatctggactgaaggtattttactctgggtttatcagaccaaatctggattattatatttgattccaagcaacaccctctacaatgatattgataaactggaggtgaacaaatctcctatatgaaatacagtttcataataggtgctgtaaatccttcatctcaaataaattctttccatatttaggataggtaagtttggtgtcctgattttcagataagaaaagtgaggattagaaaaattcaatacctgaccatgtttctctgacatgtcagtttttcaatattacttctatagatgagcttaaagccaccttgtatcaggaagaactaagaaactaagtgagacttagattggagacggtaagacacagattgaggagtgggagagaggctgtattgcataagcaaagatttatgtttactaaagccttgctactcaatgtgtggtcaccaggccagcagcaatggtatcacctgggagagaattccaaagccactcccgacttgctgaatcagaatctgcatttcacaagtttgagaagtgctgatctgaggaactattatagagagaagggattacagattttttcctatgtttctatttttgtttctcagaagacttgaattaagaagcttccaaaagacagactttgaattaatattggggaaacatcattttataatcagagttgacaacatatgtcatccactgaagatcataagattcaagtagaaagctgaactaaggctgtgagcagtggctcacgcctgtaatcccagcactttgggaggccaaggtgggctgatccctgaggtcgggagttcgagaccagcctgaccaacatggagaaaccccgtctctactaaaaataaaaaataaataaataaataaataaataaataaataaagctgggcatggtggcgcatgcctgtaatcccagctactggggaggctgaggcaggagaatcgtttgaactcaggaggtggaggttgcagtgaaccaagattgcgccattgcactccagcctgggcaacaaaagtgaaactccgagagagagagagagagagagagagagagagagagagagagaggaagggagggagggagggagggaagaaaggaagaaaggaagatgaactacacatgtaatttttggtgttctgtatctcctctaacccacgacctttttaagataaaggcctttgtttttttctctattgacccatacttcagttctagacagattataagtagacaatggatgtctgtcaaataattgaagatgtaaatgaatgtacagtggtgttggagtcagtgggttcaaatatgaaggtaaatgacctttaaagttttctacaatatgaagactctgtgattacaatgttaatggggtataggtttgctttttaattctacctatatgcaggatagagcagaatcaaaaactttcacccaacaaactcaaatttcccgaaggttcatagtgtatgtgaagatggctctatttatgagtattcatagaacattgctgaggtctttcactctccctctccaccaggagtaataatttgcattcaccttgttttgttaggcctatgtcattggtaaggtgactcatccaacaaatatattttatgtgacatctacgtgtcaagcaatatgctaggctttgttctttaccgtgttctacgtaagggactaacctcaagaaatgactttattagcaccctgttctaatcaaacagtaaactagccagtgattcagtagaatcctacattgactctcaactcacttgtaaatagggagaaataatcctataggagccctccaaattgtttttgtaaaagtttcctcatgtttgacacacaccatgaggtggcctctaactgactgttatgacattttcctcaaaaagaaaaagcccttctcatggttaaaactgattttgtattatacttcaaattcagggagtaggccaagcttatttttggtgaagtaacatgaccaatggcacaaaagataaaactgaattttcctgtgtatactgtaatcatactgcacagataaagaaaatgggaaaaaaaagaaaaaggtcaaataccaatcacacctatggaaatagataatgtggataatatacatgaataaaattcacagaaactcttaagatatcattttaggatatattttaatcatatccttccttaccaagtcttctactattatcactaatgagcataaattaatttcacaaactgtccataatattaaacgtgatgattctaagagaatgtcaaggctgatatttagtaaacattgttttaaaaaaaaatttcataattgatgaagtcctggtggaaaacatatctaaaaggtatatcccaagtctgggaaatctaaaaacttgataattaaggcatgacttgcctctccacatccattccaatcagttcctatggcatcctatactttactacatttctattgcttaaaactgtcctgcagtatgacattacacattaacctacccagaaataagtctccagctttcactcaaaatcatgtggttcctttcctgtctgttttttaaaaattgttttattatcttcgagactacactagtaaataaacgtattttctattaaaacaaatactagttccactatattattaagttcttccggggctgaggtccaaacttatgtaatggtctaccttgaaggcctgtcaaaatgctagaaacaaggaaaatttagaaatacagtcaatttgtgtccagttgaatgaatctaagaacaaataaagaatatacaacagagaagctaataaaaatatatttgttaaatttgtgatattccatttaatatacatgtcaaaccttctagaacttcatatcaaacatatcattaagccattttcttatatctgacatacagatatcttggaatacatacacctgtcctccatgagtattagcaccataaatatacatcaagaataataaagctgaaaggaatttcggaaatcattgatagtaaccctttcatgctgaaaataaggaaactaagctgaagagaagaaaaatgacttccccaaggtcaccaggactctgactcctagtccagtattttttctatcacatcattttaccttagactgaatcaaaaacctcttttatttatatcttccttttaaaaaggttgggtttcaaaccaagcaaaagaataaatacagagaactgtagcatacacagaagacttatttaatgctgctatcaataactttaaaagtaagagaaaagaagaaaaacaaatgaggtaatcaagagttgacagaaagaaccttttccattaaacccaatcgatactgtatttccccatcacttagcgcttcaccagagaaagtgaacccagagtgaatatgttccctcaagggtatttaacactaagatgacttgttggtctcagctgtaaatataaggaccagacatgactaaatctgaaatcaatggcaaaggttattcctcattaacctaacgttaagaaacctaaaccagtcaaaatagaaatgggcccttttccatattggctgcaccacccactccctctaggtttctggggcaaagacataaatgaatataaagatgctccttctttcagcattcccatagaaactgccccctgcatcagtgggtgctctgataagaaagaggtaaagtttgaaggtgttaggcaaagtaaatactaagtataagaagggatggccattaggagttgggttggggaataagtaaagacatgaagttctaagtatttatcaaacaactacatatcaaattaaactggagtaacaatatttttggaatttaatatcaaatgaagagatatttgtattagccaaaaatactgatttattttctttcccaacattttcatatatatgcagaaattccctcagagcctgactatactgatgccataagcacattagtcaccaatggaattaatttcgttttgatgaattatttctgatcacctagtatgtagaaagcattgaaatgacagggcgcttgccctccaggaactcactctccagcggcagagacaaacaggtacttatagagtaattataagacaagacagactaaccgcagacaacagtgcagggtataaagcctggggcaggcagtgattcattctacctggaaggatctgagaagatctggcagaagagatgggagttgagctgggctttgaataatgggcaggactgcagcagagtggataaatgaagggttgtctctgggtaagtgaaggataggtgtggaggttaatggcatccctcgtggagaaataaaaacatctataaactaaaagaactgaaatggatagatgcagtaaatgttctatgaatgtcaagaaggtttgggtcggctagagtagtatgtggggaagggtggagaaagaaccttgattgtggagcctattcatattgatgatacaataataaactgtctgctcttaaccacgtattgagcccacacgtgtatttttaaaagacagattgtggctaagttttttaaattaagaaattactgtttttcttgaaatatagacattaaaggagaaacagtccaaaataatacagcaaaactataacttggaacacagtaacacaaatccagcaagagttaataaatcttaattatatactgccttacacaaaagaaggcaaggattttctcagtatttctatattccattcccaagcacatgatatacaaatactcaatgggtgtctagcaatataacttgactgtagatatttaaacgcatctacccaacatttatattgctccagacacagaacaggcagatagctcttgctaccagcattgggcaatgggccctaaaaggaggcagctgtggtgtagcagtaaggcataggcttatcgcaaatttcagtccttgctctgcctttcatagttgtatgacctaacacccactatgagtcttatttctttcttccatgaggtgggcaggtgtattgtaatgagctctgttttccaattcaaacccaccaacacttttcatatataccttaccaggtggacatctcaaggctaatgtcacagttagtcaaccccaagtgcaagatatataatggcctgggacgaaagtcttaatcaaggtgccagttcaaccagactttgaattcaaataatgaacccagctgcataaagcttgctgctcttcagccctaacaggtgtctgcataatcacaaagaaaaccagcttcagactgaatgtaattgctgagcatgaaaaagacaacaggcaggccagcagtttcagtgaaaataacaagagtcaggaccaaggaacctccatcttcaccagatcaaaacttaccctgaaggggcaggctcccaaccaagatggtagttccattagcaaaattataatgaatggaactctaaatcataaagccatgtggtaacccagaaaatgcactcgggaacatttcaaagaagggagttttgtggcaataccaggaaaagcataatttcaaagcaagtttccttcttggtcctgcttttctcatgacctgtaggtggagagggaggagtagatagaatgcctgggaaaccagagctgcagaatgtggaggcggcctggccacaatgctgccaactcctttcctgagcaaagctgcagaggataatggcccagggattgtcagggaaagacaggtgaggcaaggaggcaatgaggaatcctctctactttcccgaaaagaaaatagatctccagtttctcagagaaatatcctataagaagactacagaggatgtctgggtttctatcattgtgacttcctttcctagaattctgagcttctgaactatcacctcatatgccatctcttcttctcctagctagagtcgagttgcaaaaacccactgcaatatcctttgaagcaacaaagcatgacagcaacacatacatgactcgctcctcagtgagaaacttgggtttccatagaatttgagatcctctatatgttccatcattttctattaattactcagatatgaatgaaccttttctgttgcggcctctgtgggtgactctgggtgactttcctttctcaaatgtaatattgtatgtagaaggtatattgtgtagacagctagagctatttggctgaaaacagaacctgacacctattctaaccagaaaatttgaatatagatccctactttgggcacttatttaaattctgcccctgtttcttaatgatttttaatgcattatctgattctaggacactgtgaaggtgatctgggtcatcttttgagttcccaaattaatatacaacatttaaatcaccagtgcaatttaaaaaaaaactctttatgaactttttagtctattttatctttataataacttatacaacttatccgggtttatagttcttctttcatgaatttcactcttcccttcaaaccccctttaaaaaaaaatctaaaacactgcacacagcacactgatttaatttctaatccttgaagagacaaaataagcctaaattggtgtcaagagaaagactgacattttagacagatttctttattagtgccttgcaagtaattaaaccatgggatgcagttaggaacatccaaaacagcacactaagaaaatagttttgtccttcaagtaagaagcagggaaaagatctgtgtttcatgttcccagtcacaaatgtttttcctggggtgaggggagctacagttaatagcttttcaggctaaagaggcccttatattttcttttttctttttttttttttttctgagacagagtcttgctttgtcacccagactggagtgcagtggtgtgatcttggcacactgcaacctacacctcccaggtaggtgattttcctgccccagcctcccaagtagctgggattacaggcatgcaccaccacgcccgactaattttgtattttagtaaagacagggtttcaccatgttgaccagactggtctcgaactcctaacctcaagtgatctgcccgcctcagcttcccaaagtgctggaattacaggtgtgagccagctcttatatattcttatatatagctcccttgtttttcaaagacagaaactgaggtccatttccaggactggcagagtagaaagaaaagtagattaggaaaaacaaacctgagtctaaatccagaatctaaccagtcctgtgaaactgagaagccccaggctttgcaggacctcagcatccttaggtgggaaggagagatgctaccttcagaatccttcttcctctgaggcttgctcagtgagtcaggatgtcatttcctcattgatttaacagcaactgaagaactgcagtgacacaggcagtatactaagttctgagaaatctagtgctgaccaggtcctgtgcttaggaactgaagttttcatcaagaagacgaggcatgcaagcattccatatgatgatgcagctcagttttgggatatcattaaacacaggaaagattcaaatataagcaaaaaaaaaaaaagtggtgccttggacagaacgtttatgtgtccctccccctgcccaatgttgaaatcctaacctccaagatgatgttaggaagtggaagactttgagaagtgattaggtcatgaagcctctctcctcatgaatgggattagtggtcttacaaaagagaccccagggagctcccttgccccttctgccatttgaaaaagcagcaaagactgccatctatgacttaggaagcaggccctcacagacaccgaatcttccggcaccttgatcttgggaatgccagcctctcgaactgtgaaaaatacatttctgttgtttaagccacctgtgcatggtattttatcataacaaccagaatgggctgagacagaagagatcatcattataaattatattagtgtataaaatttctaggcataatggatgtgttcctaaagacattaacaaaatcattaattttgtttaagggccacaatttatgaaataaaggaattggaacaggttggggactctcaatatatgatgcatattagcatagactttctaggtgtttggcattagtacgtttaaaaactctcaggtgatttcattttgcagctagggctgagaaccagtggcttatataagctctaagtgctaacattttgtgattcagcatacagatcctatttgacccatgtcattctttacttctagggaaccaagtttggtcttaggccttagggccctctctactgactcctgaaaagtaacgaagaaaagactctatagagtacagtcatccctccctatgttcagggtgaggagtggtggttacaagaccgccaccctcaggatacccaaccggaggatcctcaagtcctttacataaaatggcatagtatttgcatagcatggttgtactatggttttcttcttgaatatttccatccatggttggtgaatcttcaaatgcaaaaccatcagtccaagtttcaattatgaggcattaacataagtgtggttacaagcatggagtctgggaggcctataaatactacaaacgaatcaaataactaacaataggcagaaaaatagaactttataaaatttgtgtttgtaaaatcacttgacgattcgaaggccaatgagtgtttcttgagagttcaagaataaagtaaacagccttatatatatgggtattgtaaaaccattaaacaataaataaaacccaatcttccaccttcacattcttttctttttttttttttttttgagactgagtctcgccatgtggcccgggctggagtgcaatgacacgaccttggctcattgcaacttccgcctcccgggttcaaatgattctcctgcctcagcctcctaagtagctgggattacaggcacccaccaccacactgagctaatttttgtatttttaatagagatggggtttcaccatgttggccaggctggtctcgaactcctgacgttgtgatccacctgcctcagccttccaaaatgctgggattatgggtgtgaaccaccgcaccccgtccccaccttcacattctatagtgttttgtagttgggtaattacattatttgacctctatcaaccctgctccttcaccagcattcctccatctccacaaacatgcaattcactatggaatagttcagccagggattatccaggcaccttcgactctccactcatagtctacctcttatgaagttctgctcattctacctttacccactctttttatatccatggccatcaacttcatttcaacatcatctatagcctagaccagtggttctcaaactttttgttttcaggatcctttacactcctagaaagtattgagtaccccgaagagctttgtgcttatgtagtttatatctctcaatatttactgtatttagaagttacaatgaaatttttcaaataattatttgtttattaaaacaataataagccccactgtgttaacataaatagcatgatttaataaaacttatctttattttccaaaacaaacaaaaaggaattaatgaaaagactggtttgtaaatctttttaatgtctagcttaatagaagtcagcttgttctcaagtctgcttctgcattcaatctcttttgatatcttattgtggatgaagtacatgaggataacctggcctcacaaagaaacgtggttgaaaagggaggaaatttttagtaccttttacagatgattgtggatatatcacacagtctctggaaaattccactggacacttgtgacagaatgagtgaaaatggcaaataactagtggtattaggaaatattttttatgaaaatcgttttgaccttctggatccactaaaagattttcaggaagcttctagggcctctgtactgtatggtactttgagaactgctggtccagactgatgccctagcctccttactgttcccttgcttctactctgcttccattgctatccattctcttctccaaaggcaaagtgcccaattaaaaatacaagtcgcatgatatcaccccatactgctgatctttctttggaccctagattaaaatacaaaattcatcttaggcttctcaaggccctgcggttcttgccaaactttccaacatcatctgtacccctctccccttgttcttattgcttcagctatacttcaatttcttcagaagcaccgagctccctctcacatcaatcttcatgcaagttgttctcttctgccttgaaggttcttccattcctgtctgcctgtttcatcttttggagctcagcttaaatgatttttcctcaaagaagcatttcttgaccaaaagctagaggtaatatcttcattttacaaatcagcaaactgaggtgcaaagatattaagaaacttgcctaatgttcttacaaataataagaccataatttgaattcacatcccactccgaagtccaggtacttaatcattctgctatgctatcacttaagttaaacaaacaaacaaaaagattaaatcttacagagctctctttaacttggtgttaacctctttactatccaaaacatctgaagcaatcatttatgtttatggttaagagagtctggccctctgggcccaagtctcccagtgggtccttaggtatcccatgtggcaccccttcatatcatcaaggctcccggcattcaggcaggaacatccgagccaggagcctaagcccagcacataacaacatagccatgggactgcttcttcagtcctgccctgaagatctccatcagctttccacttctctcctccactctggggactctagaccacacacacagcaaaacaaaccatgtaatcacgttccacatttcttgaacttttcatcagattccctccaacaatagtttcccagcttcctaaccctcagtgtggtgggagataaaagcagattatctgcagtgtggaactgggagccatgtgacacttactcatcttctgattccatgaatctgaacaagtctcattgccacttgaggcttagttttcttttttctaagatggggctatctcagcagactgctataaaaagtaaaagaagcaaaaattataaagaaattctataaatcctgaagtcaagttattattattaaaatttattattatagatgattaatttataggcattttgcatctaagccttctcccactcacagatgcttaggaggtagtcttggaatcacagccctttagatgtggtgcacctttctttagaaaataggaaaagttctgtaattccatgagtaagccagaagataaaattgaaaatatagcatatcaagcgtgtcctctatgtctaacaaggctgttttgtggaatcatcatacaatctataataattctatacatcaaaagcaaatatacatgatgatcatgcattcaaagaagagacaagaaaaaattgatcactattaacatatttccaaagcaaatctacaaaatttccagagcaaatttattctctcaccaagaataaaagcaatgagtttccatatgagtaagcccaggactttttaaaatacaattttatgagacaaagcttacatttctaaagatcttccaaaatattcctattgcttcctcaaatgcagagactgcctcacttcctataaattgtttttctacttctgttcaagaaaaacaaattcattaaaactttaaagacttaatctcgagttacgtcttgatgagatctctgtgggatgaaagaaatcaagagatcacaataactgctattttaaaatgttcctacaatggaaacataatttgttgttgagaatgcactgctgtagagagaaccgaattttaaaaacatgttcaaaatatcagtttaaaccctaaggtgggtttctgaaaagttaggggtcttactgtttttttttttttaacaaaaatcaagccaaatatcatttaattaggctgactttgtagttcagatatgagtcatactttcaaaagagaaaatgtaatcaaagtacttcctataaatgtaaaatatcacctgtcatataaatctattcttgacccatatattggccaaaactatttcaatttataaaaatctaactcatattccataaatcacatgattaaacattatttcacctttactgtcaactttcttcttgaagtttctatttcctacgatattttcttcctctatgcaaaaggatacgttttataataaaaatgttgaatgagtatactgttaaacactgtgcatctaccgaaacaatgtaaaagaatactgaaatattttgaataaccataatttttataacagcagaaacagggactcagaaagataaggtaaatgaaaatcaacaaaatcgggtaaattacaattactactttgatttattttaccatgtagtgtaattctactccattactttttaaagggatcggcgtatgaaatcaaatctttaaattgtaaaaaaattctgaagatctttaggttttaagatagatttttcctgattgattattcttttcatgttctggtttgaggtaagaaactaagttatatagaaatataataaaaacacccacatcacttaaaatacctagatttaggcttaatcaattgctttgctctttccagagagggtctcatttgaaaaatgaaagagtaatattgatgacctccaaggttcgtggccactcagacattcagagattctacaaacacctttccctccttgattatgagtgttaccctttgtctgtaataacttccgagtcaaaacatacatcattttgtagtcaatcatttgtactattgtttctactcaaaataaagctaaaggttggacatgaataagcgtgtaattcatacggatgtactaatagtctagatacaacaaattaagtggcatcaacatttaggcaaatattctagtgtgcctgactaatacagccttttcacacataaataatgactcaaataatgactataagtacactcttttctcattagaaagtgcacaaacagaaatgttctaaaggctttttcatggttcaatgacctcatccaactttccagttcagggtctccaatatttcattttcaaagatctacagtccacacagtgtctaaggggcccattaaccctagctgcctataggtcttcaataatgctatacggtggtcattgctgaagtccaatggcctccttagcctatgccttcttctacaagttacctcttctactctaccctatctctgttctaattataaaataacgatcacaatgataataataataccaatggttaaaactttgacagaagacatccagttatttacactagttgatgttactttctgctgtgttgcaaggaaggtaggaaaaaaagtcaactgaatctagttctagtctcaattttgacaaaacctagttgtgtaaccttagataaattacaaacttgcaatggctccaggatttctcatctacaaagacagagattttgctgcacaaaaaggatccaatgtgcaccctggccctgaaactgtgtgatgtgaggccatacctagtcatttcccatgttttcattctgtgttactgtcattttaaatctgagccctttgccatgataatttcaggatccccactgtatttatacagcttcaatactacacatatcagaacttggttagctaagaaaaaagagaaggagagatactcaatgtgtcagccctgaaatcagaaatacaaccgtggcctttcccatcaaacacttgccttagattcacttcctaagcctcactcccctagaaagtctggtcaatggaacatgtgtctcagtgacagaaattcagagtggaaattctttatcaggacaaattattccacttcaccactttaccatttgtgagttactttgttagttcacaatgatatggcttaggaaggctagtggtttcaagaatcagtcaaatattaagtgaatacaacatcaaagtgattataaaacagattcgaatagtttttctttttggtgtttagcaacttcctcccaatccaactaaagattcttctctggaactgatatgtggaaggtgctatctctctataaatagacttattccatgctatgtgaatcatggctgctgacagcaaatcaacagattaattatttggctttgttagtgaagataatagcacactatcatcttcccaaaatgtttttacacacaccacatgcccattcttctaagctaagcttcagaacaaactgaaatggtatacaaatacacgcaggttgcccttgcactgggaatgtcttaataggtcctgccatctctctgccagattgttattttgacactttagctaaaggaagtcaccagtcaggatcctctctgataagatgaacactgtgtagaacaaaaagggaggcaaattaaacgaacactgaagaaaacaataaactcagaaactgcctcaaatctctgttttctaatgagatgctaaggaagagcccacaggaagcagcaaatacagtccttccttcccatgcaaaatgaagccatgcaaaagtaacccattgatcatctccaagtcaactccagagatcaggatcagtttatgttacccgttcacatatatccacctatcattcttattatcttgttttttagaagaggctgactaggatcaactcaaaaacgtcatataattttcccaactagagtgcaagcacgtacttcagagattgagatataaaagtcacattgagttcagaaccttgaagtcctctgtagaccacataagccctaagaaaagaaggcctccaaattatccctccacaacagaacaggttattttattttccactaggtgagttactttgtagaggtaattcaaactattgcataaatcttcactttataaaatgaacatgctatactaattggacataaaataatagagactaatagctcctgtcttgggatcataattatttttgtatactcctgaaatttaccactttatcatcatcacaaaataagaaaatgagcctagtatggagtggacaatgtcatgaaaacccaacggaaaatgaaacagggtcgcttcttcacaaggcttaaccccaaatttctgagctaattctgagcccgacttgtccagacttcccaagtgtcgcccttcatccaatggacccaaccatgtacttcattgctggaaaccaacagcacgccacagtcagagttgcaaagagacaaactagccaacagattacagggcaggctccctttccagacagtatttccttccagttgtccacaataggggtagagtatctgcagaatgcaaatggctctgcagccacaacccagaaaaccaacagtctgatggaagcacagatctctccgcaattctgcttccattctctcaagctgggtacactggcctggcttgacctggaaatcatcatgtcaaaactttgggtatccaatttccctttgcaagtagagacacatccaaaagcaatcatctgcggtcggggctgcagaagagaattagcttcagaaagcccacgccatgaaaatctctgatcaagctgaagttttctttacactccttgaggccaaactgtgtatactgtcttgttccctcaatgtctcaaaagtgtgagtgtgctaagtatggtaataggacagaaacgttaatgagcagagtccttggaaacaatgagaggggttggaagaaaataataggaaaatgaagactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaattaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaagagggcgtcccctctggggagcccactctccgggcttctactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcact

SEQ ID NO: 2012 - DNA, 588208 bp, Homo sapiens
tgaataatctgtgctttaatggaaaaatgaaacattaatttgtttagtttctcatacaacatgtttactaaacatttcagtgtcaataatttcttaagattgtaacatttaaccttgtattggagctaataccaattctagccatgggagtatgttttggactttttgaacaattttaagtaaaatgaatgtcactgtctttaaattgtacttggagcaaagacaaagaaacatcagctcattctttccaactaatagaacatttaatgatgcaatttttattacattattttaaggctattatcataatgttaaatattcttatttttttttgcttccgtctgttactaaagctcaatacatcattctgaacattattaattttcacttaacttagatttaagtattgaatttttaacttgggctccaggaaaaatcctgaaaaagaaagatcagcatctagcatccttttcctattctttcaccacaaattctcaatttgatatgacttaacatgaaatctgtattgggaagtatagatttctaagataactttttgtaactaaaaaataatttcctgtgcatcacaagggggattaaaaatcaccaaagtactgaaggaacacgtgctttgattattattcccacctgtttcttttttattataaagtggcaatttgtaccatcattagaaatgtacattaatgtataaagttttgcattcaaatctctttatttttgattacctatgactaaagaccacaaatcaaataaaaactcatataatatatccttatttcagaagcatatgtatatatacacatatatatttgtagaacaatccactgttttaaatgtaattttgacttaaaaaatgctatttacaattttatgacagagaaataacctcagccttttatggtattaaaatgagcagggaatttttatgtttgtgtctcatcttgtgcagatgaaattaagcaatatcatggaaaaccttctcaagagcaaggccttgtagactaaggtatgagggtgaaatcgatttgctatttctgggtctatgtttttaaaaaattactggcaacgtagtcatacttacttcttcaccaagaaatcagtgctcccaaattaggaattccaaacttttcaatatgcaacctttaagtctttccttgtccttactcttgtcttaatactctcatctcccactagtggcaccgcaggactaccaatctagatattagattgttgctattttattaaacagaagagtcttagttcttttaaacaagctttctgaattagaatgaggcccataaagcatcacattgcattacattgatatctctttattgcgccaatccataatggctaaaaatgtgctattaaattgtatgtaaatttcaaagccaaaacgattactatgagaataggatggcttgctgccctccaatttgcggaagcacaaaagtctctgaattagcaaatggaacttcagctccatttgtttctatactttattctgcgagcttaaaaatcaagtaaggtgtattgaccagaaagctattttgtgagactctcaaaagttttgttttcattcttaagctcgttgattttgaaacttattccaataagaactcagaataaacatatcttaatttatatctgcgtagccaattgcaaagcattactaaaagccatattttttcctgggaaaaatcccaatgcaactccaaaaaaaaaaaaaaaaaaaaaaaaaagcttattttacttaaaaaggaaaagtgacgaatgaattgaagacccagaaatcagaacaatgaaaatcaaagaattattatacttgaaataagcctgaaaaacaaagtacttaaactcaaccatatttttggatgaagttggatattatatgtttacacatggtaatatttttaaaaactcagtgaatactggcatattctattaaagttttcatgtacttgagaagtaagcaggagttaagcaaacattcaccctttgctctaagctacattttttgtcaggtttatgtgtaaaagaaatcaggtttccaattaattctctgaactaaactggaaataagacaaagctaatttccaaaacattttactgcagtgaacatttgcttaacataatacggagaaaaacaatatacaaattgtgtggttagaattttttcttaactgctatcaggaaggagacaaatgtgagtctagatgataaatgatgaatagccactgaaaatggaggaattttgttagtgattcatatctctatttttttcataacaaacttaattaaatatattttgtcatgaaatcataattgtaattgatttttatgatttgcatcaattgtgttatttatgaaaccatcgttttactgatgagtgtgtatgtgtatcatcactacaaaagctcaagtcatttcatgctaaaagagccagtgtcccatagtgttgaagtttcttttttatttttttcaaataaaataagctttgtgcttgggatttttttctttttttttttggttctggtagtgacaggtgtatttataatcaagttgaatcaagagtgacaagaagaaatacagctagagttatatttttgccccaggggtattcttttcctagaagagcaagtccatttttagaaaatttaaatgtctttatttgttactttccaaatattttggttaaacaaatatctcttgcaaatgtatcttcaaaatctttgcctacatgcatacaatttgttcttcccaactgcttagggaaattccttcatttcattttctgctaacctctagataacagaaataggatacctggtgaaggatatggtccactattgaagaataatgattgtgtaaagtgagggaaactatattgaccttgaaatacggcaaccaatggcaaggtttgaggtgagggcctagagcttctgcaaagtgtatatattttagggagtcatatttggaacaatacatgctggacagtagagatataggagaagttacatgctatgtcttctcattgataatatccataaatctgcatacattttttaacattctgttttgtgtttttttttctttaaatttggatgtctctacaccactcctgatttgtaggactaaatagatctatttattccaatgcaaattgtgtaacatttatttcttccttgatttttaaaaatactttagtattcttaactatgtatgtgccttctcttacactgagttcttttttgctcctttcagctgctcacacaatcctgtctgttggagtcatagctgctaattccatattatttctctacacaccttgaaaatttagtgtattactggtacccttctgtgttctaggaaacaaatgaattgcaaactggacttgtaacaggatcatacatagagcaacaaattagctactggctttgtaagatagtaagttaggaatttcacagtcatgtctccaaatttcatggcagagtttaaaaaacaatataagactgtggtaaggtacaaacgcaaatgcaatttgcgttgactaatttcctaggacttatttccttatgtaaaacccctgttctttctttcctgccacaagacagggtacaaagctttctaaaacatgctctcaggtgtccacacctgagacattgctttgtggatactctcaaaggtgtccacaaagcaaaaaaatcagaccaaatgctaagagcaagtaacttatacctcaccacctggacatggcactggcaaaagtcacttcagcattagaacagtaatgtttttgctaaattactaaaaaaaaaaaaaaaagaaagaaagaagaactccggaaataatatctttgataaaaatgttatactctaggataatttgaaatcatttttgtgaaagaattaaactcattaaggctattcgatgccatacaagattttccttttacataaaacaatcttaaattacatctcaaaaataatttcttacacttttcttgatgataaatggttcctggctatatattttataggtattaacatagtttataatttggaaatgttcaatttcatggttacaaaaaaaatcctgcaaacagaatgtaatggtgtgtcaattccagatgcccaaataaaatacaaaatcaagcaaaaccacacatcgcagcattatcatgagtttaagctattgagtatataacatcagtttgtgagttcaattctccaaatcctttcctttaaagtaataagtttatttcatctttattaatgtcttcattacaattagccttctactaataacaatacagtttaatttaatatttatggagttctgatttattttttcctttgcttttaagtgtgctaatctttgtgcacgtgaattttctaccacattgcaacaagcaagctttggttcaattttcttgtcctacacaaaggaagattttgagtgcagaatcttagccactaggtcttgcgttgtcattttattttcctctccttgggtggatttactggaaggaaatgggtaaatgggaaggaagggaaggggaagggatgagagagggaagaaggggagagttctcagctatgttgaatcttgattcacaactttgcctccattcatggttggtgttccagaacttttccttgaacgcccttgtttttctccaatttcatgtagcgatggttctctgtacatacacactgaaaggcaaaataacaaaaattacttatgacagtggacataaatttccttcaataagcttttcaaatttgattttacaatattcttcactctcatcacaagctcttcttctcattataaaaaaacagttttaacttgataatcagtgaatacacttaattttctttcagttctttcagtcacaaccttttaaacttttcttgaactgcagacatttaagtaagttgtttctgttctctcatagataaggcttgaatctttacagtttcctaacctagaaaagaggattttcatccagagtcagaggagacatgggaaatatttcgctttttggtccttagtctgcagtctaattcgggtaggtaaaaaaatattcatttacatgttgctaatctttaccctaccataggaaatataatgtatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaaaattgcatatttatgaagattaaatgccttgcatagagcaagtaccaaaaaatgtttatgaaaattaaggagctgatttctttgtgagcattttgaataacagatcttcagagaatatagaaataaattgttttggctgaaagtattctaaatccaaaactagactaaaacagaatttagaatacaagtgagagtctcctgagactggttcagtgatgaggagacagatttcttccaacatattctattacagaacttcttaaatgttaccgtacatgggaatcacctaggaatattgttaaaatgcagattatgaatcagaaggattgtagtgagcttgagagtctccattttaaatagatctcaggtgatgttgatgctgataaaacccagactacactctgagtagcagaaaatatatgaataaaatatgtgtgttaaggctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatccttagggaatatcttgccagaatcttgaagttccctaagtctaatggtgcttacctctctttctattataaaaaaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaaagtgtatatttttatcactttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgagcggtattgcaaattgacatctgaaaatatacagtgtttcaaaaagaccaaaagtcaccagtgccacagcaagatgtaaaatttgctctttttctcatacaactcattttctaatttcccaatctttgcactaaatggagtaataaaattaacggttttgaaaacctagttcatgtcccagttagaaaacgacaagtaaaaggtaggttttccagttcactgatgaaaactgcccccctcctcaataaatcaaataggtatttgaatttctatacttctgttaaccaaaataaaaagatgttcagagaaagcaaactaaagttattctagaaactgcatgcaaatacaaatacggagagcaaaaccttggtcaaagcaatagattaaatgtaatttcttgagcattaattttcattgttatttacaggacctaggattcagtaatatatctaagaagctgacaaatcaaggggaataagtctcaatcaaatttctgaattacaatataatttaaagaccataatccaattagaaagcaaagaaagaataaagtacctcccttcagtaatataactgccttactaccatccatagttgcattaacgcttaatgactgctattctgaatgtacatggtaaataatgaaacaaaattaaggaaggaaacaaggcgtaagtgttctctaaagtgcattatatgtgcaaaacgtaaacgaaaatcaccatgatgtatatagcagcctcaatatcatttcagagtattcaaagcaattttaaattgattaactaaattttacaattataacccagtgaatatagtaggtgagaaattatcacccccattttttttaaatataaaagaaattaagccacttccataaagtcagagagtgagtagtggcagggccaggatgaatatttagggtttcaaggtcctagttaagagttttgaataaaatcagaaataccataatttatccaacaaacaatgtaaaatgactgacatatcagtgtttgaattcttatgtctgtatgttaatcaagatttaagttggccttaacttcactaaatattcctaaagtcattcagaaatggtaataaaagaaaacatatggctgttataaacaaaatcaaaaaagaaagtaacaagagttggtgagtatgtggagaaattgaaaccctattcatttctacttaaatgtaaaatggctcagccaccgtggaaaatgaaatggtgattcctcaaaaaattaaatacggatgtaccatatgatccagcaattccaactgtaggtgtacactcaaaataaatgaaagcagggaccccagcatctatctgtacatccatgtccatagaaggattattcactgtagccaaaagatggaagcaccaaaatgtccattgacaaatgaatgggtaaatataatgtggcctatacatataatgaaatattattcagcctaaaaaacaaaattctgacacatactacaacatgaatgaaccttgaagaaattctgctaggtgaaataagccagttacaaggagccaaatattgattccacttatgtgagatacccagagtagtcaagttcacagaggcaaaaaatagaactgtacttgccaggggctggggaagaatggggatttcttatttaatgagtacagagtttcagttgggggagatgaaaaagttctggagttggatgatggtgatgtttgcacaacaatgtcaatgtacttaacggcaatgaaacatatacttaaaaatgattaaaatggtaaattttgtattatcatattttaccacaattaaaaagcaaacaaacaaacaacttgtcctgaattgtcctgagtataaggtataagaagtgactattaaagccagaggtgttccatttgcataggaagagccagcaattccccaataataaaaaacattagttttagaactgtattaaggaagagggagttgagatataactgaggaggtacagggcgaggaaaaggatagagaaatctgatgaaaatattctaggactgtgctgcctagtatagcatccatttagccatatgtggccactgagcacgtacaatgtagctagtcctaattcagatgagacataagtgcaaaaataaacactacaggactgggtaaaatagggaggtgatgacgaataagaaggataaggctaatttgtgtcagagcttgctgaattccaggccagaaaatttaaaccgtgaacatcatatatatcaggctcaatatgatagcaagtgaagagttaatatacttagttaattaagtgatatgatagcaaatgaagagttaacgtccatccgacatgagtgtataaagaaaaatctattaattcctttatgtagaaaaatgtctaggtttacgtgatatggatacaactagtcagtatagtcaagaaaaatcattcaaactgaatctcactgagtgaactctgtaaggaatgactggcagcatttgaaccttttttttattattatactttaagttttagggtacatgtgcacattgtgcaggttagatacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtctgcatgtgtctttatagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacgtcctctccagcacctgttgtctcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatttattaaatggggaatcctttccccattgcttggttttctcaggtttgtcaaagatcagatagttgtaggtatgcggcattatttctgagggctctattctgttccattgatctatatctctgttttggtaccagtaccatgctgttttggttactgtagccttgtagtatagtttgaagtcaggtagtgtgatgcctccagctttgctcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgacattgattcttcctagccatgagcatggaatgttcttccatttgtttgtatcctcttttatttccttgagcagtggtttgtagttctccttgaagaggtccttcacaccccttgtaagttggattcctaggtattttattctctttgaagcaattgtgaatgggagttcactcatgatttggctctctgtttgtctgttgttggtgtataagaatgcttgtgatttttgtacattgattttgtatcctgggactttgctgaagttgcttatcagcttaaggagattttgggctgagacaatggggttttctagacatacaatcatgtcgtctgcaaacagggacaatttgacttcctcttttcctaattgaataccctttatttccttcccctgcctaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctcctcgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttatgtctttgttcttgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaatgggtgtggtgtggtgctgaaaaaaatgtatattctgttgaattggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgtgagtctaagtctctttgtaggtcactcaggacttgctttatgaatctgggtgctcctgtattgggtgcatatatatttaggacagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacattgaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgtcttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgatacccttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagacgctctgcattttagagtttccagtttttctgttctgttttttccccatttttgtggttttatctacttttggtctttgatgatggtgatatacagatgggttttcggtgtggatgtcctttctgtttgttagttttccttctaacagacaggaccctcagctgcaggtctgttggagtaccctgctgtgagaggtgtcagtgtgcccctgctgggcggtgcctcccagttaggctgctcgggggtcaggggtcagggacccacttgaggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcacggtgcgcgcacccactgacctgcgcccactgtctggcactccctagtgagatgaacccggtacctcagatggaaatgcagaaatcaccggtcttctgcattgctcacgctgggagctgtagaccggagctgttcctattcggccgtctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaattgaaaggtgaggttcatttgggcgatctaaaacatgttcttttgttttgggggggagcttaagaagcctaaacaaacaaaaaataaattaagaattactaatgtcattgcttctggccttttggctatgaacaagtatggagaattactaataccacatagaaaatgggaatcacatgtactttatagtaaaatttattcatgatcttatataaatatcagcactagaatttggagttctgctattaatttctaatcacatactattaagcatttaggggaaacctttagcaagtatgtccagagaactgtctaggctctgaccttcaatagctacatgaattctacaactcttaaactgtggttctcaaattattcttatcctatgccagattaagtttctctcttcctaataatcagatccttattattaaccagaaagattcctagtcccttgatttgtagtagctcgaagtgcaatgtatttcaagagggactttttccatctctttctgttataatgcgcaatattatttcaccaggaatagatttgccatgctttaggaggtgctagaattttttttaaatctcttttttttcttcaaaaattattttcctgtttcctctgtgttatgcactggaggccacttcagctatgagaacaaaatttgatattttagttcttatgataagcagtaatttctagactggaaataacatgaaaacaaaacaaagaaacagaaactccctatctttcttgtcttcccagttccccaatcctgttccacaaaaactcagattcagtggcacttctcatatgaaattggaagcaaatcctctaatttagacaatatgggatgttactagttaactatgtctcactcaggaccttggggcaacacttgtgatatagattttattttcagcaggtatgatgttatagatagtacttagtataaaactgatttaaactttgtttctctctgattgcacttgatactatttttccaacacagtttcagtacccaaatttcaaggatgttcagtgtcctaaagatgcaaggcctgcaagataaataaacaatgttatttccctttcatctggcctgcaagataaataaacaatgttatttccctttcatctggcttttctgggttgtccttgatcaagccgcttgccctctttctattcatttgtcaagtacatagagtaggaaaagaaatatttgcttccctcaccccaggatatttctgagataaaatatcattgctcctctaatgcatgtatcatcataatagttttggacaaatggtaaaatacgatcatgttttgaagaggaagcatttctttttggttcttctgtactctttcttcaaatcaaagcacactcttatttcacttcttttcttcttatttttcctctattctgacttacatttcaattttcttccttcttcttaatgtttctttctattcatgcttttgacttttctagagctatcgtagattgaaacggagagatttaacccagctttctgagtgaaaataaggtagagatttggtgcgagagtgttcctccttattttcagacacaaggacaagcaggtttctaataacacagctcacagtatgtactactttaaagcacagtatttactagaaaccagtttaacccttgaatgtcagcagaatgcacttgtgagatagacagtagttaccaggtgacccagcacagtgaaggttttgattttaacagctgtctgagcatgcactgaccatgtagccatagaaagccctgcagttctggtaacacaaatacaatgcaacacttggtcagaacaggaccataatatattgactctgtgatgatatatggtatttgttctatttatttaattcttgcttcattttaaagtgaaaaatttacacttttagaaaagagaaatgtgaaatatatatcactgagctttgaagtattgtcaaaaacaatccattttctctttgtaggattaggtatggattttttccagggcaagctttctatttaatatttttctattacattcttttcatgggtgcctgtgttgcaaatgcagttaccagaatatgcaggctttccttgccatcgtgatggctcagattcccctatttacaacttctaacattcaacaataacttctattttagttataaatttcttctgaaaaaattacaatgaaacaaagactttcttaaaagtatgaaaaaagtaaaatcttgggcattgctgttatttataaagcacacagctataataaaccgggtgccaagtaccatcctatgagtactctcctattaagcattagtcatcctcataataatatctaacgttaactgagcacttactatatgcctgcacattatacatacaaacagttttttaaatgaccataaaaatagatacttttagtggcctgttttgcagctgagtaaactgaagaacaaagagggtaacctgtccaaagtaatatagcaatacagggcagtcagctttaaaatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttcccttttctctttctttctttctttctctttctttctttctttctttctttctttctttctttctttctttctttcttttctttctctctctttctttttctttctttctctttctttttcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttccttctttctttctctctgttttttccctccctccctccctcccttccttccctccctccctctctctctctctttctccttccttccctccttccttccttctccctctctccttcttattcttcctctttattttccaagacaataaactgtctgactttgcatttcacttagaaaggagaattagatgagaaatgttttcatggcaaaaattaccaacctatggacatctgcccccacgtgttctgactcctgcttgttacaatgcttgcactgtgcagttcttacctaaatctagagcgccatggtgcactcagtcccagcccttctactcagtgttctttggtgtccctctctcctgtgatcccaatgtctgcttatcccagattgttcccatcagtatatgaatgtatgaaatagctttaaaaacaaagaaccctaccatgtaactgtcatgtttctcaccagctccctcctcatttctctacttcctttttatagcagcagttctcaaaagaactttaatattcaatattaccttcttcttttctttgcctccagttatcatttaattctttccattcagacttatttctcactgtttcaccaaaatcactcatgtcaagtcactactgaccacgagttacaaaagcaaagatcaattctcatttagcagcttgctagacactccagcagtgttggatacagttaattatttcctcctttttgacaagatgttttcacttggcttcttgaacatcaatcaaaatagcctagtctttctgcaaatcactggctactctattttattctcctttgcaggagcctccttttccaataaatgttagtgttccccaggagtaagtcagcaattacattcattttcttagcagtgtgaagaaactagggaagtattctccccatttcttgtcacaactatagtgatggaggtcaaggtggtattactaatattctataatgtgagaaagttccacacaatagaataatttttccaaacaagatagtctccccatttgaaaagtagtcatagaacctagggcagtggttgtcaagcggtggtgaatttgccttcagtgaatctttcgtaatgtctgagacatgtttgtttgtcaccactagagaggatgatttgctattggtatcctgaacatagaggctatagatgttgctacatatcctccaatgcacagggaagtgccccacaacaaggaattatagaacccaaagtcccaaaatgtcagtagtgtctgagttgtaataaccagtactaggggattacaagtgattttaaaatgtcatatttaagtagtgtgtgtgtgtgtgtgtgtgtgtgtgtgtgtgtgtacacatttcagcacacagacccattattcgcccagttcatcatgcctaacacctaaaagtcatccctgatttctgtctttatctaacaacctacatccaatccattagcatgctctatcaggtctaccttcaaaataaattcaaagtcattctctctacctctagttataaaaccctagagtccaatctaatactatcttgcttaagatcctggatgatttcactgcaattctgctcaaaatctataatgaatccccatcacattaaccataaaatctaaagtcctgaaggtggttacaagccctcaatttatagtctttcctttctctctaagttcatctcctaccttccattcctttaatcaatccattctagtcacattggctttcttgctcattattaggcatcctcggagtctataaaagcctttggaatctctcagctttgcctgcaaaaaccttgtgccacatctttgcatggtttactactaaatttcattcagattactgttcaaacatcatttacgtcatcttctctaaaaaatttaccttcatcatcctttttaaaatagtcccatatttttttcttggaactaatctctagtgatgttttaaaatgcttgcttatttttaattgcgtattttttacccatttctagacataaatgctatcaagtcaaaattgtctttccttgagtactaactgtgtccccattagtacagtgaaagacgcttagtagatgtttcatagttatgttccaaatgaatattcctatctactatgctacagtgactaactgaagaagtctttggttggagtaaagctgatttttctttcacctttaaagtcagtgaatctttactttatctaaggtcctaaacttgggctgagttccctgaaactgaccaatataaaggtaaaatagatgactttgacacaaatggagcaaggaatactatacggtagacaatatttatcaagctcctttagttaagtgatatttgaataatcaaataataagcctcatcttcacagaaataagaaaaatcaatgaaacagaaaataaaccaagaaagctgacgaccacccttacctttccttgtatatatggtgcattatagagtctagaaaggaaagagattctaaggatcattgcatcagacagttccctaaacttagtgattgtcaaggcatgacccctaaccaccaccaccaacagcaggaacgttaagaaatgcaaattatttggccagctcaaacgtacagaattaaaaattcaggagatggggcctagcaatctatgctttagtgggctctctaggtaattctgatgcacactcaacttgtagagttgctgtccttaattcttccatgagaaatacccggatgttctaagaatacacatttgtatctatgtcttgcctctgcagattctaattcataagaagttacacacaaatacacacacacacacaactgattaagtaactaaattgaataactttaaggaatgacaacgcctatttacacacacacacacacacacacacacacacatcacatcacatttgtagtaggaaaagcatgacatctgaagttaccaggtaacaattctagttttgcttctttctagctgtatacacctaagtgagttaacctctagaaatgacatctttctcgtgtttaaaatagggatagtaaatcttaaccttcatacttccaaggatttagtggctattaaatgatactttggttcagaaagcatgttgaaaggacaatatgccattcaaatggaatataaggtagtatagctgctactaattatcactttatattgttgctgtattcttgacagatcctttgaaatttgagagtgctagcagtaatttttaagtgtcaatgtcactctgtagtggagagttgaacaacctgtgtgtgggaacactggagttgttctgacaaattctgttttccaaataaaaacaatttaacttctgtttttaataaaactaaaacattaaactctataaagaacctccatcgactactagttaccatcaaagacaaatgaaatatgattaatcattttattactacaaatttaattgaattttccttggtcctctgtaatttccaagaagctgaaaggttagactgctgtgttagttaatgcaccattgaagatacttaattgtcttaatagcagatcatagaagggtgtgggaaatttacctaaagcaatttcacacctgaattaatgttacatgggatccttttggaactctgggagaattctaagtgctagtttggaagaaatgtattgccttagaaatgcattcactgtgctatacatatttactataatgagataacaactataacgttgtgaacaaaagcgtctgtatgttcgtttagaaagaaagaaaaagcaatatttgcaatgagggacaaagagagagaaagaggaagaatgtgtggggaagaggtaagagggttgtattaaagactacattcagaaaccagaaaaaactggtttgaataagttacaatggtttgcaggaggaaagtatcacaggctggcagaaacccaaaacacaaaagaaagagttgcagctattatcctttctgtaattaaaacaattactggcagagaggttcttttttgctccatctttctgcttttgtctttcagtatggttgggtccaaaagagaaccaaggcatttatttctatttccagtttattgaaataaaaatatcaaatttggcattagtgtccaccagttggagttttaaaacatcaggactcctgatttgctctgttctttggtgtcttattatgtagttttgaagggattgttattttccttccagattccattttcattgcctttaatttctcatgcaatgccacatctcacagcatttttccaatacaaaacacagtaagacaatgtccattttctaagacaaaatgaaaaaggcatttcatgtttgatctgacagaattctcttgaaaaatccaacttttttttacaatgtctaattttcatattattcctttgaagcaggtggaatttataatagactttatcttcagagatgactgaggtagaaggagataaattattttctcaaaattacttagcaaggctgctctgcctatggagtagccattcttctgtttcttgacttctccaatacacttgctttcattcaaacaaaaattgcttagcaaatcattgccaaattttgacccaaagaattagacacttctgtattcttggttacttgatttctattaggttgctctaagaggtgtcaatttaataaaataattggcattacctctactgacttcatataggaatttaaccctggactaaaacatacctgtcttgatagtagtagggaatgtaaaaatgtaacatatatagtatacttaatttcatgtcagagggacaatttatattacattagattcagtccaatatattgatcacaataatatgaataaatttaaatcatccatggccagatttgaccaaaaggagcttagaaacaccaaattcagaacactgcatctcaaactcaatgccatcagaaatcccctggacagcgttttaaacctatagagtcctaggtcatacataggtttcaaacatcagatcactttggagatttgctctgagaatctgttagcttctaggaacactacagatggttctggtactgatgtttgggaaatgacagtttacattctgctgagtcttaaatcagattctatgagcttaaagcaccaattctaacaaagaaaatggaaaccatgtatatggccaagtgtgtgtgagtgtgtgtgtgtgtgtgtgtgtgtgttagtactgtctccccactaccaaataaattgggagaaataaatcaatattcctttattccaagtttaatacttctgtatggatggctctcaaatgattcttagttatcttatttggaaatatatttatttctccaggtctcagctcttgaagcttaaatctttgcaaagtacacagactttttttttcagaagggaagaaccagatcctaaatactcagccacctgcagtagctgagcaatgtgcttcttgaaggaggagggaggagaaaaggaggagactatattttgttctttgtcaaagagtatttgactgctatatctgatgctaaagggggaggtcaccactaaaacactttacatctggggaagttacttatctgtgctttgaacaatactctgaaagggcagaattgagaatcaggaagcctgtgctattgtccaaaattccaggggaggggacccatgtaagtagaggtttatatgcaatgtacatagtaatgtgcttaaacatcaaggccatctatcagaataggtgaccctgaaacccctcatcaacgctcctgttctctaaacacaggatgagacgtgaaagagtgaagggaaatgggctggtgggtaattattatcatgttatcagtgtaggacttaaccatcctcaaactggcagagcttaattttgggaatcgtgacattcaaaagacaacaccagcaggactgggataaaggcagacatatgtgaaaaacaaataagcaggaaaaaacaaaagaacaaaagcaaaacccaaagccaaaaaaaaccctactttggcttttcctccctaagaggacaattcccttcacaaaggaagggctcatttaccgtgcagtgctggactctgttaggatgttaacagtattaccattggacttacagggttacaaagatgcctttaaacattacaaacaaaatagtcaataatttttttggttaacccattagcagcaagttagctaatctcttatgctatcattttctaatcgttttctaaaagtgtcatctagttatgtgctttatacctgccctatggaaaaatattatcgaaaactttatttatttatttattcacttatttttgggacagaatctttctctgttgaccaggctggagtgtagtggtgcaatctcagctcctggcaaactccgactccctgggttgaaagtgattctcctgcctcagcctcccaagtagcggggattacaggtgtgtaccaccacacctggctaattttcatattttttagtagtgatgacgtttcatcatgtcggccaggctggtcttgaactcctggcctcaagtgattcacctgcctcgacttcccaaattgctgggaatacaggtatgagccactgcgtctgtcctaaaatctatttaaatgtaagttatggctaggatgcctttcatcctatcccttcattaaaaaaaaaaatcacaaataatggaaatagctcataaagctgtaatttattttttcaataattcaataaagaaaatatgtttagaccagttttacatgtaaattctaggctaggttctatgaaggaacatggttttacagtgaagggcttataacgactgccacacaatgtcattgccaaagaactttagaaatcatctggtccaatttttttttttttttttgctgagtggaaataaaccttgttagaattcaccagaaaagaagtgatgcattgttaattctttcttgcctagcttgaacatggcattccattaactgttttatctgattgtttaccaatgtgtttctcatcatatcatgtattcctgtctcaattttgcatgatttaaaactagtttactattcaaattgcatcatagtataaggtttctgctttgctatcactgacttttctgagtatttgcatattcacaggcttacttcagattgaagggcaacatagtacagaggttacgtgacatcagggttcctggactgcaaccccagttctgtatttatctagccctgtggtcttggactggttacttagttactttaaattacgtttcctcatctataaaatgaggataaaaatacagaactattgtgaggcttaacagagataacatacgcaacctggctagcaaatagtaaattgataaactgcatacagaagtagtaagactagtaatagcagtaatggtggcagcaaaaataatttgagtatcccagcagcgaggagaaaggtttcaatgtccagtggattaatgcctgacacaacctcaagtgtacatatctttgatagtaatggtaacctgttaaaatcatttaaggatataatgtataactgcatggagaatcataaggtaattgttcacattttctgtattataaggacatcaaagcacataggaggcagaagagaaccaaccaatttcatgtgtttcatgtcagttacaagagtgtgatgatctccattaatctgcaagaacttttatttctaaggggtagggatatattgcagatttttaaaaagagaagcaattaggagacatttattcaagatcatttactaggtcccactatattgaagttacatctacatctttctcagacctcagactgtagcctgtcttaccagttttaaatggggtttaagaacttgattgttcaagtcagaatgctttggtttcatttctggctttgccaattgctagctgcatgatttaggacaaattactcaatatctctgtgtttcatttttcacatttgtaaatgcggataatactggaacctacttcgtacaaatggaatggaaagtaagagacagtaattgagacgtgcttagaatagcacctgcacagagtaagcatttataaaactgttagctaagattgttcaataaagttagttccctaagacaaaagataaagacatttatagggaatgagaaggtgtttggcctaaaaccaattaagttttttttttcatttttggaagtaattatcatcatattctatatgcttcacacctagagagacaaaaatccttggaagtgaatcaaagtattagtgaatctgatttagaatgcattttttttcccagaacaaaaagaaaatcattctaaaggatcagtcaataacataaagtaaaaacacgataatctaccaaaagatgtcaatcagaaaattaggaaatcagagatattctaaaattaagaggatggaagcctgaagcagagtttttagtgtctcaatacccattgtgccataacccctagtcacagaacatttatttggtatatggctatcaaaaaaaaaaaaaaaaaaaagactacattcttagcttctttacacctaagtgtgactacctgactaggttgtggccagtgcgataagtagcatatggcagttaccatggacaacttggaaagaaaactggccctggcttttccttctgtcttcttcacctctcctctgccctctggctggaataagatgctggttggatcatgggcagaagggcagatccagggccagcatgtgtggttgtgttccgggtgcagtgcacagttgtaaataagccgtagcaaaacactgggagagaggtagtaaaagctggatgcagccaaggccctaccaattggaaaagcacagtaccagctaggatagctggtctctagatttgttttgtgagagaataaaaaactttatatgattaagctgctgttaatatgagtttgtgttgtgtgaagacaaccttaattctaatccatataggaatgtccagttgtacacgtacatgctcatccagacccaagaggaaacttgattaaccaaagtacagatagcagctaaaattaggagggtaggttataggtatatatatatatatatatatatatatatatatatataaaatttttttttttttttttttttgagaaagaatcttgctttatcacccaggctggagtgcagtggcgtgatctcagctcactgcaatctccacctccttgattctcctgcctcagtctcctgagtagctgggattaccggcacgtgccaccacgcccggttaatttttgtatttttagtagagacggggtttcaccatgttggtcaggctgatctcaaactcctgacctcgtgatccgcccacctcggtctcccaaagtcctgggattacaggcgtgagccaccaagcctggcctaggtgtatttttaagtggggtcatgagggtgaagttgaatataaagggcattatccgtaaagggaataaacacaacacgtggatttcttttcttcatactttcctaaattttccaaaattgttaatgaccttgtactacttttataacaagaagaaaatcaatgtaaatgaacaaataaaaatgatgcaataattaagagcataattcatcaaacatttcatttttgagaatccatatatttccctgtgaaaatattacttacttctcaggtaccctttgcttaaccctaagaagcaggcactttcctgcctttattcacactgcacctggaatgtttttgtctgcctaatccctacctctcatctcaaattgcaggaacctggcctagccctgaaggtaagtttaaatattagcttctcaatgatatcttactttttgggaaaataatagcctttttctctgagtcccaatataaatcctatatattgcatcacttaacattttacttttgctctgagtaaacatatgtcacacctctaagaatatcataaagttctctggcgcatatattcttctttgtctttatagttttctattcattaattcattcacatgttcacttttcagacaactgattatcaaatatctctctatgatatgccaactattatagaagacaaagggagatatgaagaaaaataaaacatgttctgttcattcaaagagtgagctaaccatgaataagaggagacagagtggcattgggcaaatttaatgtcataatttctatgggagagaaatgtatgcaatgacaagctgaccgaatgtttagttctacttgaagaaagtcaagaaggccatcatggaagtattgactcttgaattatttttttccaaagactaatagacattttccaggcagatgagataaatggataaaaactaaaggagcaggggtgatgaacaaaatgagcccaataagaatgaaaataggccaggcatggtggctcacgcttgtaatcccagcactttgggaggccgaggtgggcagataacctgaggtcaggagtttgagaccagcctggccaacatggcgaaatcctgtctctactaaaaatacaaaaattagccgggtgtggtggtgtgtgcctgtaatcccagctacccaggaggctgaagaaggagaatcgctggaacccagggggcagaggctgcagtgagccgagattgcaccaccgcactccagcctgggtgacagagcaagactccatctcaaataaataaataaataaagtgaaaatatactgcaggaaagaaaagttcatttcatgtgctgaatacacagcatgtgaagagggtcctgagaggggctaggggctttgaatatcacatttcatccagtgcttggaacattggaagatagtattgacttaaatgtttgcagtcaccgtgctatgtactatgcaccaggcattgtgtacactgattgactgaccatgccatatgagatattcaggggacagcaagcttgactaagccacagagttgcaatgcactgcctcaattttctcatttcctcagacgaggatgctgagccaatgtttaaagtgattataatgtgactttcagaggagaaacaagcttactcagcctgtagtagaaagcttggctgaattcaggaaatgtggttacccaaatgatatgctctcatcctagctaaggaatttctgagggaacatagcctagctgccaaaaatcggtttcctcagaaaaaaaaaaacaaaaaagtttattctaatggtcagtttgaaataaatgaacagagaattaaatgattacgagagaaaaggttataggctcacctgagaaggatacagtgcaatacggtaaatataaaagtatcatttgtttttcaagggtgtatcttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgcctcaaaagaaaaaaaaaaaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgagtcccagaaaccaagctcggcctgattcttgctggcggtacagtgtggaagaatagatcacatagtagttttcaaacacagattccttgaatttgcattctggagtgaaaacatcctgtaggaaaaaaaaaaaaagacacaaaaaagagaaatgatttaaaggtgaatcagcaaatgcttaaatccaataagcttgaaatccatgtcctctgttaagaacaaatgaaaggcaatgacacatagtttctattagcctttggttacaaagattcatcatacaaaatcaaaaaacatgattgcctttctagccaaccttcagcccagagataataacttgctcaggcttgaagctacgttaaaatcattcaggactgtggccaagtctgcgctccgatcctagcaatatgttttgtaaactaaagtgattggccattcctcatttactcacccttaacatgtaaataaggaactaaaatttatcctggaaatcaaaatcaaatataaccacagcaaacacaggcacacaaggtgcttttgaagagactattctgtatatacaaatgtattacacagccacagcttggtcaggaaaatcaccacttttcctaaagtcagtaacttcctctctaatttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacattatagacgaagaaaaatgagactaagaaaactggagtaggctggggtgtggtagcttacctctgtaatgccagcacttcgggaggttgaggtaagcagatcatttgaggtcaggagttcaagaccagcctggccaacatggtgaaaccccgtctctactaaaaatgcaaaaattagctgggtgtggtggcagatgcctgtatttccagctactcgggaggctgaggtgggaggatgacttgaaccagggaggtggatgttgcagtgagcagagattacaccccacactccagcttgggtgacacagtgaaatggatctcaacccccccttcaaaaaaaagtccaagaaaacaccccccaaagaaaattggagtagaaaggtggttgtagatagtaagataatatgaatagcaataaattaatattatgtttatattaatactgaaatatgatttcttagagtactttgagttttaagtaaatgaactactagcttaagaatcaaagaaacaaatgaccatgagatactacttcacatccactataaaggctatagtttaaaaatggacatgacaaagtgtttatgaggatgtggaaaaactgcaactcacatacattgctggtggaaatgtaaaattatgcagaagctgtggaaaataggttggcagtgcctcaaaaggttaaacatacagttgccacacaatccaaaaattccacttttaggtatagttctaagattaatgaaaacatatgtccacacaaaaacttgtgcacaaatgttcatagtgacatcattcataatgtggaaacaacccaaacatctatcaagtgatgaatggataaatacagtgtgatagttctacagaatgcaactgtaataccattcaattataaaaaagaatgaaatactgatttatgtggcaacaaggatgaacctcatacacattatgttaagtgcaaggagccagatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaaagtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttattatttttttttctcgatctagtccaatactagcaaacagtattaaccctagatgctatgctaaggaactctggaaagttcaagcaatacattcaatgtataagatttcagactttataaagaagttaggaaaaaaataattcctgttttgtgtaagtacatatcgtcatatatgtagatggtgataaaaccttcttccttatgaatgtacatcacagaaacatgtaaatttgaagatagatataaagctgcttagtgatgatagtacaatttggcacctttatctaacaaggtaactaaagctcatgacagcgaaataattgtccccagtgtcataggaagctagcggcagatccagaccctgtgttgaacaacgggctcctcgctgctggttcagtacttcttccaatgccacacattgctttcctactgcatacgcaatcctgcttttgatgccaagcttgatttgggcaagccttactcatattatagaaaccatatcagtgatgtataattactacattgtcatttatacatgagaaaaacaacactctcatttaataaataacgattcttaggtttctgtttcatactcatttaaaattccctcccggaacagcaaaaatcagagatattgcacagaagctggagtcctggggtcctgagccaggaaccgcattaggtaggaaccgggctttgaactactaaattgacaaatgggggatttcttgcacagcatccaggtcctaatcagcaatgaaaagccaagtggagttttccattcagtataattccaacagggctatgcagagtcagaatctgaaaatgaggcagctattaatacctgaccagggcaagacatttccggctggaaacatggcaggagtttgctgcaggcacttgtgtggacacaggcaggctaccctataaactggacgggaaatcttaatggcactgaaccagcttggatagtcattctaagtagaacctttacaatatatgtgcagtttcagtttcaatatggagttgggcatcaaagaatttacattgtatttgctattatgcctcttttttttttgtaatgagaaatcagagccctacacgtggagtaaaaaaaaaaaaaaaatcagggttttccttctggctccacacatattagctgtggattttaggtaagtgattacaattctctaaatttcacattttcaactgtaaattgagttattttaaggaaaatcatgcatatggacacatgttttaaatgtttagaatttaacaacctccaactcattattcacttttcacatagcaggaaaaatgcaatgaatcctataataaggcactcaattctggtttttgtcacatgtttatatctgctccaacatctaggaccttgtgccataagagtagttaaggcaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatcccaggccaccttgatccagtgcatataatagaaagcagagtaaataatcagtataataaggatgattttgtttctttcgtaagactaaccagtagtcatgttgtatctcatgagtgtttctttttcctatagtcttgagccctcagttcaatgtaggcatcagagaaaacttatagaaatctgctgaaatagaaacacccccgtgttctattctatgtcatgtgtgtagatatgtgaaatgataggtctatttttcacaattattactttaaaacctgcccattcttcaacttccactcactttgacttcagcagaaaatgaatattttgatagtgttccgaaattatttttgaatgctccctcttttatcagcatttgcagaactgagtttttgttctatcatggtataagccaatatttgaccaattctttttcacattccaaatacctgtccaccctagccttgcctcaaaagttaaaatctccaactcattttaatccagatgatgaatgaatgctggaatcctacgtaagcccaacatgatcactcaggaccccttctagtctctccccatcccatgggattccaacctcctctccctagaatgctccctgaccccagcttcatagtttcatactctaccttgattcctctccaacactgaatttcttcctgtttcttctccctgcacatagacaactgtcacacagtttctggcttcttagggtctaccactgcccaggaaaagtcctttcctctctagtcagcctctaactgtgtcagctttggcctttcccaccgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaacttggacatgctatttaattttgttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgtatggtaagtttaataacaaataacaaccattcatttataggttgcaagcaaattttgttcaagatgtaaatataacattgtggatcacataagttattcaagaaaaaatattttccattctgtctccaactaacacattccccttcttattttctattccacaccgttatattatacaacgcccatgcttacatgtttgatttactaataatgtttgtaaaactgtgtaagttaaaagtaaccacttacaaggtcctacagaataattatgtcaagacatcaaatgaacagaatagaaaaacagaattgtccaggacacatggagaaataaacagtaagtattttctggaaaatcatttgaattatctaaatttctgatttgtcattcactgacaattttctccctgacctttggcacgccagttaacctctctgagcctcaacttcctccactgtacactgaagatacgtttactatacagactaggagcattgtaatgatcaaattatttaacagatatgaaagctctttgataactacaaaggcctataaaattatttgagattatttcttttcacagacaactttgatattgtaactttaaaggcttctacattttagtatgacatctgctcagaataaagttcttgaaaggtaaagaatgttatgtgattcactcagaaccgcttttgctcccatgagctttacttgccaaatgcatgctttccaactcaagtaggaatacagcacttggtagcactgtatagttaatataattacacgataccataaccataattcatcttcactctgctctttgcagatccctgtttcctccttactgctctggctgagataacccatgggtgaatgtacagtcaatgagtgaatgctcgttgtactcagccactggtctccttgctgttactgaaacacaataagcatgtcccatttcaaatccttcacaatcaatattccttgttcttgaaaatgtcttcagtaacatattaacatggtttgatctcttatttcattcaggttactgcttaaatgtaactacctcagagaaagctcccttgactaccttacataatttagcactacggccactttctaaccctttaccttgcttttgttttccttcataacttgaccctttctggcattataacacatatgaatttgtttaagcttcttgaaagtagctaccatgattgctatattctcttcgtattctcaacagttctgggaattaaacaacaaatcgactccaacaaaataatttggtgaaaatacatcataaaatctgaattttttcttcctgtatatctctaagttgtgatcaaatgggaaaggcctctttctttcttaggctctcagtttctctaaatgtaaaaaagaaatgccaaattacacaatctcaaatgtcacttttgtcttactttatagctatattattcatattaaatacataatgtattaaaattaaagagcctatataaaatgttgtttcttcaaaaatagagctttcctaccaaagaaatggtggtaatatattattatttaataagcaaacaaagaaaaattaatcagagaaatagactttgctattgtgttagtaattatgactaatgactctccatatggtatgtagaaattattgaattttcaagcatatgccagataaaaaagggcctctgattttggttctatctttcccacttaaaaccccaaatctaaactcttttttttttccagagggagtctcgctctgtcacccaggctggagtgcagtggcacgatctcggctcactgcaacctccacctccctggttcaagcaattcccctgcctcagcctcctgagtagctgagattacaggcgcctgccaccatgccttaatttttttgtatttttagtagagacagggtttcaccctgttggccagacgggtctctaactcctgacctcagacaatccgtccaccttggcctcccaaagtgctgggattacaggcataagccactgcgccaggtctaaactctttttaatgtatataaccaccttctctgtttgctgtgccaccttgtggattcagttttgtgtaagaaagaaaggaatcaaaaacaactggggaatcttccaacacaatttatatccaacaactccagagacagagtcctttcggttattctcactggatatttggctgtgaagcttctgatttgctaacttcattaatggcctttagatggagagaacttgaaaatccttgctataatagctgctactttgctaactctgttgtcacgcataatgatattaaatcaagcaagagaaatattgttttccatcctgacaagaggcaaagaaaatgccaaattacattatctcaagtgaatttttttgaaaaaaaaattgggattgctttgactagaacaagtctaattttataacttaaaaaaaacaactctgcagatacggaaacctttgtctacacacttttgaaataatttttactggaaaactactgagctgattcctctaaaaataaaggttctttgttaacacattctttgcaacatctgacaaggaaacaaggtaaatttataccatcataaaataatgcaacctgtgacgtactggaaatgtaatgttggaggtagatggacacaactactcaatactcaaacccttgatttttgaccttgagcaagttacttaatttctctgaaactcagtttcacatctgtaagttaaggttaattatatcatcactgtaaggttgattttttttttttttttgagacagtcttgctctgtcactcaggctggagtacagcggcacaatctttgctcactgcaacctccgcctcccgggttcaagtgattctcatgcctcagcctcccaagttgcttggattacaggtgtgtgccaccacaccgggctaatttttatatttttagtagagacagggtttcattatattgtccaggttggtctcgaactcctgacctcaagggatctgcctgctttggcctcccggggtgctgggaatacaaccatgagccattgcatccggccaggttgtgattattagactagacaatgaaggtgtgtcaagcatgtagtacctgacttattactcactctccttactcctggttacaatttcaggggaaaactgatatcacaaatgagaatgcagtagcctgagcagcgggcagagaaaagtcactgtagttgtggatccacataacgtgtcatgaggatctcttacctgtgagaggttaattaagattatcttgcttaaggctcaacttggtcatctatatatagagaacacagagatatcagatcacttttctttctctggtagaggaatttggtgccatcaattggagataagtgatgtggtaatttcaggttcttgtcacctcctaatgaggcattataccacaataccactggactcagcctctagccagaagactgtaagtatagaagtgaggtgggagaaagccagtgggtgaggggtatattatattacaattcactattatcatcaaaataacttccaggagcttcaatgttttagagacgacatatctagagcagatattggaggggcagcacaattctccattgaaaatgcctttggttcttaccaagtgaacctgtgcacaatacgtaatcatgtgtcccactatgactgaacaggaaaatcatggcaagatatgtgcttctagtgcctcagcctctgtcttcctttcttgggataaggatgaaagtagggatgttgtcaaatgcacatatttcaatttcaacattcttctgctttttggaaagtcacatttcatacactaaaaggtacgagaaattatcaactaaggctaaaaaatatattttttacatgaaatttcctaacttttaaaacttctgtatcaactcccatgaagtcaaactaactgatatcaaacttaactttccgatgtaagcaattataaaactggacaaagtatatgaggtagaagtttccaggcacttgtcaactggaactgtgggtgtttgatctttgagagaaggcagatacacaggaggtaagcactgtgtatttgcttggctctgtgttggttttcttgctttcttcaagggacagcactgtggttttgtgaagctgaagaggcagaaactgtagttcgagattgctaaggtgacttgaatttgtggagcaaggtgccagtgaaaaagggctggatggaatgaggggcaggagactgtacggagatctcctgtggatcctgggtttacagagagaaaagcacatgctcaggatgagactcttcaaggcccagcatagaatggctgctccaggattgagagctgaatggagatggctgtggctgtgtagggctaggatatgataaacttccgggcaagtcagaaagcaggggcctcactaagcaaagagggcattcaatgaagacctcagaaaggccacaggttcaagttaatgaccacaccctaagtgagcacgtcctcatcccccagattaaagacagaaccaaaacagtcaagacaagacctacacgcacacacacagacacacacacacagacacacacacacacacacacagcatgacaagatcaagaggatttattagttattaatccaaatgccagaacaaaacacacacctgtatcagcagataatgtaatacactctacaatgttttttataaatgtctaacatacaatatcacaaaacatggatgcaagcagcacgatgtaactcatggtcagttacgcagatagtagaaaagatcacaaggtcgcctagatgttaaaattaagagaagtaatttgttttttttttttttttttgacacagggtttcactcctgttgcccagactggagtgcagtagcgggatcactgttcgctgcaacctccactgccccagctcaagcaattctcctgcctcagcctcccaagtagctgggactacaggcatgcaccaccacaccctgccaatttttgtatttttagtagagacagggttttgctgtgttccccaggctggtttcgaactcctgggatcaacccacagtgctgggattacagacatgggccaccatgctcagccaacagataagaactttaaaacagccactataaatatgttctagagaaaacatatctcaatgaaaaaaaagaacataatgaataaacaataaacagcagaaaaaatataaatgatttttaaaacccaataaaaatttaagaactgaaaggaaccatatttgagggaaaatattactggatataattaattataggctggatactggcacatataaacaactcggtatttgtgtgtattatgtatgattggaaaatatcttgaagcttacacaagctggtaatagtgttggctcctgggaagggatttggttggctagggagcagagatataagaaatagactttttttttttctacatgtattattacttcaagtaatgaatttaggggaaaaattctgggtcaagtacaattaatgtactagttaaatatagactacagacctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgtttacttaccccatcgtctatgtcctgcttagaccaccagaactacactggacctcagtacaagggatatatattaaagcaaacaaactcatcattctttgaactctactcgcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactataatggtcaatgaaggagaaacgtggactgggacgcagcatgtggtgcagtattgctgagatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgtgtttttgaaaaaaatctttgctgcaatgcttcttgctgtgatggtgtgtcctcagaatgagaatgcaaagtaaacacctgcaccaccaaagaagaatgaagacagagaggcctggttcactttatgctttatttctaaagtcccaggaatatcatttacctgtatcatgttttggatatactaccatttggacaaagagatcacaagtacacttgtttaatttcataaaaggtactaaaaagaaagttcataagctctgtcctcatcatagaatccttgaaatctaaaattgcaaatatgtagtttgactcttcactttacagatgaagaaagcaaggctgagcaggggaaggaattaacccgatcaagaccatggcgctaaataacagcagaataaggattagaacctgctctccagtccaggggtctgccctctctttgccacagtgggtgctttgcttatgatttatgcgctttcgtagattaagaatgattagctaaaatagacttttataatccaggcatggtggctcacacctgtaatgccagcactttgcgaggtcgaggtgggcagatcacttaaccccaggagtctgagaccagcctgggtaacatgacaaaactgtgcctctacaaaaacatacaaaaattacccaggcatggtgacaggtgcctgtagttgcagctactcaggagactgaggtgggaggatagcttgggcctgggaggcacgggttacagtaagccaagattttgccactgtatgccagcctgagcaacagagaccctgtcccccaaaaataaaataaaataggcttttacttttaattcagcatattttccattaatcaaatgactgaccaatgtgcttcggttaatataatagttgttttcactttgcttaccgattagagtgaattctctgcttttagacattttggctgcaggtaggaagttatttgctcttgattccataaagcagacactagtaatgtaagagctggcaaagggcaaaaaagggtgattctttttatatgaacaggataaaaccagagtaagcttgaccgatggtctgaattagagatggtgaatggagaaaatactgtatttttcaaagtagaattgccatgtgtgggcaaagggaacaatgggtgaaaggtcaggggaaggccaatccaactctgaaaatcaatagccgtactgctacctaatgatgctatcaatgcacattttgagttcatttgtgattcagaacttatgatttgatcctaaagtaattttctctagcaaactgaaagttggcaagtgccttcctcaaagcatctttgcagaccctacaaaaatggtaaagaaatgaaatcgttctccaaacgtgttttatctaccaattttcccatttacagtgttggattacaaatccataaaaagaattcagatatatgtggataatttacattctctatctttaccaccagattgctaaatcacctcatatatgtgcctccatctcattagggtacttgatatatatcttatcacttctcacagatttcattacaatttatagttatttcatttgttgttactactgctgtgctttcacatgtggcaattcctcccacctatatctgcaaatccaaatctctcctggtcttaaagatctagttcaaattcaactcccttcacaaaattgcctctgatcctgtcatctaaaattatctctttctcttctgactcccgtcatagctatttatctgtggctgtcttaacataatgatcactttgtattacatatcatgtgtatttgcaatgatgacatactatatagaactcacttgagaccccggcctctgtcttatttctcactgaaataagatacttgcacagtagctggcatctgacacccagtagctcctccataactgtttgtaaatgagctaatgaatggaggagtctagcctgttccatgtcgggagtagtttgatgaaatagcccttgtaacggcttatgaagcctattacagatagcttccagcagtagactttctacaaatcaacatagctaacaaaattcagaacttaactcaactgtttacattttctttttttttcatgaattttttttttaattgaaaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattagccaggcatggtggtgggtgcctgtaatcccagctactcgggaggctgaggcagagaaatgcttgaacccaggaggcggaggtggcaatgagccaagatcgcaccactgcacttcagcctgggcgacagagcgaggctccgtctaaaaaaaaaaaaaaagttacagcgaataattaatggatcagtagcctaaaaaataaccatttaatttttcagaaaatattcactcattggtgaaagagagagaaaaaacattaaaaaaatataaactgaagcatacaatctcaagaagcctataatatgagagaataaacacaggtatgattcaacctcctcttcacattctatgttagtttacaaaagatagtgattttatgttgagtgtaagagatactatttttttttcttgaactgagaaccaattgtgtagaaattcaaatatatgttaacttgataaatgtcattaacatgtatgaaccaaagcaaacagatggtattctgggacctggagagtataaggaaaatgcgaatacttcttttctgatgttaatactttgagaattacatgtgaatcacttaagagtaaatccattgttttgatacattctaaaatgtcagggttcctgttcagttcatgactacgtggtgccaccatcttgcataaagccttagacaaatgctgtttgataaatacttagtgacatgtacatgatttattcttatatatgtggttgtgcacatagtaagcctactagaaagaaggctatctacttcctttctatagactcattctattaaagttatttttcaggaatatcgaatgaataaacaatttcttcttcagatcatcaactacaaaaaccatcagttcattttctcttacatttgtgtgtgcgtgtgtgtgtgtatactgctactttatttgaaaggagaataattttgattcatttcctgttttgattttcatgctcttgcaaaaaaataaaataaagaactgcgttggcagtttcaagaacaactgaaaaatctattgtttagtatgagtcatgtctcctcttgaccttaaattcttttatctgcctaaacttcagttttgaagtttgaggttcaattgttgataagcagttagtatttgattttggttccccctgaaatgtaccaacacactcaaacatagtctgctcttttcagatattttgcagcttggcatttttaattctcttctccttagtagaaatctgtattagtacagatgaagctgaaaggaagcttggaattcttctaattggaatttcatcattttataaaaggaagccaacctcactactgtttctgttctcttaacttgaagccaagtagcagaggggtcacagcatctcatcagtttagcttgtattcaacatgaatagaatctgaccattttccctaatagaatcagcatgcaaatttctagcattcaattttgaaaagctgtatttaaaactactgtgtgggagagcagaacaatatgtgaaggagatattatgctagagtcgacgagttttagtttctgacatatatagtctttttttgagcaaaggcaaaatttatatagtatatcttataatttatcataaacaggtcagtaaaaccataagcatatttttgcctgcattctcaacttccacatatatttttaatgtaaaacagctataaatgagccagtccaggtagaaagagaaggttaatgtgaagttgaccaaacagcatttgctatttaattacacgatagacactaaaataattatgtaattcatgtagtcttttagctaacacttaaatcctgtccatgttctaactggttaatgataaagagattaataaacagtttttgcagtcaaagaatttgccatactgtgaggtataagattaagtgataatgcttccttcttgaataagaatcaggaccaaggagagcttcctgaagaggctgctttggattgacccttgaagaatgtgtaggaacttggaagcaaatgaagagagataaacgaaaggagagagagaaataaatagaacagatggaaagaaaaaagaaaaaagagaaaactaagaaaagaaagtgaaggaaggtgaagaaaggaaagaaaaaggaagggaagggaaaaggaagaaagaatagtaagttttcctcgacatggggggtcaactgtggttaccatatcacggaaataaacagtagcagatctatgtattaggaaatgagaacggaaagacaagtgaggtttagaaagtggagacattcctattctagtcccaggagtttcagagacattccagtgaaacagagagccaggaaagtttcctaaggagagtagtggcctcatgtatttattcatcaatgtattattttattaatccaacatcaatttataatattctaataatttcataatcatgtgattctaagaatgaaatctagaattcaaagaggtactagtgagacagcttgaactaaaagactgtccaatggcaggaattctaagcataggacctccatactctttgctccacaaaactcagcacatttcaaattatgttattctgtcctctttacaggttaatggggattacagattgaaactacgcacgtgtttttgtgtttccattttcaggttgctttcctgaggtggtacttaacctccaattagagaatgccgccactaggtggcggggtggtgacttggttccaagaggctacagttggtgggaccaagaaagggagggttatgggtcccatgattcttatatctatttcattttttctttcaaaaactgcagtggacagttgagaaataagcttcgataataagtttttagaaacaactaagtgtgtcatgtgatacctggatgacaatacattgtctgagaaatacagtaagacaaatgaaaactctgggctttgatgcaagacactgagtttcaattttgcctgtgccatttattagttgaatgaaaagcagaaagttccttcatttctatgagcgttggactcatttaaaacttgaatcatcatacttatttcacaagtctgttagaagacaaagccatgtggtgcaatgtgctttgaaaagaacgtgggtaaccacctagatatgatccacaaatatgcctgatccaatcccaagaggtttttcaagttcacaacatttcacatagaaatgtaatctctaatttcttatgaaaaagtctgaagttcaggtaacacttcatcttcattcctctgtctaagaattagctggagttacgtgacccaggctcccctccctacacatgagtgtgctaacacagatttaggggaaacttgcctgggactccggcacatcaatgtcaaagaactacttgacatttcatgccagccgcagcttgtaggcttcctcagcctcggtttcatggtatctccagtcctgtttaagccatctaaaaggggcttttttgatttcctttgatttatttattctcctttcttcctttacttcccatacttggaggaatccaatggagaaagacaatattaattagataatctttaagggagtcataccctctcctgtgacataggcatgcttctcagttccaaaataacagagaaatttgacctctccaaacagaaattagctggcgactgaatgcatttatgttagattaaaaaatgtaaagttgacgcacctctctcctctctttgccgtctgttacaaactaaactgtgccttctctcaccccaaaatttttttgttgaagccctatcctcccggtacttcagaatgtgactgtacttggaaataggacctttagatgaagtgaaatgagctgttagagtgggctctttccaagctgactagtgtctttatcagaagaggaaatttggatatgcacagaaacaccaggcatggtgtgcacagaaaacagccacatgaagaggcaacaagagagtagctatctggaagccacagagagaggtctgagggggaaccaaccctgccactttgaccttgaacttccaagatcaccataaccacgagaaaatttatttctgttgttgaaaccattccgtctctggtactctgttatggcagccttagcaaactaatataccgaccaaagaggattctggtttggctacccagtccctccctttcctctttcctttgagcaggatgttttaaggacttttgtgtttgacactcaggagcaaggggggatggtgggggagactatgtgaaacatagaaggtcaaggtggaattgtccactttttaatggatcaggacaaattgaaaaaagcatggaagcacttaaggtatggcacatagtttatgagagctaaggaaaagtttttttaaagttataagaaatataaaaaattattttgaaattatgttgcatagactttgcatttttatataacttctctaggatcaaacacagtggtcaaagctttatagttattatataacaatacatcttcccataacaagcatacaaacaaaaacaccttttataaattgcaactagtatgaagttttatgtttcaaaaattccttatgtttcaaaaactattttaaagggcaaatgattaattcattgaaaatattttaaagcatccacattttagaagaaaatttaatgaattatttaacagagctacaatattctttttatataaaccaactatacattgataattaaaatctgacaatctgtaagcccaatactctttttttttttttttttttttttttgagactgagtctcgctctgtcgcccaggctggagtgcagtggcgggatctcggctcactgcaaactccgcctcccgggttcacgccattctcctgcctcagcctcccgagtagctgggactacaggtgcccgccaccgcgcccggctaattttttgtatttttagtagagacggggtttcaccgttttagccgggatggtctccatctcctgacctcgtgatccgcccacctcggcctcccaaagtgctgggattacaggcgtgagccaccgcgcccggccccaatactctttttgaattattctttataaatctcaataggtcaacatctccccatgaaaagaatcagaatacaaatgatgtgataatgctcgtgaaatggtctttcaaattataaagtatcacgtatgtgcaacggattattatttatgacccttatctgaagaatgatgacttcttcaaaagaatattcattatttctgtcgatttctttaggctatcctaagagtgagcctaaaagaaaacaataatagatcttgtataattagacaagatattgtaaggacacctctgtaatttttcttgaaggtacatctttcccatcagtacttttagtattggtgactaccctgacataatatggagaagtattttcataagtaaaataatgaagttctacaaaactatgaggacaatagaaagatcagtggtggccagggatcccaggggaaaagtcaggtgaatccatgaaaaatagaaaatttttagggcagtgaagctactctgtgtgatactataatggctgatacatgtcattatagatttgtccacactcgcagaatgtaaaaaaccaagagtgaaccctattgtaaactattgactttggttgataatgatatgtcagtgcagggtcatacattgtaactaatgtgccactaatgcagaagatgctgataatgtggaggctatgcatgtgtgtttcagggagtatatgggatatctttgtaactttttctccatttttctgtgagcctaaaactgctctaaaaatagtctttaaggccaggcacagtggctcacgcctataatcccagcactttgggaggctgaggtgggaggatcatgaggtcaagagatggagaccatcctggccaacatggtgaaaccccgtctctactaaaaataacaaaaaattagccgggcatggtggcaggcgcctgtagtcccagctactcaggaggctgaggcaggagaatggcacgaacccgggaggtggagcttgcagtgagcagagatcacgccactgtactccagcctgggagacagagcgagactccgtctcaaaaaaaaaaaaaagcctttaaaaaactaataacaaagccctaaacaaatagcagggataaagaaagatacacagagtaggggaaaggttccccagaaaataagagaattacactgaataatttttaagttcattttatgtgtttgtcacataggcatgggataacatcgtgtgcctttcaacacactaagcatacaacagtggtaaaatctggtgctctggcataaaccttcaggacaaactctagagaaatcattcttcaatctcattggatccaaaaactttaacatgctaaatgaagatctgtcataattagagctggaagtcttgctctcctaactttcacttaatggagaaataataaaattattactagcttcatacttttcttacaagttgatcaaaatggaactatttagctgttgattatggactttttggtagaaagggaaattatctttctctcattgtctcttaggcttacaaaaatttataagtattttattttattcaaattatatatacacatttacacatatacttttcatagaagaaaatttgtaagattttttgttcaaatcatatatgtacatataattatatatgataaatatataattatattacatataataaatatataatataaatatataattacatgttatatataaattatatatatacacacacagtggggcaggaaacaagacagatcttcgcacttgaaacaggtttttaatataactagtaataacttttttcttctctccacacttttattatgcattctttccctgtggaattatagaatcacagtattttcaaacttaaaagggagaacatttgatttttacaaagaaataggtcctgagtgagacaatgaaaaataaaagaagtgtctttaattctatattgttgcattaagtctgccttcaacaggtatttatgaatacctgcagttattttttattcatataatacatcagcgcatacatagcatatcattgtgtaaatacagcattgagatgtttgttattttaagtaggaagcattttgcatcatgaactgtcaataaaaatgaaattaatgacaatatataatcatgtaagcagcagtgtcaagaatacttttagcacctatactgagtgaaatattgttgctgtaattgtctttttgggaggtaggaagaacatagagcaggacaagattcgatccaggtagaacagaagttgggtatcagtggtctgggttctcaagctcacttctttcagagaccaaaaaaagtttcataaatgccatgtgtattcttaaatattctaaatattttaactctgcccatgatatggtttgacttacttcctggtctcgcttgccttgctctagatctgttctggattgtcaatgttcctattaaaatatgactccaataaaggaatacatactttagatataatctgatctgaggtgacaagagaacaacttcaactcttatgccttggatatgatactgccacgatcaccccatcactgtcttggactccaacactggactgcacagaatactcagaagggtgctcattttcttctacaggtaataaaggactcactcctcagcagtgatccaagtttcttttccttttaagtaggttctcataatcagcttcctttatcagcagccctaacattataatcatcaaatttatttgacattctcttaccaaacatacctcttctcttgaagattaatgattagagttactttggttaaaaatcaagtatcatttccagaatacactctatagtctcaccctatgtcatcttccattttcaacatcactggtcaataacatgactctatacctatcttggaatgattccccagtccttactgaaacacttttaaatactagaaagcagccactgtcttcttttttttttaaggatatttttattccaaatgcattataatttgtatatgtaccatcagcgtgattctcaggaatacttctggcctgtcctacaaagcaattacagtcggctcatcttcgtgtacttgagtttgactgtgaataaatagctttctcaacttttctttctaccaaatatacatactgggccagcagggatgtgtagtatgtagaaaaaataaaagcaatatttttctagctaaaacaacgtcacttctccaactcatacagccctgtatttctggtcctaacataatgttcaaaaataaatctgagcggttttaaatgtaggcacatattttataaaatgcatagctttctattccttcaagcagctgatttatataaagcagaaatccattcacataggtcagaaatttgtaaaatgtatgacaagagatttagctcattatgcttatcttgtggtctgcccaaattgttaaagcttgtgcctcaaagtatgctgagcctctttggcacactgacccagtgattagtattttctcacccagtgcaaggataatgcatacctcagaggatcaggtggtaactaaaatcattgaatcaggctgagtgagagctatgaaactctggagattctcatttctccacttacaaaatgaaactgtggcttagagtctaattgacactgataataccatagagctatacattcatattactctggatgaaattttcattcacagcactaaacatctgggtatttccacatggacttattttcatatatatttagatgtttgacaacctaaaaataaaatagtatatacctggtggaatttttctttctgtccatgactatcatatggatggattcagagtgtgtcaagtttttcctgataggatactcatagaaatgtaactttattaacagtttaaaaaccaatactatctttgaaacattgtggagtctattcactctacctaactataataagactttttaaatgtacgcttttttagtaaggaatttgatcatttttataacatatttttcagatttctcaccaataaaaaattaaaatacagtgcaaccaatattaaatgttaaggcttaatttaactaatttatatagcaaggatttacaagatacctgctttgggtcagatatcgtgcaaagggttgtggtaaaagaagcatgctgactgactttgtcctcaagtggtttacagtttaatggagaaaagcatctccaccaagtattctgtctcccattgtggttgtcttggagccagaactaggatgcagattggcagtcctatacgtagcccggagggcccaccaattgcttacctctttcaacaaaggcatcgtgaactctcattttgaagtgggaacaaaacaaattttttttatatgtaatgtatcattggccttttgtgttatttttcatgaggattttatttcaactaaagtcgttaccatttaaatgatcaaagagaaaagtcagagtccatgatttttgttacacgtttataatgacagatacagttatacgtatttatcgtgtacaacatgatgttttgaaatacagtcatgcacctcaaaacatttaggtcaaaaacagagcacatgtgcaaatggtggtcccataagcttgtaacactgaagtttttactgtaccttttctatgtttagatacaaaaacacttaccgttatttacaattgcctacattattccataaatggacaggtttgtagcctagcggcaataggctgtgccacatagtgtaggtgtatagtaagctataccgtctagttttctgtaagtatactctacgatagtcacacaatgaacttgcaataatgacaaatttctcacaatgtatccccattgtaagcaatgtataactatatgtatatacatatacacatttcacaatgtgtgtgtgtatatatatgtatgtatgtgtatatatgtatgtatgtatgtatgtgtgtatacacacacacacgcacacacacacacattgtgaaatggttaaatatacctaagtaacaaatgtattacctcatctagttatcacttttgtggtaagaccacttaacatccactttgcatttttcaagagtacaatatgtcttctttaactacagtcaccatgctatagaagagatctcttgaacttaactcctcccatctaactgtattacatacactttgaggaacatttctccattcccccttcccccaaccaccccagcctttggtaaccactattctattctctacttctatgagtttagagtttatagattctacatgagtgcgataatgtggtatttgtttttctgtgtctagcttatgtcacataatataatatcctccagtttcatccatgatttcaaagagattggcactcccatgtttattgcagcactattcacaataaacaagataatggaatcaacccaagtgttcctcaatggacggatgaaaaaagagtccatcaactttaaaagacacaaaagactgttccaaatattaccttaaaaattgagatttaaaaactaatctgggtaaatagcacattttttaattccttgggcaaagtttttaaatgggagtgttagaacacaacaaaatgtaatgctctgaaatgtaaaagatcattataaacaatagagaggtgagatgccacttttcattttttagccaatacttagagcttattagataagcatatctgatgggacagtagagctttttaattgcctgggagacaaaaaaaaaatcccatctatgccataaagctgtttagcaacatgtttggctgtaaagaatgtgaaatgtagataaaattaataactaaaatattctagggtgtaaatttctaactttccgtcaaaaataacactctaaatgtgaaccatcaaggtagacgtgacagcattttgtagcattctttccaccatttaaatctatttagtttttgtgtgtgacaatttgacagtcttgagcatacaaatgaagacacagggtaaaattatagattcagttttcagagaccatatttgcaaagacaagtatttttttttttcagcaagaaatcaactaagcagtagttacagaaaataacttaataagacagtgaacagaaaaccagtatctacttaacagactcaggaaagagatcggttatgagatgcttggggtttctgtttttgttagataagatgtgcagttaccagaaatctaaggaaaggtaagagccccctcaaagatttcccttagaattaattatctaaaaattataatggattactgttcctattgattgcttagatttggcccaccacaatctctgattcggcagtacatgtgcaattttctataagtctttctggaaaatcctagtataaaaatgtatttttagtgatgtttgttttacactctgtattcttctcggtgcctacatgaaactctatagacagttactgtgaacttcaagatcaggcaatcagtttcaaacacgtatcgtgtgtccttctgtactcatttttaaagatgtttaatattcagtgtgaggtttttatattggggataaaacgaagtctgcgttatatgaaatttaattttgaaggtaacgacatttgaactgcagtgttgtgttgttatatctccttttttgtctagcttttataaaatgatctagattaagtaccataaagatcataaggaccttataagtccctctgcatttgaaacagtgaagggaaatgtgttgctttcacatttccatcctatccaaggggcctctacagtgcctgaactcaccaatgaggtaacagatgaagggagaatagtgatggcctttacaaagccctcctgggggccggatgtggtggctcacgcctataatcccagcattttgggaggccgaggcgggaagatcacctgaggtcgggagtttgagaccagcctgaccaacatgaagaaaccccgtctcttttaaaaaaatacaaagttagccgggcgtggtggtacatgcctgtaatcccagctacttgggaggctgaggcaggagaatcacttgaacccaggggacggaggttgcagtgagctgagatcatgccattgcactccagcctggggaacaaaagcgaaattcctcctcaaaaaaaaaaaaaaaaaaaaaaaaagtcctccgggggtcccgagtgccaaactacaaagccaactttttttttttaacttcttctctcacaatatcagcaaatttgctgtcaacaaacttcttaactttatagttttgtacaaattttgaataaaagaaagaccccaaaggatccagaacggtgcatccattctaaaggcagagagctgagtattttgtattctgataaaaagatatgaaaagcaaatgaatcacataaataggattaggagagaatgttcaacttttttatgaccaaaatgttttcaggcacttgaaaattagaagcaaatgttcactgatggcgattagggaattaatggcctttaaaactgacaagatttttttcattgctttagttaatatctattttctaacctttaacctgagtaaaaaagaatctgtacattagattgagcataaaaaccactgagcaaatgaaaaaaaaagctaaaatcagtaataatgctcactaaatttgtaaatgttgaaatgctgctttacctttcatgacctcacttattcagccatgaaaaaagggtgagagaaggaaggcagcaagataatttctatatctgttctctaggtataagtgcctatgagtctaaaatagactgctgaggatattagaaagatttcatgaaaattaagatttggggaatataaaaaagcttacaaatctgatgttctccaaattcctgaaatttgtaattaccaatatcatgacccaactggttagaaatatgtaaataactaaggaatgttttgaaaagtcctaattattacagtgaagaggtaaataaggtcaacatgctagtgtccaccatcaaaaggaaatttcatgttgtttactcagcttctctggacactaccagagacacagctcttagtggcttttaaggtagtttcttcatcactgggcaatagttcattaacagactatcccaaacttatataatcttttcattctggaaaattttacacatgtgttgtttaggttaatcaggagaaacaaagactaatcagaataatctttagtagtaagctaatttagctcttctcagcaccgtttcaaggaagatatgtgcaagatgtgtgaacaaatgggaaagagctgaagtcagtaacaatgctaactaaagttgcaaatgctgacatgttacttcgtctctcttggcctcacttattcataaaatggggcaaggggagaaaagggatgagataatctcagatctgttctatgtctaagagcctatgagcctaaaacagaatgctaacaaaattgaaaaggaaaactaagtagtaagtgtactgagttgtgctcctgttcagtctttttctattcaacctccctaacgtttcactcaaggatagcatttcatgtaagacatacatcataacagttcagatcagatgtcctccgtatttgagatttcttactttcttgagagggaaggagatgattaggacaaagaaacagcattgtctgcaaataccaagtagcttagtgaagccagctaacaaatggaggccaaatgtatatgtggccttctttcacaagcaggccaataaatgtagaaacctcacctaacctgcatttggtttgagagccagtgcatgaagtttaggaataaaggataattatttggccatctgagaaaagctaaatcttgtaagtgggtattaaaagatgcaataaatgatattccttgccaatctgaaaaggcaaaaaataaaaaggtagtctagctgtttatgagatctaactcctccctcctcctcccactctgaaaacagtgaagatgaaagtgattgtatcatacgccactcttacgccaggaaagctcaagaataaaaccatcacagttcagatggactaaagggtattttctaggtttatgaccagaatgattcatatatcaaaggccaatcatatacatgtacttgctcagggattttcaagtcgatttcttagagatgaaacgtactgctccctggctccaggaaacagagcaatgctaaagaggtaaatcaaaacagcaatagaaaggccgggtgcagtggctcactcctgtaatcccagcgctttgggaggccgaggtgggtggattgtctgagctcaggagtttgtgaccagcctgggcaacatggtgaaatcccatctctaataaaatacaaaaaaaaaaaaaaataattagccgggtgtggctgcgtgctcctgtagtcccagctactccggaggctgagtcaggagaattgcttgaacccaggaggcagaagttgcagtgagccgagattgtgccactgcactccagcatgggtgacagagcaagagtccatcttaaaaaaaaaaggcaatagaaattattcatgtttgggaacatgaagatattaaaatcataataaaatgagaatgccaatcaaacaggaataaaaacacttgctgtgtactgtttctccttctccagtttaaaccagaaaaacactagatccaagagataacatgtaatacattaagaaagaaactttcacgtaggaagccaaatatcctcccacattgtttcccccatatgtgtacactaattactggagcatcttcacatgccagcgattatcaaagcctcacaagtgtagactgcagtgtcagtgagtgcttggtaagacagaccaaactccgtcagtaccttgccatgtgatcctggacaagacatacttgtcctctcatggtcattaaaatgggagagggaatggggacaagatgctatctcgactctttacagcaccatagatttagtttctctagcaaggcctatgctccttaagtttatggatgtcacaaagtggttctgtattttatattatttgtcagaagattagtaataggctcccattagaaccagaagaaccaggcttttgtgtgaaaaaaaaaaaatgagtgagtaggctacctcagtactttaagagatggtaaaagtatcctgctttgacagccaggtgaaaaagctaataaaagcacagaaagttttcataaaggggtacagcttcagatgtctccagataatccctctgttaattgtgaagggtcatctgtagggggccactggtatatatctctttactaagttagctggttaacactggatccttagggaatgagatgatgtatgaatatggaaggagtcaaggtgctaagctgtactttatgttctaaatgtgtaatttcctctgctttcttgattgatctctttagcattgtcctgttttctaaagtcaaattttgacacatattggatggacaacagatttcattatatgtgtgggggaatggaaatggaacacaacaactgaaatggaaatattcagaaaggggcaggcaagggcaaagctttatcaagaaggtgtgagtggacacctactctacaggtctttaaaattcatttttatgcatttaattaacacttgccattttacaaaatacaatgtcaatgtgagttatttgacattatcctcaccacatctccatgcagtaagcccagagactacagtttagagaactgatatagctccaatcaggccacacatcttgtaacccgcagagcttgaataggaacccagtcttatattcatccctctctgtataccaccaccatcagcccataactgtggaaactctattagcctaggaactcattaaaatcatgtttacacttttactaacttaaaatcatatttatttaactagatgtctcattagcttattgaagtcattactgcctgtcagtcagagaaagcaaacgaatgaatattcttcataatagaagagcaagcaggactgtaattaatgactttgctaataacagccccgtgtttgtgcacattgattttcagatatggaatatacacataaacctctggggaacaatgttcttctatttaccaagaacaaatctactaatagttattaacaatacattctttaaaaggctttatttctaataatctcttacatatggatgtttcttcaatgtgaattaccaaattgactttgaacaatttatgctgccaaatttttccatttatctcattcagatgacaaaagtaaatacaccaaagattatttctatgcaaaaatgtcttaagtggagtggtatttgagatgggaccctgaaaaaaaaagtaaggtatccaacagaaagttccaatgcagaaggaatgcaagatgaaggaaacagcaaaagaaacagacagattgaggaagtggcacagttcccaagaacagagattggcccggtagctctaatgaaagcattagaggaaagatctaaacagagttttgatgtcaggctttggaaggtcatgagtactttgtctacatgatagcaaaatccaaatatttaaagccacagataactgcccaagatttttgtctccatttgtgtttggtcttaggcacagatttattatgtgcctgttctaattaatgtaggcaaaaacactgttttttaattgaaataagcactttctgttttcatacaacactgaagcaaatgctaagctggaagcttttatttttgtttttgacaacggtttctttaattgtaagggaaaatcaagaaaatatttaattttgtctcatatccgaatagtagaggaaaggccatattgttggaatgcagtgatgggagctctattattctccctatgtgaatttgcagcattagcatctctgaactacgggttctatcaccagaaagttgaggataccagtaattaccactttacttgcttagaggaatacaaattataatgtatatgacaaggctttgcaacttaaaaagtgctataacacagtgagcagctctctacgtgaagctgataaagactgaaaaaaataaggttaagaacttgtgattattttatatttattttctatatttctagtgcttgctcctgatatcaatgaagaaaagtgggaaatacagcctgctaaacagtgcttgatggtaaaaatacaatgctaaagcatttcattggctcagctacttttattttcaaaaacttcagtctatatataatattaggaggaaaagactagtcaaagtattgtttagattttttttaaaaatgtacttaaaagcattaaatatttgtgtgtgtgtgtgtgtgtgtgtgtgtacatgcacactaggtaaaaataatgttcttctgtagtttagaggactgatagaactaatttggtattttctttccttataagttgtagatttcatatgcatttgtcttataacctgttttttaccttgacctagcttaatgatccttctaaacaagatattctctagttaaaaggaattagaattatgtgaaattgacttgggaggtaaaactttattttcattcatttgcacatatccttattgaaaagtataaacaaagttaagatttggaaggccatgctaaactcttctgtaaatatcacatgtctatatgtctaaggatttggatacatgttgcatttgaagtagcttaggtgtctctaataaatgagtcagcttacaagcttacactcttttttctttacttttttttttttttttttgaagatagggtcttactctgacaccccaggctggagtgcaacggcacaatcatggctcactgcagccttgacttcctgggctcaagtgatcctcccatctgagacttccaagtagttcagattatagattatagattacagacttccaagtagttcagattattagctgtcacgcccacctaatttttaaaatttttttgtagagacagggttctcactatgttgcccaggctggtcttgaacttttggccttaaaaaatcctcctgctttatacttccaaagtgctagaattataggcatgcatcaccatgcccagcaatttactttctttactatgatttcaattttagacatgtcaggggcctccctgaataactgcactttttagaaataaaggccagtggttcattggccaaaaagaatttgtcgttaaaaaaaaagcaaatctgtccgatttattaattatgattgtgtgatttgatccaaccaatgatagatggcaaatttcacttttcaatttgtctaggtattagatgaaggtcacccaaaaactgagttggaaaaaaaacttgaaaaggaatccatctaatccatgtcttttagccccacacacggcagatctgagcaaaaagatgaaagaaaattccattttctttatcacagagcaaataagagtctcaacatgcaaagctgtacagcagaactttctctaatgatggaaatggtatacctctgcactgtctaatacagtagacacataccacatgtgactactgagcagtcaaaatgtggttattatgactgaggaactaaattttaaatagccatatttgtttagtgtctactatattagagagtgccactaaatattttagtcacactttactgaagcaagaattgtaaagtgccacaatccaggcagataaatatgctgcattttaataacctgtgaagtcaggttgttgccttttatgcaggtcccataatatcaggagttcactttcagatttgcacttggagccaggagtggtggctcaggtttgtaatcccagcactttgggagatcaaggtgggtgaatcacttgaggtcaggagtttgagaccagcctggccaacgtggcaaaaccccatctctaccaaaaatacaaaaatgagctgggcgtggtagcatgcacctgtagcctcagctacttaggaggttgaggcaggagaatttcctgaacctgggaggcagatgttgtggtgagccaagatcgcaccaagactgtactccagcctgggcgatagagtgagactccatctcaaaaagagaaaaaaaaagaaagtaagaaagaaagaaagaaagaaaaaatttgcactccttggaagaagtatgcacagctctgcttcattatctctgcatttctcttccttagacttggtcactattgattttctactctcctaagtttggactgctcattcctcctaatataaatgctgtctaagcatgtgttgtggaagaagtatcctctgttatcttttgggaggacaaattatgacagccattagaaaaaaaaagattaatctaatttagaaaatctcttagtgtaataggtctttaagtagatttttgtgtggtcccagaattgtagctaaatccaagattaaaatattcaaccttatccaccccacattctaaataagcttcctagaattagagacatctaccctttatagcactttctaagagattaaagaaataccgccaactaccataccatatcctacccccatgttaatataagaaaaggatgagagatgagagagggttttcttggacctaggtctttgagagacgcagcgttcctgaggacaatcaattcccttccctccttgtggattagttaggggaagggagaatatccctcctgcctgaagctaagtgaaggaagctccaagaatattatgcataaaacttaagtgcccagcaagaagagactagcatcttatccttagactgggtgcttgataaacagtagtcctgttggtgtaggcagagtagggagtgcttaagaagttcttgtaaaaatgtgacttgtgccacctcatgttttcggcctttgagaacatagaaaatggtgcccacttctgatgaagagatttggaaatcaggctccctgctataattgattatgggatcatagaggaggccttgaagtggtgtgataagcgtggaagaagatgagaatgccagctattccactccagtctttacatccctgcagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggtcacaggaagttgaagatgactccaagaaaaccatgcatattgctaatatggagacaattacatcacctgaagctttagcagcagacagaaccaggccaatccagagcaatgccatagacatcactccactatcttcatgtgcctttataaggagatctctgcctttccatccttttccctttccctgaaaaactgaaggctctaggcccagaagcagcaacggaaggggaaatctcagagaaccctcttctctttcactctacccaacaaaggatcatagatcatagctctagtctccaaaagggaagatcaatagcctgaaatcagatatgagattaaagttttttgctaaattagaccaagtggttggagaataatagaatctactcagtacgttgttaagcaggaaagctggatttgacaaagtacagttaaaagtaatgacaggaagaacaaaacaaagcgtaataggttcatatttatatccaccaagttgagactgctcaattacaaaagaaatattaatgcacttctgtgtttttggtttttagtccagtttaacagcactcaatctacattagtaaatgaatatttctaaaccatatcacacattttgaaacaaaacccactcatattttcgggcactttttcaaaaaagaaaaaatatattttcgacaagatagggtggatgatggggaccctacctataagttttatttcttcaaaagttgccttgctgtcattgaaacaaatggtgagcaaaacgaagttaacagtttaacattttattaaaagggtgtctgtatccaactctaaagcactgccctgactctcaaccctcctggagggccccctggaagctgcccctgaagcttccttcacactgacctcaatagtgggaaatcttattctctgggggtgaatgtaaactttagagttaggcagaacataatttcacacattttttcatgtattagacatcagtcgtggtgctaagtcttgaggaggaaagatattatattgggaaaaaaataactaggctttggcatcagaaaatgggatcaaatcaaagctataggctttattggcagtctagtcctgagaaagccccttagcatttgaatatccatccattcatcagtgaaacgaaaataatacttcataattgtattgaaagtccttaatgatatattatttgtagagcatatagtttctgggatttagtaaacatccaaatgttatcaaccttcaacataaaaagattatgatgtcatgcctcctaaacttaaaggccagttgtggagacatataattacaataaaatgtaatgagttctctcagatgtgagcagattgctatgacaataaagaggcagatgactaactttccttggaatgctggaacagtgatatttgagctgaagcttttgcagaaggagggattcttcaggtacaaaagttgttggacacggagcgatcccggcatagccaaaggcaaatgcagagaagtatgaaatgttcagtgtatttggagagtggggagaagtgaagtgtggctagagcatatggcatgtagggggaataccaggaagtgttgctggaaaagcagtcagggccaaaatgtgaagggtcatcgatactttgctaaagggcttggcatttatccagcagaggatgaagatctgcaacggggatccagcagaggtttttagcagggcagtgaaatgagtggatttgtttttcaggaaatatttccttggcatcagagtggctgatgaattagagttgagagaaactggtgtcaagacttacagcaacagcctcctacctgggctccctgccaccatttcagacacgctgaagtggaggtgcctgcaggacactcagtgtaaaccacactcacaaagctaagcagaggaaaatcctacttagggccagataaattacagggtaattatttccactgcagaaacattctctgcttcataaaaggattcattttaggatcccagagttcctctaaatagcaagtttcttagtgcatttaggcatccctttacagctcattagctacttgatagaggcggagaaagtcaagaaaatcctaaagatgtactttcaagtgttcttattaaaaatcttcatggatgaaaataaaatgtttgaagttatcatttttcaatgaaaaaggaaatttgatttataaaagcacttcgatgtgatttatagaaactagaataagaagaatgtctgttacgatattccatagaatgcatttcacaaatttcagccaccataactcaaaacactgtagggagtgtgacaatatgagtagtcagattaatagaaatagctagaaatacagctgtttagccactgaataagaacctctattgtctttaagcctgaatctcatacatagttttatgttaagtgcttctctctgtccacagtttctcatcagatgaactatgtcctttgctacataaattaaagaacatgttgtaatttggatattttatatatatacaccaaattataaaagaaaaactattttaatctcattatattgaattttcttgtgaatagatatttcacgagaatacattattaatatcaacggagtcacttccagaatgcaaataaatgtagaataatttcaattttaaaacaaaaaacactgttgggaaccctctttgaggaatgctttcagagcattctttgacctatctttactgggagcaactcctttgtagtgaatttactttttcaaaatagacaaatttcaatttgagccaaatgcttctcagttgccacgtgagaggtatctaacttagctactgtctataagtgtctcactcggcataaagtgtagtattagtgttccttgtagtaccttcagttgaactagttcagagaattccttgttgataaaagcatgtggcagaaactgacaactgtctttcagtattcattcttttctaatgtgtttgataacaacacacgtttttatacttggctacattacttaaaaagttagacaatatttaccattcttccttgtagctatatgtagtcatctgactaaattaaggctaatatgatataaatgaatatatattatgggactttcagaaaagctgatttaaatgagttgatttggcttagaggaaaacattttctcccctacttcttccagctattgccactaccaccaccaccatcatcatcattttcatcatcatcatgaaatgtggatgtaatggctagaattccagcagccatcttgaatcaagaggtgatgaaaattatcaatgaggatgggaaaacagaaaaatagaaagctgggttcctagtgtcctctgggaatcctgtgctagctatggactgtagacattcagatccctttttataatagaacaagcttctgccttgtttaaaccacttttagtttgtttaaagtgaaaattaatcttagctgacacaggttatatcaaaagagaatgtattcttgtctacataaattatcaggataaacatgcacaagatgaattaaggtgaagtgttttgtcattctgaattttctagcttcacaaataatgatgatgcaaataagaatatcccctcacatcagtacaggattttagagataggatacaggattttagagataggaatttttatatctgtgaccacatttaatctttgaagtaactctgtaataaagcagaaggacttccatttcccatacaaacagatgatgaaattaaggttgagctatctgcctcaggtcaaacaacagcagttggtacagccagaaaccaaacgttcttgacttaaaatgtattgctttcctattgataacttgcaggttctacacgtgaacattagtcacatgttgtataccattcactacctgactcacttacgtgctcctttgattaaagataaaaaaaatagctttcatagtttttcactgggcttctgtttttgccatggtgcagtaacagtgactagatttaacttcccactttaaacaaccaaaaattataccatatatgaaacaatgattttcagatgttgggaaacatgcagtgtacaactgtgatccttgagagaaaaaaacatagtgagcattgccccagaaggaaatgtctagacagcggcacagaaagaaagaacacaaacagccaaggagattcactgagctgaggaaacagaaactggatttcagggagccaggggaggcaaggtggctagaagttgggtgtcagtgtatcagattaaaagaagtcagtaatttagacgaatactgacctgcatatgtgtgagaggaaactacccaaggctatgggagaaaaaaaatacacaagaaaaaagccagataattcttggagctcacacagagccaagagtagttcatgtccccacaaaggtggacagacctggtaatatatggggctttggctggagctctaagaagggtataactagtttaataaaattctaggaaagtcaacatagagtacacagaaaagagatggaagaatagaaagttacacagtaacctaggattttatgaacttgaacataaatgacaattgcagcacttctgtttgacctcggtatttgtcatagaattaaattaaatttctacatatcggatatagcaaggaatagagataaaagtctttaccatcgcggagcttatattctaacgagagtagaagagagagacagtcatgtaataaatattatattggaggaaatgagtgctattagaatataaatgggggtaaggtgttgtgagaaagaatgtggcaattttaagaagttcataaattcatcaaggtagatgagaccaaagacagtgatgaggccagggtggctggaggcaacgagaagaacaacaggagagaagtcagagatgtattgatgggttagatcctgtaagccattgtgaaaacaggagagattgcaaggtttaaagcagaggtatgacataatgtctcatatctcgaaaggatactcttcctgttgtttggattaggctccaagggtgcaatggtggattcccaccactaaggaggatattacagtattccagaggagaaggactgaaagcttggatttgaggggcactctggacaaggtgagaaatggtcagattatgcatataattgaaaaaacagagccatgacaatgttcaaatattatatgtgggatataaaagaagagaagaatccaggatgcttttgagagttgtggtggtttttaagcaactaaaagggtagagttgccattaacgacaaaggagaacactttggatggagcatagtagaagagaagatcaatcctggacatgaaaaaatcaatggcggtttagtgtgtgataccacaatattgtgatttatttgtttatttttttgagacggaccctcgctcttgtggccgaggctggagtgcagcggcgcaatctcggctcactgcaagctccgcctcccaggttcaagcagttctcctgcctcagcctaccgtgtagctgggattacaggtgccccccaccacgcctagctaaatttttgtatttttagtagagacggggtttcatcatgttggccaggctggtcatgaacccctgacctcaggtgacccacctgcctcaacctcccaaagtgctgggattacaggtgtgagccaccgtgactggcctttattttttgtaaacataaaaatattgtaaaatattgttattttaacaatacattttaaagaaggtattagatctgctgcatggtcatttttaaatgctttaaaaaagacataatacaaaatagctttccctttcaaataacataataaatcctacataattgcatattttagaagaaataggaaaacacgaaagtttagactcttgctacaaagtgaagtctctcccacattaaacacaggaatgttaaacagcctatagcgttctcccaaatagcccattgtgcaacttgaacaacatgtatttgcaatttaacttctgttttgcctaacttctttttcaaatgcatcctctctgtgttgcaacactgtcacttatacagacgtgcacagcagggcctacctttaaatactgaaatctctgagaagttgattgctcttccaatcacttatctggctgcaaaccgctgagttgttgccatgattaacagttattctttcatagacaataaaaacaggaaggttatatagtgaagatttaaagctagaaacaaatatattgataatgaatacgaacactgtcattttgcagctatgaaaactgaggacagtgtagggaagagatttcccataaaacgtcaactctgatttagttcaggcagttagtttcaggaaaaaaaaatgtattaaatgtgttatgtaaaacggtgtggggagaagaatggttaagtttaaataacttgttatttagaagatggtaggtgaaaagaaatacatatatatttgctgctgtctgtctgccccctatactccactgtgtgaaaatgcagtaaactgggctaataacttatagcacaatttgcacagtcaaaatgaaggtttctgctagataccattaaactcaaaggtcacatttaatataaaccttttatcctgcctggactcaaagcagtttcaggatttgtcatttaacagtcataaataatgtgcctcattttgtggcatcctggagactgagaatctctcatattttcttctcaacattaaaattcacaaaaatggggggggggttaaaaaaagaaataaaaagataacttggtaatttctgttgataatttcaaaagctggtccttgagctttggtggagacaatctcgttagcatcagtgatgtgtaatacaataaagagaaacacacaaaaatcaaacaccctgtctggagtggcagctgctcttgtcagagctatctgtctcgtgccagtcccagaagtgcaatggtaccaatggtctttgtcccatgttcttcctgcagcaaaacttgtcaggttatgatgtgccaatctttatcaatgtctacagttctgcacaagaaggttcctcacagaacgtgcttacgcttctgggcaagaaaacgctgtgtgctgtcactcttccttcccccttgtaagcacaattgtcccagcaagcgagcgccagagcagctgaaggcgaaggagagcatctgcctatttctaagtcttggttatctgaaagcgtctccaattcttttttttttcccttttttttggaagctgcttttgtagtcagtagggagctctggatgaatcagaataggaattacccttttaagagggaacaccttctacttgtttgaaactctaaatccaataacactatttccagacatgaattaagctctttaaattgataaatgctcatatcattttattttctcatttataaatatgcatctcatttcattcgcacagccatttccagagtaagtattatttttccactatagtgatgatgatacagttttcaaataagtcaagtgacttatctgagatcgcccagcttagaaggggcaagactaagtcttagatccagtctagctctcattttacttcattttaactgcctcatttcaggaagttacagtttctatcactataggagtttatcctccagagagttgaagaaccataagaactgtctctctccgtggctcaacagatagattgaacacagctcacactactcacaggcctgtgattcagccaaattgttccttatttcatgtagctgtggtgactctcaatagattggatcttcgtggcccatttattccaatgcagctttcagtttcactgaccgttgtggaagctgtgggcatttgactgtgagtgagctctgattccagggttggggaacttcctggagtaccagggcatgaaagacccaagtcaagaaaagggaggggcttttttttaaaaaactgttacttttctccctgtgtgtccatgtaatttacaaatattataacgctcgttactagaatgccaaactgaattaggtcatttctcaatctagaagatgcttttccttcgacagagacgggaactgtaacatttaccaagaaactatatgattgtgtgtcacgttttacatttactaattcatttttgtttattcttcacaataaccacgtgagatcagtgttatactcattttactgcttaggaaattcagagccagaaaaggcaagatattttctcaatatttcatgtttaataaatgagagaacccagaaccaaagctagaaataataacagtgaatctctgagtaagcacagtaacatttcttccatgaatcttggtgtgttttacttttttatttgcaaatgttctcctgggggaggtaatggtactgtcaaatatttttgctaacagaagatgtggaatgagaagagacaagtgacacataggtcaccatcatcagatgctccaaataggtctatatgtgtgttacagtagaaaaaaggagctctaactacaaactggcttccagatcagtcacattttcctgtgttccacatagtttcagttgttatgatgaagcaacttacccacgagcagaaataagcatggagaaggcaaattggtaattgacatgttaaaagttgttaaaaatgccaactcataagcattgttagtccaaggccaacagctgtcttaaatatcaacattaggatgaagctaaatagcacacacatctttgatcacataagaatgtttggagaagaatgattttaggaacttgcattatgtaaagaataatatttgtcaacttaaatgtagttacatgaaaacaattgttttaggtactctcacatgtaacccagttgcctccttaggaatgaatttattccacagctgctgggagaactgctggaagaaattcttcatgctttcagctccccccagatctgcttaagagagctgccttacaatgactaatcgacatggaggtataggggccaatcctcttcagcctaaatcagaggatgcttacgttgtcatcggctcttcccgaactctctacaggagtgaatggctgtgttctcccatcaaagcttcatccttactcacaattccctctgctgaatcctgtttccttgtcttccctttcctggctttccctcgaaggtgttgatatcattttcattctcaaataacccccacctgcccattagactctgcactaatctctgtctcagagtctgtttttctgagccaatgaagaagggagagaggagaaatacttggtactcatcacccagcaatttaaagaagtctttcttaccctcacaccactactgctggttgctaaaccttagcactataattgatggacctcacatggcaattattcattggagcaatggtgcttcttcagttaagatttttacttactacacattatctgtagcattgggcccaaatgtaagtgcttggctaatggttatatgggtcttaaaggccaaaaagccataaattcaatactactttaaggctgacagcttctccacaacactcctgccgactctgtacctattatctcctagcaggtcttctgttaggaagttctcattgtctctccaaatagctcagagccatctctgtacagattagactgctctctcttatttcctccaaaacctttttcccctgtagaagaaattctgccaatcttttactggtggtagacatataaaacaaagccatttctttgatataattcttcaatgacataaaaacaactttctagtttccctaaaagtctcatctaacgtccagctttttattattctttcctcacaggaattaattttaagactcctccttcttcactttgctgccctcctctctatgcatcccactatcttatctgtattaaaatgttgaatatagtcatgattaattcattgtacaagcacgtgagtttctattatgtacaaggcaccttgctagaccctaggaatatagttcacaaggagctcagataacacagtaaatttaggaaaatttactttcctctgaaaccaatttccagaccattgttacaaagacaatgtagtgtattgttatattcaatgacagaaaaacaccatctcctcccatttacatttctccaagtgactatttcttttattttttctcctcgcacaaagaagtattattaaattattgttaaccagaattttatgaattggacattgtcacacatccagccatttgttatctaccccctggtaatggaggttattccctgccacccagatcttgttttactatccattgtctttaacaacaaaatggaaattatttttccagctcttagtctgaaatcaaaacaagatcactcttgcatggaaagtaaatgaatttgcacatcgttccatcaaatgaaatacatatcataaaatttgtatgtgctaaaaaacttggtttccctttatataaaattttttataacgtgtaataaacaatacctttaaaatgctacataatcagaaacttctataaaagatttataaaaagaaaattattgacatttggtaggatttggtaggcaatagcagggtagaaaacaatctctaaatagttctctcattcctttttcattttatctcagaaatcaagtttaattcacaaaattgtggagctgaaaataatctttaaaactaccattttcaggtgagaaaactgaggcccagagaaatgcaatatctgtttaatctacagagagtgtggagcaaacacgggcttaaactctggtttccaactcttatcactttatttcacaacaattttttctttgtactggtaagcatcttaataattgaatattaaggatgtgagaagatgaattaatcgaatcaggaaacttgatgtttctaatgtgtttgttttatttataatctgtgcagcaaggaaagcatgtttactgagtggcacttgctatacatacagtatgcaagagcacagtggttaagaacatttgctttcagccagataaacctggcttcacatccccacccagccgataactagctttctggcactgtgcaagtcaattaaccacacaaggccttagtttcctcatccctaaaagagggataatgaaggtacctctttcataagcttgttttgaggataaaacgagttaatccatgcagtgcacataaaactgcccaacaccttaagcgctatatgagcgtctgctgttgtttttgttgttgttactatttttaaactgaataagtactttttccatattcttctcaggttcagtttgaatctccactcttttcactttgtaccagccggtaaccaaattcaagctgaagcaaagaggtctaatccaggggaagaagtgggcacaagagtttgactctattactgtgggtaaatgctctttattagagagcaaagaggaacgtagacaacaaaataaaaacacatggagctgtaaaacacctgcaggcaggtctcaatggctgccaagtctctttgccatcatgtcaataatggttttatgaataacttagaattaagctttagtattttattaggaaaaatatataaaatcaaatttgaagatgtttctctgaattgctttgctttaaatagttttgtaacggtacacatgcatttagttcttttaaaatcctaatttaaaaggatcaagggctcatcactgccatcagtaattcatgatatatgacatactaattaattcttgtcacttttctttttttcttttcttttcttttcttttttttttagatggaatttcgctcttgttgccaagactggagtgcaatggcatgatctcggctcaccgcaacctctgcctcctgggttcaagcaattctcctgcctcatcctcccgagtagctgggattacagacgtgtgccaccatgcccagctaagttttgtatttttagtagagatgtggtttctccatgttggtcaggctggcctcgaactcccaacctcaggtggcccacgtcggcctcccaaaatgctgggattacaagcgtcagccaccacgcctggcccttcttgtcacttttctacgtcaggaaatcacgttctattaatggatctaaaaagtgaaatttataaagataaatggagaactttaaatttgagttcatcttgtggcagggcatttgtggcatgtgggaaataagtaaggagatactggcatcttttggggccagttgatctggattatatgtgatatggcttagatctgtgtccccacctaaatctcatgtctaattgttatccccaatgttggaggaagggtttgttgggaggtgatggatcatgcgggtgcgtttctcatgaatggttaaatactatccctttggtgctgttctcatgatagtgagtgagttctcatgtgatctggttgtttaaaattgtgtggcacctccccgtctctctcttcctcctgctctggctatcacctgcttccccttcctatgtcaaccataattgtgagtttcctgaggcctccccagaaggagaagcctatacagcctgcaaaactgtgaggcaattaaagctctttttctttataaattacccagtctcaggtacttctttacagcagtgcaagaatggactaatccaatatgattcacaattgcatacacaacaaagtactttgactaaaaatgagccaaggcggaaaagaggaagagcattttaaaataaccattttatttggacaatatcaaacttcataatttccatttgattgctagatttgctccacatttaaaaagttacaaatacatacctagctctatgaccacaacacaaatgtatcttccaggtcctgaccctgcctttcggctgcctattgtgacccctagctagatgttgccctagttgtgtagctgggttggcaaacttggaagtccacatctttgtttatttggtaaatgcaatgttataaaaattagaaacatttacttataaatatctatttttattttttttaattatttttaaattgagatggagtcttgctctgtcacccaggctggagtgcagtggtgcaatcttggctcactgcaacctccaactcctagattcaagcaattctcccccatcagcctcccaagtagctaggactacaggcacttgccaccatacccgactgatttttttatttttagtagagatgggttttcgccatgttggccaggctggtctcgaactcctgacctcaagtgatccacccaccttggcctcccaaagtgctgggattacagatgtgagccactgcgccaggtcattttaatttttaaatatcagaagaactgactagtggtttttggcctggctgcctagtgggatcacctgagatacttaaacacgaaaaacccccagaaatattttaatataatagatgtggtttgaacccaggtattggtatgcttcctttaagctcctcagatgattctcatgtgcctcatgctacagtgagctgggctacagtagcataaattcccaaagtggttgactaacagcaccaacatcacctgggaatatgtgagaaatgcaaattatcaggccatatcaagacctacacgatcagaaattctggggtgagactcaggaatctgtgtttgaacaagtgttccataaatgtgcatgtgattctgactcacactcacatttgagaaccactgcactatgtagaccctgcacatctctattagttattgcttatagttattgttttcactcagttaactgacttacctatagctgtgtttgtatttgaagatcctctaactgagttcattctcattttcccagacctaatttttcttttgaaattcctctttctgattatgacaaaaagacaccaaccaagcttcaggcattgttttcttttccagtgctaattcaaccctcttaatattacaatcatttttttttccttatagtcctactgccattgttccagtccaggccctcattacttcttatcttgacaattgaatctgtttctggcttccctgcctctagtacctactcactccagttcctcatatatactgttgacagttttgtcttcctgaatgcaagccaagtcataaactcattcagtttagaattcttcagtgacttgccattgaatatattcagtctactccacctagcatcaaagaccctccatgacctggctcctccttgcatttctacacttctccttcaccattctacttccctattaactttaaactctaaataatttactattgcctaaactttcctactccatattgacttttaactttatgtttcaacttatgctttcattccacttggattgaccaaactttgtcttctgttaccatctcctccaaattctcctcacactataattgtcccaaacaccatttccttctgaagccttccttgatccatcaaatcttaagtagttttgatccactctgtactaccttaggtttttattccgcctctcatacatcactcgacatactgagataacatgcacacacagacaacatattagttgtcagttacgaactatcatccatctagttggttaaccaaaaaaataataactgacttctataagataagaactgtgctaagctctatatgactggtaaatattggttcattgaaaagaagccttagaaatttgggggtataaatatgttttttaaaagtttctttgaaggatttttgaacaaatggaaacatgatgttaaatattccaatagtctactgaagatgataatctgtgaatcctctcctttccatcttcaaggcaattcctctattattactctctttattagatgaaatgagacacaaataaatcctccaaatattgtatcttaaaagcatcttgcaccaaccatctgaatgacaaagaggtgagttaatgtatttgtgtgactccatgagaggatggtttaaagggaagagtactggtaacaagataagactgggtctcagccaaacatggcagcttgcctacctttggtgctgcttggattttactcaaaacacacaattctccaatttcctctttgctagagttgggtgaccttttctgtttgacaaagcctcacaaggctaacccacacacacattcatacatgattggtatttctttttattttaagtgttcttcatgttccggagccttctcaccttaaagccacaaattctgcacattctcttaggctcttatatgcaagccattaatctgacagatcagccaatggaaaaatggtaactaggttaaaatgctatgcatacgtagtactaattagaatttaataaggccttactcaaatgagagacactattatacctgtaagcaccatgacagcgcagggatgtgatcagtatctttatactaaggtacgttaataaacaccagtggtgctggagggaggaagagatagccatcatgaataaccaactgcttggacctttagaacatcataaatagtcctttaaatatctacattttggacgaagtgacttaggaaggcttaaagctggggcaaatcaagagaacaatatgcatgggtaatataaagaaagaaatatagttcaagtcttggacatctaaaagtaaaatgtaattcaggtcaacaaagatttactgaagtataaaatatagaagaaaatatcacgaaaatatttaagatacaatcctgtctctagttatgactggcagtgtaaaggtagaatataacaagtataaaatgatcatgatataaataccaccaaggttatatggtgtgaggattcgaagaagcaaaatataaacaaaaacaaacaaaaaatagattagcaaaagaaatagagaaacatttgatagagatttgccttataattcaaattacatttttaccaggaaaggtgtggtatgaagaggaagccacaggaacagagaacatgacaggtgtgacatgtattcagatactatccataaatcaaatctagagagaatacaagtaaatggggcaagaagtgggagacgagactgtaaaacttggtggggtcatcctgataaggccatgaacatgggaatgagtacttagtgctgagtaggtgaaaagagatggatgaaagccaggtttcttattctcttaggttcaacaaagaacgctgaaatacagcattcttaacagccgactctattgaagagactctattgaagagactcaaataaggttcttcggctgtaacatgtccttagaatgtccagaggaaaatcagtttccatatcagacacctttacttctattctgaaaaattctgtaaactcccgaacatgattattggattccagattaattttttcattgttaaaatgttagcatctggaaactcaaaaggaaagaataataattagtatttttcttgcacatcagatttcaccttgctctagtgtggtgttctttaggaagctcagttggcagataccaattgaattgtgaaaatatgtctctcctccacactcaaagataataagagtgtctgggaaacaggctgtatcaatacatgatacttttattgtgtgtgaaaaagggaaaaattccaaattaatcttaagaatatactgactgatatctatcaagttaacccgatacaacaggctggggaatggtaaatctattccatcaaaaaatatggccatgagtttcaccaaaccgagtgctcatcctggctctttgtaaatgcaggatgaaactcagcacactttcattacttattctgcaaaaacaactgttcattagaattctgagaaatgagtgttgaattaagactcagtgtctccatcaggatgcagttgagaaactcccccacgtttcatgtccttcctcttcagttgcacgtattccgcactgcacctctgcccatactttacccaaggttagatataacttagtaaagtgaatttaaaattattaatattttcaaagcaaataaaatcacatgaaagggatcttgcaaatgcctaaattaaaactcttttcttttagctatgtaccttcaacacattttacttactagaggcgcctgaacactgaatattacaggttacctaggaaacttacagtgactacacttaaaaacaacacaaagccctctaactgaagcagaataccattttagaaaagtctattttgggaatggcaaaaagaaatggttaacaagtaaatatcagtgcatagctactgtcacatttgagtttttcttcctcacattattcttcaatttctttttatgtctgccactgagttgttcctgaaataaaataaaagctaaagatataataatgaataaagggcaattatttctattatcagctataatccagatcatgagatcttactccgtggctcctcagataatatggaaataatgttatgcctttttagcattcattaatgatggtgaccatacatccagtttgtctggtatatttccagtttatgcctatggttctggcaaaattattcacggtatctcatttcacttgaaaattatccaggctcggatgataaattatgtttgccgtaactgtctattacaggtatatgcagaatgtattgagaaatataaaactgtactaggatagtcagtgcccttggggagctataaatgtataatctaattgaaaaaatataaatggtaacatattctttaaaatattcactactaaacaatataatgatattattatatcattcactatgactaaattgacaaaaatacttgtttccgcaaactctcctgcctaatgtaataaattacaccaagaaggcacttccccatagcccataaaaagaagaaagacaaagtgtatagagtgagttgtgataattctgcaagcctcagcagctttgttagcagcaaaatcaaggtcaccttggctactgcccaaatctaatactaccactgagagattgcctcagggtagggattttgtaagatacctggagagttgttgcagtgttttctgaaatccaattacaaaatccattattactactagacaaactgatacagcatttctatatttgcaaggtgcagagcactcacagctcagcaaaacggtgctggagaacgctttctgtattatgatgatagtggtgatgatgatgatgataatgacatacaattccatttatttaaatactttctactccagtccttcgaaaacaaacgtgaaggatttcctacacaaaactggaagaagataacatttctttttccttttctctagccaatccttgttttatatagtaaataaaaattataccaatatggcttgataaagtgaaaagacattttagtgttcaaatctcaattctgcatctcttagatctgccattttattatagaaaaatctgttctgggactaggaaaagaaatggttaacaagtaaatatcagttcatagctactttttttttaatttgggcttttcttcctcaacttattcttaaatttcttcttaggtctgccattgagtcactcttaaaagaaaaactctccaaggctcaatgttttcatttttataatgaggattatcatagtcctacctcagaaaattagttagaataaaaggaaagaaaaagtgtgaagtgtctggcatgatgtcaataaaactcgaaactgaatgttctcaactgtacataatcctcagagtagttcgagttgccattgccactgagattcttgcagtgacctcttcttacgctagtaggttacagcagtagttttaaaagtccagtatgtaaatgaatcagctgaactacttgttaaaatagaaattcctgataccatacccggaattctgacgtaatacatgtgagagaggccccaggacttagcatttcttaccagcacctgccttgcccatccttactacaggccacatttacacaaacacaagtcagagaaaatgaagacttgccacaacttcaaggctgaaatttcacattaaaaaaagtatcattagccacttaacatctccccctggatattctgccagcaagtctgtatcccaagctgaatttaacttaaaccttgaaattattgttgcttctcttaatgacccttcaatctcaaaacctcagtatgctcatcctcctgctcactagccatcatcgctctgcactcaatattttgcatatttctcctctattccatcgtcattctctgccccaccatcccttgcctgacttttataatcatctcgtctttgatttttccatctccattctctccctcatgctaatcaatcctactcttgctaccacacatacattcttaatgcataattataatcttaaaactccttataagcctccaatgaggatgtaaaaacactgaaatcatcatatgttgttgatgggaatatataaatgtgcagccacattggaaaacagtttggtaattcctaaagttaaacaggttaccacattaccaacacttctactcctactttatatatatataagataattaaaaacatgtatctacacaaaatgtataaacaaatgttaatattcatagcagcataattcataacagtgaaaaagtaaaaacaactgaaatgtccatcaactaattaatgaataaaatgtgatctcttcctacaatggaatattttcggtcataaaaaggacacgtggacacatgttataacatggatgaaccttgaaaacatgctaagtaaaagaagccagccataaaaggctacatattgtatgattctacttacgtgaaatgtgcaaaatagacaaatccatacagacagatagtaaactgatggctgccaggggctgggggaaggatggaataggaagtgactggtagtgggtatgggatttattttgggggtgatgaaaaccttctgaaattagatactggtgatgaatgcacaaccttctgaatatgttaaaacacactgaagtctccaatagctcctcaccacctgcaaaaaaacaaaaccctaaatttcctgacttggtatatgagacccattcttctatagcctctcttcatgcgtcctatacccaagactaagtgaaccattgctcttttgaagtcctggtatgcttttttccccatggcttagggcattttttgaatatctttgtttcatgcatgattaccataatatgtcacatagtatcggtactctatgcctgaatgcccagtaaaaaagcaaactatttttttcaaaacacagtatcctttaaattttgtatgtagcaatctccatttgaaacatgaacatgctgagatccttaaaataagaataaggcagaattgtgtgtgttgcaaagacaacataaaatgccattactgcagccattaataagtaagcacacatctatgtataatgcacacacaaaacccacatatatacatacacacatactgctatggtctgaagttttgtgtccccctcaaattcttatgcttaaatcctaacccctaaggtgatggtaacaggaagtggaacctttgcaaggtgattaggtcatgagggcagaacactcctgagtgggattagtgtccttagaaaagaggttggagagatctaatgtacaacatggtgaatatacttaactacaacatatcgtatactagaaaaatgccaagagactgaatgttaaatgttatcaccacaaaaatgatagctatgtgaggaatcatatatgtcacttagctagatttactcactccactatacatatatatatacttcaaaacatcatgttgcacttggtaaatatattcaatattgtgtgtcaattaaaaaaaatgaatataatgataaaaagaggtttctcaaaggagcttgtttgccctccttccgtgggaggatgcagcacaaaagggccgtccaagaaccaggaagtgggcccccatcagacattgaatctgctggcaccttaatcttgagctcccagcttccagaactgtgacaaataaatttctgttgtttacaagccaccaagtttatgctattttgttacagcggctcaaacagacttaaacacatacatatacaataaaggaatgatcatatcttataaagtcttactactctgtttcctcatactgctatcagcaaaatcactactttagcagcaatctcagaaagaaaaataaaacccaggaagcacagttcttgtacttatgcacagacatttaagccttaactccgtaccctgtgcctctcaccttggtttatgagatatcctttcctttgcttttatgaggatgccagttcaatctttttccagaagtagaccattaagcagtcaatatccgaaatgtaccctaaatgcttcctcatatttccctttatctgactaatggaatatggaaagcaatgtttaaccagggaaaaaacatttacttctacctggtaaagcttaaattccatttagtgctcagaacttaaagtaaaaaaaaaaaaaaaaaagaaaaaagaaaaaaaatttctatcacaccatagtaagtgagcaagaggtaactagtaagtatatgaaattgaaggaaaaattgactgaaagtcaaaacatagtctaggaagggaaactcactcccaacgaaccatcattgacaaacgcaggtcaattacttcttattgaactctatgatacatagtcatgattttccatttgtgctcaaaacagaagcaacttcagcaaaaaatagaattgacaagcattgaaagagaactgcaaatagttgaagcaaggggaatgtttttcaaaacaaaaaaatgttttgtttcctctttctacttttctgtattttctacaagaggacctattactttaaaagtttgtttgtttagaagaaataaagataagtcatggggggatgaggaaagaggagatgttggtcaaagccaacaaagttttgatcagacaggaggaataagttttagtgatctattgcccaccatggtgacgatagttaacaatgtgttgtttaattcaaaattgttagaacagtggattttaaatgttctcgccaaaaaaaaaagtatatgggtagttaatatacaaatcagcttaatttaattattccacaaatgcatacacatcaaaacattacattgtactccatacatataaaaaattatttgtcaattaaaaaataagtgattatagatgacatgaggcatgcattacccatcacagtggtaaaaatccagcttccctgtgtcctgacctcttattctgttgagcaagcatatcacatttaatcatgacaattgcattacagatattagcgatatataaaaatgtaaataggctaaatgtaactaactttgctcttaccacaacagtgttttatctatgtagcaaagcttccatgtcaacttgtcaaggcgcgtcacctttggacagtatacacagacaagatattaaaaataatggaaaatttatcacaatcaccatgccctcgggtgatttttccctcagaatgagaaatgatgcatttttacagtgttagagataaatacagaatcatcatcactattttaggaaagaaacaatactcagaattgaatgtcatattctcaaggaatccacaagtcatgtttccttagggcatagaaccattaagatgaatataaaagaatatcacttgctccactgatttacattcttgctttagttacaggatttaagaaattattccgtacaacttttaatactgcgtctgaggaaaaacagagggaaactagacactacgagagccaatacatttgcagtcacagagttcaattacgtttttttaaaattaacttattcaatcctcacaataattttccgagttacatatgtagcataatcctcatgttacagttgatcagataatttcaggctatggtagagcttattatattgtgagattcctcacctcatgattggagctcattgagagtaaggacattctatactaaacctaagttgtctaacttctgggacatggctgatgcactataaattttatggatctaagtgaataaaattttaaaaaaaaaaacctgagttcttggagggctatgcacacagaaggaatagatgaaagaattaagatgcgaacccaagaatgtctttccattttaccaagccatactggtaaaatgtttatttatataatggtacaaaacaagcatttgagaaaagcaaagaaaaatgattatcttcctccagtgataggtgggaatccttcacatttgttcctttaactgacttctctcatagggaaagtggaagagctaaaatttagatgcaggtattctggcccctgtgtttctctaaaacctcataacctactattggctaatcaagtgtgtgttgatcattgcagatttttatttttcagaaactctaaaattgttttttagagtactgctaccaggttagaggtcaactatcactattaagtgatacaatacaacattttgaaaattaattacagatcctggagactaagaagatccatgttatgtagtttaaaatgaggtaaatgtatatttctatgagcaatttataaatggctattgtaagtaatttgaatggtcatggaaaataaactagctgaactacatgctattcctatacagctttggaacattatgtaaatgaaagcgatctactcatggaatccgaaaaacaaagctcttgcactatgtttactaattagaggttcatacacctgaaaagcttgaaattgtcacattcactttagttttctcatctgtaaaataaacaacttacttttcatgctttacataattgttgtaaaaatggatgatacattatgtgagaaagatgttgtaaactttaaagtgtaatgcatatgacggagcttattacctaacatctttctacttaagctgtggtcacagcgcaatggcatcaacattcctaggaagtgaactgatccaaagaatctcagaccccattccacacttactgaatcagaatatacattttacccatattgccaatagacttattcacatgtaagttggatggaaagcagtaatttcactactttcaagatccacttttatcattcaatattaaaaatgttttgatatcccaattatgtgatgtgaaacttcagcaaatccatgggcacttatttagacagatacatatatggtgttactgtttcatattctaattaagcattcctctacataactgttttggcatacacatatactcttgatgtatttgttttttgcatcactgaagcaaattttagactgcacatttctggacggcaaggattgccttcaaatacttagttcagtgcctgataaatatgtaaactgccttgagaaacagtgatgacagtatcataatctgacaataattagagaaaaaatgctttggatgcacaactaagagtaggaaattctcagaaacattaattccaactcacctggaaataacaattcacagaatagaaaaaaaccaaaaggttgctaatattcttgagcacccacacttcattttgatgaaatctaatgtcagactaacctagagtttcaggtggaagtaatcattcttttttttaatctctttattttttactgtcatagggtaacagtctccatgtataattttaataggattagaggacaccttgaaatgtaaggaatgatcaatcaaattcatatagtgcatcagcaattgtgatctcccaggttgtggaaatcaagttgaaaaatatagatggtagacatagtcctggaattttcaaaacaagaaatgaaagctttaataaaattaaacactttaagctaatgatgacctacttaagaaaatcatttacctttctaatttttaagcacttgaattagtttagatttatagtctctagacattgctaaatttgattaaatgtgaaaaacttaaagttcacctgtaaaaatgtccttgattaattttatctgttaagggaaaacctataccatcctctctggccttggaaatatctctgacagagttccgaattcttctctgtattttaaatattgttgatatattattgatgcaggtttcagtcatgctgaacaaaccttaaaatgcatggaaaatctgaaaatgcctatttagataggtcacaggcccccctttttttttactaagctaaaatttaaaaatcaggaatcacagaacatcaacaacgagaaaagaggttgaattagaggtgctctgtagaactccaaataaacactttacatttgtattttcatgcatttaaattagggctgttaaaataagagcaggtggatataaaactattaggttggtgcaaaagtaattgcagtttttggccaggtgcagtggctcatgcctgtaatcccagcactgtgggaggcagaggcaggtggactgcttgaggttaggagttcaagaccagcctggacaacatggtgaaaccccatctctactaaaaatacaaaaattagccaggggtgttggtgggtgcctgtaatcccagctacttaggaggctgaggcaggagaatcgcttgaacccaggaagcagaggttgcagtgagccgtgaaggtgccactgcactccagcctgagcaacacagcaagactctgtctccaaaaaaaaaagtaattgcagttttagttactacgttcaataggaaaaaaaaacaatacttttgcaccaacctaatagaaaaccatcgactagattaatcagctcataccatgtgaattactgaccagtaggaaacagagatcaaagtcagtgctgcctgctacttaggagatgcaaaggtaattcctctgatggacttctacgttcatttcattgctcaacgacgtagagataattaattcttaacgaatattcatttgaaataaattctgacaagtgctccataatccttccagaattcagtaataaatcaaatacacctttttttttcttgtaacttcccattgacaatgtcatatcattaaaacccaggctatatgtggtagctctttcccactacagtgaaagacatttcaatgggaaatgagcttgtctattaaaaatatcttcattgttgttttctaccaatctgtatcaacaggtcattttctttcctttctttttaaaatagtaaataaagaaggaatgattatgatacttcttgctctctaggagccacgtcataaatgcttaattaggtatgccaaagttattttttctaatagagtacagaaaactcttaataaaagatcagattcattgatgtatatgcacaatatcaggaaagagttctcataatttgtataattccatagtcaaccctagcaagtgaagattaatcaatggtgggctcccatgcacgtgtatttatttatttatttatttatttatttatttttcttttccactttcttttaggtccagggggtacatgtgcagttttgttactttagtacattgcacatcactggggtttggtgtacacatgattttgttacccagatagtggcatagtacttgataggtagtttttttgactctcgccctcctcctaccctccaccttcaaataggtcccagtgcctactgttccattctttgtatccatatgtactcaatgtttagctctcactgataaatgagaacgtgtgatatttggttttctgttcctctattaacctgcttaggataatggcctgcagcttcatccatgttgctgcaaaggacatgattttgttatttttttatggctgcatagtattccacgacgtacatgtgccatgttttctttatccggtccactgttgatgggcatctaggttgattccatgtctttgctattgtgaataatgctacagtgaacatattactatgtgtatctttttggtaggataatttatattcctttgggtgtacattcactaaagggattgctgggttcaatgatagctctggtttaagttctttgagaaatctctgggctgcttcccacaatgggtgaactactttacatttccaccaggagtgtataagcattcccttttttccacaaccccaccagcatctgttattttttgactttttgataatagtaattctgactggtgtgaaatggtatctcattgtggtttttatttacatttctctaatgttagtgatgttgaacatttttcatatgcttgttggccatgtgaatgtcttctttggaaacgtgtccatttgtgtcctttgcctattttttaatggggttgtttggtttttcttgttgatttgtttaagtttcttacagattctggacattagacctttgttggatgcatagtttgcaattttctcccattctgtaggttgtgtttatgctgttgatggcttcttttgctatgcagaagatctttagtttaattaggtctcgcttaatccatttttgtttttgttgcaattacttttgcagactttgtgatgaaacctttgccaaggtcatgtccagagtggtatttcctagattttttttctaggatatttataatttgaggtcttaaatttaagtctttaattttgagttgatttttgtatatggtagaaggaagtggcccagtttcagtcttcggcatatggctagcgagtgatcccagcaccatttactgaatagggagtccttttcccattgattgttaatgggcagctttgtcaaagatcacatggttgtaggtgtatggctttatttccgggttatctaatattggtctatgtgtctatttttgtaccactaccatgctgtattttactgtagcctactactgtatctattactgtcaccctgtaatatagtttgaagtttgatagtgtgatgcctctggctgtgttcatcttgtttaggattgctttggctattccagctcttttttaggttcatatgaattttagaattttttttctaatgctgtgaaaaatgacattgattgataagaatggtattgaatctgtaaattactttgggaagtatgatcattttagcagtattgattcttcctgtccatgggcattgaatgtttttctttttgtttgtgtcatctctgatttctttcagcagtttctgcaattctcatagagtactttcccctccctggttagctgtcttcctaggtacttgattccttttgtggctattgtgaatgggatcaaattcttgatttggctgccagctattgttgagctactaattgttgtacatttattttgcatcctgaaactttactgaagttgtttgtcagttctatgagcttttggatggagactatgaggttttctaggtatagaatcatatcatctgcaaagggagataatttgactccctctcttcctatttggataccttttatttatttctcatgcctgattgttctgggtaggaattccagtacaatgttgaataggagtggtgagagtgggcatctttgtcttcttccagttgtcaggcggaatgcttccagcttttgtccctccagtatgatgctggccatgggtttgtcaagatgattcttattattttgaggtatggtctttcaatggttagtttgttgagagtttttaaaacaaagggatgtgatgttgaattttattagaagccttttctgtgtctattgagatgatcatgtaatttttgcctttagctctgtttatgtgatgaatcgcatttattgatattcatatgatgagccaatcttacatcccaggactaaagcctgctttattgtggtggattagctgtttcatgtgctgctggatttggtttgctgatattttgttgaagatttttatatctatgttcatcaaggatattagcctgaagttttctttttccctcgtgtctctgccaggttttggtatcagaatgatgctggcctcatagaatgagttaggcaggagtccctcctcctttattttatggtataatgtcagtaaaattggtaccagatcttctttatacatctggtaaaatttggctgtgagtccatctggttcagggtattttttagtttgtatgttgtttattactgattcaatttcagaactcgttattggcctgttcaggatttcaatttattcctgattcaatcttcggaggttgtatgttttcaggaatttatcaatttcttctagatttctggttgtttttttgagacggagtctccctgggtcgccaggctacaatgcagtggcgcaatcttggctcactgcaacctccacctcccaggttcaaatgattctcctgccttagcctcctgagtagctctttccatttctttcaggaatgacaggtgcatgccaccacacccagctaatttttgtgtttttagcagagatggggtttcaccatgttggccaggatggtctcgatctcttgaccttgtgatctgcttgcctcagcctcccaaagtgctgggattacaggcgtgagccactgcacttggcctcttctaggtgttttagttggtgtgcagagaggtgttcataatagtctccggggaatttttgtacctctgtggggtcagtagtaatgtcacctttgtcatttctgattgtgtttatttggatattctttcatttttattaatctaccaagtggtctatcaatcttacttatccattcaaagaaccagcttttgggcttgttcatcttttatatgaattttcatgtcttaatttcattcagttcatctctgattttggatatttcttttcttctgctagctttggggttgggttactcttgtgtttctaactcctctagttgtaatgttaggttgttaatttcagatctttctaactgcttgatgtaggcatttcatgctataaactttcctcttagcacttctttagctatgtcccagagattctgtttgttgtatctctattttcatcagtttcaaagaaatttttgatgtctgccttaattgcattcttcacacaaaagtcattcaggggcaggttgtttaatttccatgtaattgtatggttttgagagattttcttggtattgatttctattcttattttgctgtgttctgagagtgtagcttgtatgatgtcatttttttttgaatttatagagaattgctatatggccaagcatgtggccagtctaagtgtaagcgccatgtgctgatgagaataatgtacattctgttgttgttagatacagtattctctagatgtctccgaattccatttgataagtgtggagtttacatttgatatatctttgttagctttctgccttcatgatctgtctaatactgtcactcgggtgttgaagtctgccactattattgtttgattatctaagtctctttataggtctgcaggaacttttatgaatcttagtgttccagtgttgggtgcatacatatttagtatagttttcatgttgaattgaaccctttatcattatgaaattcccttatttgtcccttttgatcactgttggcttaaagtctgttttatctgaaataataatagccacacctgctctttcttgctctccctttgcttgatctttctccatccctttactttgagcatatggatgtcattgcatgtgagatggatctacagttgggtcttgcttttttatacaacatgacactctgtgtcttttaagtaggggcatttagtacctttacattcaaggctaatattgatatgtgaggatttgatcctgtcctcatgttgttagctggttattatgtagacttaattgtatagttactttatagtgtcagtgggctatgtacatatgtgtgtttttgtggtggcaggtaatcatctcctgtgtttatatttagcactcttttaagaatctcttataaggcaagtctggtggtaacaaattcccttagtgtttgcttgtctgaaaaagattttatttctcctccatttaagaagtttggtttgtctgaatatgaaattattggctgaaatttcttttctttaaagatgctgaatataggaccctgatctcttctggctcataagggttctgctgaaaagtgcactatagcctggcggagttccctttgtacataacctgccccttatttctagctgtctttaagatttttttcttccacattggtttcgaagaatctgatgactacgtgtcttggggatggtcatcttgtatagtattttgcaggggttctctgaatttcctgaatttgcatgttgatcactccagcaaggttggggaaattttcatgaccaatattctcaaatatgttttccaagttgcttgttctctttccatctctttcaggaatgacaacgagttacaggtttggtctccttacataatctcatatttctcagagcttttgttcatttttcaaattcttttttatttttgtctgcctgcattgattccaaaaaacagtcttcgagttctgagacttttttccctcagtttgatctattcagttattaatgcctccaattgcattataaaatttctggagtcaatttttcatctccagacattcagtttgtttctttcttaaaatggatgtgtactctttcaactcttggactgtttcaccgtgttcttgggattgggtttcaaccttctcctgtaactatatgtggttccttgtcattcagctcctgaattctgtatctgtaatttcagcaatttcattctggttaagaaccattgctggggagcaagttgtagtcatttagactcaagaagacactctggctttaagaatcattagagttcttgcactagttcttatctgtgtggactgatgctcctttggtatttgaagctgctgtcttttggatggggctttttgcttttctattatttgatgctcttgaggttttgactatggtataaattgggtttcatggattggtttcaattctgaatgcttttctggagccaaagctcacctcagcactcttgggctgcatgctgtaatcctgggggatgggggattagtcctgtggctttgctctctggccccttgagattaagcacctgctgtgctggaggtgctgaggtgttcccagttcacttgcaacaacactctggcaggggctgctggcaaaattgctccagtggggcagtgggagtctccacacacatgtgcaccaatggaggaggctgcaggcgagtacgcatcagtagggggaggctgagggtgggtgtgcactggcagggaaagactatgggcaggtatgcactgacagggggaggatgcaagcaggtacgtgctggcaggggaggtcatggttggagtgtgccagcagggggagacaatgggtggatgcataatggtaggggtccaccaggtcgttttcttactccaagtttcagttttgttaacctgtactataaaatgactgaactgtaatttttaaagttttcttaagcagaaagacttcaattattttatttgatgtgccactggacagacttgtaaatggaagctcaaggaattcagtgagttgtctctggaaaagagcagagcaggtaatcccaggcttttgtgttacatgtatattgctctttccatcatcttatggctgcttcaaaggttcctcacaggtccaaagtttactctaactcagtgaattcctttggtcattccacatgtaatcctcctggagcacattatcaatggcaatctttggacagtgctaggcctatcaatggtgaacctgggatggctgaagctcatgctgagtcaagtctatactaatctaattctcccaaatgtgatgggaagtgcattttccacaaacagtactcatcttggaaagtagaccagcatcctaataaaagcagagattttagtgtaatacaggttaacattccaatcccacagaatgggcttgcttagtgtataacttttcctagtcttcatacttacgaaaagacatgaggtctatgtgtaacatgtagaagtgtacatggcccaaaatataaattgagcccaaaaaatatctgcaggatacataaaaagctagctcttttctattctctatttggtttgcatacaaatggtagcatccatgcactttaatgttattcaaaatgaacaatagaaaaatccatggaaacttgtccattttgtttgcattgatgtttccagaactactgattttgatagatttgtttttccattaaagaagtaggaacaaatccctgatctcttacactgaattgtggtgaacagagtaagatgggaaattgctcttttaataccaaattgggacaaagccgttaattatgtgaagcttattctaacaatagctcttcaagtgtgtgatggaccaggggcccccaactcctgggccacagactggtactggtctgtggcctgttaggaactggtcacacagcaagaggtgagcagcgggtgagtgagcactactgcctgagctctgcctcttcctgtcagatcagcagtggcattagattctcataggagcatgaaccctattgtgaactgtgcatatgagggatctaggctgagcgctgttggtgagaatctaaccaatgcctgtaaatctgagatgaaacagtttcatctggaaaccatctccaacccccaactagtctgtggaaaaattgcgttccaagaaactggtttctggtgccaagaaggttggggactgttgtgatagactactaatcctgctaatggggtaacccaagtcacaactaagtttaaggttggaaagccccagtaaatatctgaggtcttagtgaaacagggtaagatgaaaggtgagaaaaagttgtattagacactatgggtgcaggggggaagatcccagaaataatagtctttgaatgaaagtccaagatatgaccttcttggtagagaaaaactcaaccaggaaagttgtcttatacatttttcatagatgttgtgcatgttgaatccccacccttatggtaatccattagtatgctgaaggctcagaggaaatagtacaaaacagatgcattcatgcttcatttttccatatgtttgttattcaacaccacacgatgactgatagatcccatatctaattaccatatactggagagctttctggatttttccagcccagcagtgacaataattgccattcaagaaaagataaatcaatgttataataataatacaatgacttatctgatttcccctgttattttttttggaatatcaacttttcactgaatttaagatgattttctgataaaattattatttttttgctctgaaaaccaatataaatatgtttatctgctacaataagaatgataacatgcaacaataaatgtaaacttagctgttatatgcaaaagattttgctagttgcaagaaataaaaagacatcagaagtagttgttgacttcaaactgctcagaatctggtaaaatagatgacctagtgcacagtgattatctcacccaatgtcccattatcacccagctgtattctgttccttttccagtcctcatgctctaattatttaagactcagcttaaatcctataaatatcttggtctgatattttgtcagaagacatatctccccccaatttctcagaggtctttatctctactttgtatgttatttgtaattttttattttatgatactatcatgcttttcaccataacaaagcaaagcctctattttttcttaagttgtatcttattaaagcaactaacctaaagggtaaggaaaggacttctttgagctttcaggaaataagaacaagccaattacgaggagggaaaaaataaagctgaccttagatatctacacagcaacatttaattctagaatacagtgaatcaatgcccacaaaatattcaaggaaagaaaaatataatccaagtctttaatatctagccacagtgttcaagtacaaatacaaacaaaacccaatttttaacatgtaagaattcagggaatactattcccatgagttcttgctgaagaagaatttcactgaacagaaagatatttttggaaagactatataaaaagattagtactgaaatttgaatctatacatttgttgaacaatgatttaaacatatgcaaggattaaggtgacagaagagaatgtaaatgttaaatgactgggtgggagagtgataagtatggtaattttctcacttataataccaggagttaaaggatattttcaatacttcaaaataagtaatgtgaatataaatgtatttaatatctcaaaggaaaacactacaaagattatgtaattaaccgaaatcaaggggataagaggaaaaagcagtataaagaaaaacaaacatactaattccatcactgattatagtggagaatcaaaaacagtttgaagaaacaggggatttagggtataaaaattatattagatcaagaataccaactttctaatgagcagaagcagcactctctctctctccaaagtaggtaaaaaggaaatacaaaaagctttaaagatgggaaaggataacatgaaattctatgctagaattaaaattaaatacatctcccctattgatagttccatgagggaaaggatgtctgcttgttctgtccattgctgtgtcccgagcacctggaacattgcctggctcatgactgcaggcaaaaatttctttaaggaatgaaattcatacggctaaattcacataataaagaaaaaggctttcaagttacttcaaataacaaaaccaactgttcttgagtatatcttcaatcaaaaaagagatcaagaccaaaattacaagacttttagagacaaataataaaaatacgttgcatcagtatttatggggtacagctgaggcagtgttcagaaaaacaaatcactgcattaaatatttatgtaagggaacaagtaaaaagaaaaacacattaagcattcatattcagaaattagttaaaaatcatgaaacctaaggaaagtagaaggaagaatattgcaatgattaaaataaattgatgaattagaaacaaaagagtaggactagtaaataaatacaaaagtaggttctttgaaaaaatataataatataaataagttttagctgccaggatatttccacttcggtacttaaggaagataatttttgttgtgggagctgtcctgttcattatgggatgagcagcatccctagccagatgccagtagccctccccttcctagttctagcaaccaaaagtgtttatgaacattgccaattttccccttgggggtatcaaaattgttccaattgagaaccaaattgttccagttgagaaccactgaagtagcccagtcaaaaaggaaaggaagaagcacaaacacccaatataagaaataataagcaagtaatgatcagtcagggaaaattttaaaaatcaaaggctattttaataaactctacaaattaatatgaaacctgaatataaagcataatattatattaaagtaaaattaacaaaaatagaaaatgtaatatatgaattaccaaaggaggaaacttgccaaaatccaatcatctcaaaaaaaagttaaaaccagtccttactacaatgctatttgacccttccagatacacttggccatataatttagtaaaagaaaataaccttagaaaaagattaagaagacaaaaattagtattattgtttacaggtgcaatttaattttgctgatattattgtttacctggaaagaaaagtatattttactgagcaactatgaaaaatagtaagaaaatttagtcagttagctcagtataaaattaaaagacagaaatcattttcctttatgtatacaaataacctctattatatagaagatcatggtggaaaaacacataatattcaggaataatactgatagttaattttcaggatctatatttagagactatcaaaatacttctgaggtaatcaaaacaataccaggtacttaaacaggcagattcaacttcataaagatgttaaccttaaatatatctataaataaaataccaaaagaaaatctgagagaactgaaaaacctaatgctaacattaatatagaaaacaaaatcagaaagaataactaggatgatcatgaaaacgaagagcaatttggtgtgggatgtggagattaaaagaagaggtagacttgctgttattaaaaaataaagtaaagctacaataattaaatcagtgtgttattggcacatgaataaacagtcataaaattggaacagcctgggtagtacagaagtccaaataagtaaagcatatatgtatattcaaggtagcatttaacactaaggggaaaaagatagtttatttaaaatattgtggtaaaacattagggcagctttatggaaaaaaaaaaaaaactcaagtaaattccctttacagtatatccaacttaagcataaaattttaaacaataaatttacttcaggcattttaatgactttaaatgacaacggaataggaaggtattcctcagtaggagattttaaaatctcagaaactataaaaaaaagattaataaaatgttaacatcattatgttgttgagtctgtcaaacacacggtacttatgaaaatgcaaaaatttttgtattacttaaaatgccataaaccaatcaaaaggtaaaaagtgggaagcatttgcaagggctaactttccgaatataaaagggttccttcagaaagataagtgaaagaccaagatccaaataagaacaaaagcaaggataggtgacaagtaaaacaaaattaaaataaaatcagctattggctattctcctacaatatgctaaaaccacatatcataaataaagtaaaaattaaaactatgatgaatagaattttttatccatcatattttttaaaattacataactcactgtgctagtgaaagtgcagaaaaattggcactgtcgtgtcatatatttctttattgagtgtaaatactatatctagggagatcgatttggcattatctagcaaacttacaaatattctgctttctgctctacttttagaaatttactctgcagatatactataaaatgtgcagaatactgatgtataactatattatttataatagcaaaatattgaggcaaactttcagaaatatgggactgatgaaatcacgtatgtcacagtctatggtataataccacatagcttttaaaaaatacagaaactccctgtgtactgattcggaataatctccaagaaatattaagtggaaagagcaaaatggagtgatagtgtggacagtggctatcttttctaacaaagagaggtaaatagacatatctacttatatgggtataagcaaaaagtaataataataataactccagctgacaaataagaaaattgtaatattgatagcctatagaaaagtggctatagataggcagaatgagattgttcaatttatcttgtatcttatggttgtgagttaagtgaatgtattatctgttcaaagggaaataaattgtttcaaaatagttgacaaaagattattatgataaacctgaaagaagatatgcacagtatgatcaacaaatgctgattttgaaatccagaatactatcccacatgagtcatattttgttaatttaaaattcatgttgacagatgaacacaacagatgaagctattaatgcagctttaccttactgacccagagcccttcgagtctgagtttcctctggaccaagtggttatcttctctatacagactggggattctatctcccaagcatgcaattaactgccccttttgaatattctattccaagactcattgcaactatgatactcttttcttttaagtgtgagcctcagaaacaattaagcaagaaataatcgtgcatttgcataagcccaacttactgtgtttttttgttagtttgtttgcttgggactttctctgagaagcaggaactcgttttgtcatccaggctggagtgcagtggcatgatcaaatctcactgcagccttgaactcctgggctcaagcaatcctctcatctcagcctcccaggtagctaagaccatgagcacatgacaccatgcccggcaattttattttgttttatttatttatttatttatttttcagaaaaatggggtctcgctattttacccaggctggtctcaaactcctggcctcaagttatcctcctgccttggcctcccaaaatgctgggattacaggtgtgagcccccatgcccggccaaggacttactgtttactcagcaaacatttattgggcatcaattagctattggcataatcataacacttcctcctacatgtgagcatcagaaatatttaatcaggaagtaattatgcatttgcataagcacaatttactctttagtcaatgaatatttaatggccatcaattacatgccaggtagcatggaaggtactggaaacagagaaagacatgttccttgcccttaaataatttgcatggtaatcattattcagggagacaagaatataatagaatttaatacaatttggtccatgttagaatagtagccacaaatcataagaatggcaagaggctaggagaaggaggcagtaacaatgcctggggagactcagagagggctttacaaaacagaggaagttttacttctactagactgtctagaattataagtgacagacaacagagtccttgctttttcggaccctaatgctaaaagactgaataaatgtaatagtaaaaaagtgattagtaggacaattaagttttaagttcacattaaactttaaaaaacacttaaaaacttaaaaaacattaaaattaaaatggaattcctagttcgttgatatctcatcacattacaaaattctgtttttaataacatcagaacataaacataacttcaaaacatttaccggaaataatagctttagttttaaaatgcttcctccaaaagcatgttccaattcaaggcaaggctcataaactaaatgaattttaaaatttatattttagaattataattacatacttgattacatatttagtatgagtttataaaaaaagaaagcaaaaggatcactgtgacaacaggtgacatcaagaaccacttggaacaataaaagggaaagaaattaatctttaacataagtggagtaaatataaatgggccaaacattatactgaatttagtggtgctgcccatggaattctggaagtcttaagatgttgtagatagatatacactttccttgactcaagatagcataagtacttattttttcagatagtatgcaggcttttccaggtaggacctggttctaattgacataaatataaaagtgataagaaagcctaaagctgccgggtgtggtggctcactcctgtaatcccagaactttgggagaccgaggtgggtggatcacctgaggtcaggagttctagaccagcctggacaacatggcgaaaccccatctctactgaaaacacaaaaaattagccaggtgcagtggtggacgcctgtaatcccagctactcagaaggctgaggcaggagaatcgcttgaacccgggaagcagagattgcagtgagccaagattgtgccactgtactccagcctgggtgacaagagtgaaactccgtcaaaaaaaaaaaaaaaggagagagagagaggaaagagagagagagagaaagaaagagagagaaagagagaggaagaaagaagaaagaaagagaaaaagaaagaaagaaagaaggaaagaaagaaaaagaaaaggaaagagagggagggagaaaaggcagggaaggaagggagagaaagaaagaaagaaggaagggagggagggaaggaaagaaggaaggaaggaaggaaggaaggaaggaaggaaggaaggaaggaaggaaggaaggaaggaaggaaggaatatcctaaagcaactctcaggaaacaaaacagaatgttgaggaaaggagactggtgatgtgcaatggtgctaagacttgctgatgggaaacatttgtgtagcacaaacccaaatctgtaggcatgcttgcagcctaatcccaaatagtcaacaagcagatgcactcatctgccatccccagagacttcagcactgaagagttgtttcgtcactgtagagtatcaaattggtgagtaattttgcccttctacctggctaaaaaaacattcattcagtttctactagcttaaaggtcactgtattttgcagtcacccatgcatgcaatcagatatggctcaatggactctgctcacctcacaatcatgaatacaatatgatttaaaggtcagccaacttgcattctgtcaaaagagcataaggagagaatttcagctatgtgggtctatatgatggcacatattttgctgacagttttctgaatccacacctagcgatcactggcaggagatgacagttcaaggtcaataatttaataaatcatttcattatatagttattgattctaccacttttaataaggaatgtatgcaaaattgaagacgttaagtctgggaaagatttatagaaaaaacagtcaacagcttctgtgtggcttccaggagagatgaaggccaaaagagtgaggtagaattttgctctaaataagactttaccaataataagggatattgaaaatgaaaagtatttagcttctgaaagtagtgttcctgacatatggttaagccagatggtggattaacacatattgtaatgtctaaaaaattaggactttttaaattggggcccacatactgcttaagaaattgagctatctgacccttcaagactttcttattttattctctatgatcagccatgagagttctaaagggggaataaatggttcagcaaattttatcttgttccaatatactatctagaatcaacggaaccaaactatgaacatctacttcctctaggacaaatttcatcaaaccattagttataatacacatgttcaaaggagctgagataaaaattacaaatggcaaattaataaaacagccattaaggaacttggacatagttaaagtgtacattgaactgaaacatgaccatggagaacaaccttgacaatatgttatttgaagctattttcagatgtatagatgtggcccaatatggcacttttcatattctccatgcagctgctttcacctatcctgacatcttcaagttatctgaatttaagaagtatcactattcatgttgcacaattactaacactgaatatacttatcacattctctggcatgtggctttaagctatcctgggtattcagacagttaagattcttggatgatcccaaagtttccctttaattatttgtagcagtcttctggactaataatacttataaaaccttgggaatagcctatgcaacatagtgagaccccgtctctacaaaaaataaaaacaaaaaattagccaggtgtgatggtacacgcctgtggtcccagctactcatgagactgaggcgggaggatgacttctgccccggggggatccaggcagcagtgagcggtgattacactactgcattccagcctgggcaacagagagagaccctgtctcaaaataaatacacaaatatataaaatcctaagagttaattctttagaaagcattttattttagcttaacacaattaatttgatctatcagaaaaccctacctgcttgatgagccatatttactatcatcactctctgtctaccattacaatcagtgattattgattgggttagtgaagagttttgaatagttttaacaactgttttggcgctcaaattgagacttgattaacaaatgcaaaactagtcaaccatgactaaaatgaaactgcttcaataattacataatgaagatggtagcgagtttttattataagggctatgtaaatgcagcccactgtactattataatattaatcacaagttttttgaggaaaggtatgtgatataactcccatccaaggtccctagcagaatgtctttcacaaagcagatgttcattaaatgacagctgaataataaaacactattatagagaactcaagtatgaatctagtatttcattttaaaaacttgtctgattatacttacatatacaatactgcatgcagcagctactcgataaacgtgtgtaaaagattaagtttggtcaaacaattgctctgaatcaaatttgtgatataattcctgactcagcccccacagaatatttaaaatatagtaatacagtaaaataatttttccaccacttcatgaacagtcagtagggtcttgaatgctacctttcaatatgcaatatggtggccttaggaagagaggagttttttttttctcaacacgtagaatcagggtcttaagaatgactttgtgaaaactccagctttcgttgctagggaacattgattgttttccatggtgcttgtaaaggcattatttgccctgattcttttgatgagttgagactgttcacatagtaacttcagaatggaaagaacaaacccctctcttcctctggtggcactttgcctactgtcagactacaaaagggagaggcatgtgaggtgaccctctcaatgttgtctgaacaatgaggcaatcattacaactcacattctatcagtttttatgtgacactgaccaaaggcaatttggggctcctttcaagcagtttgcatcaaaaaaacgttgaatggcattgtcaccaggactacactacaacaaaaagcaacgattgagaaaggctggtgtctaactagaagacaagagtgctttagatatggaagccattgctctgatattttaaaatacatttttaaaacaaccttattatcgattcatttatacagtcaactccattctgcttagtactcgaagtgtgcactcatgtggataatctaaaacattgagaattcaaataacatttatattaaatctgacataataacctaacgttttagggtatgcctaaatttgcctttctatttctgtttattctggtaacttttgaatttggttctctggccctggaaatgccacatttagccaaagaaaaacagttttgattaggggatagcattaatcattagctagttaagtgtacactaaggaaaaattagagtcattattttgatgagttgtgcataagttatggtcagcacaagaaaacagggcacctgttcatatttggtcaccaaagaatgttctacatttaattaaccacttaatatttacaccttgagaaaaaattatgccacaatacaagcataagtgtttttgataaatattcaaatattagaaaaatatattaagatttaaatatttcaagtttgtttcagccataaaattctgatcatactctccctatctacctaattgctgctaacaataattcaaatgccaataatgatatatttagataattgattttaaagaatttatcaaacaaaaaatagaggatacctataggtatcttctttttctggagaatcaaaacatagtataaaatggaagctttctttgtgctgtaaagaattcaatacattatggggcaaataaatctattttgaaggtttttttttaatttctggtagactagaaaggaaggatccaactcggatgttcatttatttaaaatcaaacatagaagattaaattcatacaagccaaagaacatctggcccttccagaaagagaatagagttctaaatgctgaaatcaggtgaagcatacttaattactggtatccagaaagagcaaaagtgagacatcctattatatttattctaggacaaaatataccattgcctatgattgtgggttttggataagaaaaacttacagtcttaagctgatcgtgagtcaataatggagctactgggacacaaatctgtaccctttgtcactctatggaaactcttctgtctcaccacaactcacttttgtctgttgatcaaatatttcagggccttcaaactcatataacatgtttctcctagaaagagctgcttatcttttcctaactaagagcagggagtgcgccatgaaaatgttgtcattgatgagaacccactttgattctgatagagagtaagttgtgctcttttgctttagtcatgctgtgtattgtctataactctattgtactattacattcctaaatttggctataacaggtgtatcagttgattcaccaactttcaagaaatgtttgacactatctactaaagctaaacataggtagcctatgactgtgcaattctattcttatacaaagtcccaagacaaatgactgtacatgtccaccaaaagaaaatgactagaatatgtttagaaactttattcataatagctccaaactgaaaataacccaaatgtctatcatcaggagaatgggtaaagaaattgtattatatacaatacaaaggaatactacattgcaataataatgaatgaacgaagatgtacaaaacagcatgaaaaagattagatatttttagttgcatgagaaaaaaaagccagatacaaatggcccatatagtatgatcctatttatataaagttcaaaaacagaaaaaaaaataggtgtagaaaacaaaatggtagttaattcttgatggagagctttgtctgtgaaggggcattaggaatacttcggggagtggtagaagggttccaaatatctggatagtggttacacaggagctttacacattagatttgagcactttgtccataaatcattcctcacaagaaacacgtatcgttatttaggatttagtctatgctaggtatttatataagaacaccaacaaacaagatgacaggtaattgcatgcttaatttttttttgtgtgtaagtctttttaatatagattgagagtaacgtgaagtcagagacctgtctgactaaattttgtattctctaggatgcgaaatattcaggctcttaagaaagaatataagccgggcatggtggctcacgcctgtaatcacagcactttgggaggccaagatgggcagatcacttgagctcaggagttccagaccagtttggccaacttggcaaaaccctgtctctactaaaaaatacaaaaattagccaggagtggtggtagcgtgcctggaatcccagctactggggaggttgaggctggaggatcccttgaacccaggaagtggaggttgcagtgagcccagatcatgcccctgcactccagcctgggtaatggagtgagaatctgtctcaaaaaaaaaaaaaaaaaaaaaaaaaaaaaaagaaaagagaagagaagacaagagaagacaagaaaagacaagaaaagaaaagtcttctccaactctacagtgaccgaggaaataaaaatgtatgtacctatgttggttgcttctaactagaatcaatgtctctgtcaaagtactttctgccgccaactctttgacaaataatcacttgtcttcaagtaacacaaggatcaccttaattttgattaatgtcagctatggtagaaaagaaaaaaacttactggatagtcaggaaaaatactctgaaaaatagtacttaattcacataagatatatatctcagtaaaattaaaataaagagcccctaaaaagattaattataataaaaagcattatatcaagtgtgcttttcacattattgccttttgaaacattgctctcattataccctgggggaactgatttggtcttaatgccaaggaaagaaacaataagaaactaaatcacatcagttgttgaataaaactgttgaaatgcatatccttgaaaatggatttatgaattgatcaatggatccagaggttatttctgaccaatggcatataaaatgtatcaaaaatcgttggatctctctacttttcactgaaggaaaaatatgttctgactctggatgaggagatatggtttgattttgcaggctcctaggatctgaactcaccctctcaattgcatactttacaaaagtgctcagtcacctcctttcaatctccagaagataatatttcttagagcagagagaccattttattgatgttggatttttgctcctagacatggaactaatcctattaaagaaaagggaaagggaaggaggaaataagatgacattgagaaatcatgactcctggcaagagtaacgcatattacataagtacttaataaaaaatatggcaacaaggagagagggaggaagggaaaagggaagaacaaaagtaagaaagaatgaaaaaaatggaaagagaaaagaaattaatttagctttagttaacagtaagaaatgaagattgaataaaaattaggatgttctcttgcttttctgttaaatgtgtccagaattacagaattattttaaaaaattgaaaaaagaaaaggctggatgtggctaaagtttgtggtttggaaggggaaatggtgttattcaaattatgtttggagtcttgccctctcatatcaatccagagaaagtcggatgttttcctgagactctcggcataaaaagatgcaggaaattttccccacagaatgatttaggctatgaaaattattcactttagaaaagaaatgaatcatgtattattgttaacataagatttgtcattcatttataactggtttaaaacagctatttgtaaaaccaccacagtattttaaaaattaattaactttaacttgacgaataaaaaatgtatatatttatcatgtacaagatgatgttttgaaatatatatacattgttgaatggctaaatggagctaattaacatatgtatctcacatacttatttttttgagatgagaacacttaaatccactctctcagtgattttcaagaatacattgttattagctatagtcaccaccttgtaccatagttctcttgaacttattcctcctatcaaactgaaattttgtatcctttgaccaatatctccccaacccctcctctccccaagacccaggtaactaccattctactctctgcgtctatgaattcaaatatttagactccgcatatagatgagatcatgtggtatttgtctttctgtgcctggcttatttcatttaacataatgtcctctaggttcatttatggtgtcaaaaatgacaggatttcccactttattaaggctgaagtgtatttcattgtgcatatatactacattttctgtttctattcatgttgatagccatcttaatattgtgatgcattataaataaaatatgtattcaatttcctattatgttacagccattctctgcaatattgacacacaacataggatatttgataaatttatcattgaagataaattcagaggctatgtaggaaaatgtacaaaggataactgcattgaatgtgatactggactactaataatctgtaatttacctttaaactaaaaatatttgattctacaactaggcaaaagccaagattctcaggctaatgtataaacattaaaagatccaatgggaagacattaagtgcttacataacaatgatgagttaaaattctctgtcactttgcactataaaaagtttaacaattcaatcaaaagaagttataacaagttaaaagtgtgtttatataacaaatagatccttccttaatatttattttataatgaacacatataaaactccttcaaattatttggaacattaggtaacattatataatttttgctaagtttcaaaatgttcactctgcaaatgcatatcatgccataggtctagagagatgagaggtatggatgtgaactagtaggaagagtattaacttaggaggcacactgatcagggtatgaattgtgattcccctgtttaccagctgtgagatcttgagaaaaatactttaattgctgatgcctcagtttccttatctgtaaaatgtgaattaacagcacagctctctcataaaaggctacaggaaggattaatagaaatactgctcacagcattgtatcaaatagctgagcacattataaaacctcaataaaaggtaatttattattaatgttagagaaaagtttaaattattaatattataaacattgtcaacttttcccattacaatcgttctaacaaaagccaatgaatagggctgggggagaggtatactaattaaaattacaatctaactggggagagaaaacatttcagagttttacttattaagtgcatcctgagtaagctgagttggggaagaaagtgttatggtacctagaaagtttaaattatcaatgcacagtagggatcatgttaaaatgcatatcatagcataaagttttccaatctattccaattcacgtttggtataataaaataattagatatctgttttacatatcacatgtaagcacaacctaatcctctactattatttctttattatttgcaatctctgattagtcatcaatgtaaacctaactttattaaaacaatatttaaaatggtatttgccaaagcttaaacatagtttctcatgtcggacccccaagcagtttttaacatgaaagaaatatgttacatttactaaacgtagccatgcacatacattttcctagagatgtgcctattattaagtctatggaacatctccagtagccattaatgtctttcccgaagttatatggcatttcatgaatgtacccacctggcaggcctctggttggcattccacaacaaagagttaaaacatcccattaatgaaatttatagtgctttttgacatcatttctggtggggagggaaactgcaagtcacttctgttatggtttaacttgttatgctattccagaagatgaattcattgtcataaatattcagcttcacgccaaagaagagtgaacccagctggttggtccttgtcctgtcctcatcttctgtcataattcttacaactagctacaatgaggcagagtcttacttcccatgcaaattagtcatttactttgatttccagcttctgacttataaatatgcataattttataattgttaaataatagaaactttcaataatctgaccaagtatacattgttccttttaatcttttgatacttttgcaataattcattgtcttattgatttgtaccctctatgcaaatctacttccccattactcataccgcacacacacacacacacgtaaacctataagcaacatacttgttactgtatagatatttacatattttatgtttacttataaatataaattgtacatattttatatatttatatattttaagtaaaatatgcgggtttactttctttagaaatgatgtgctctatactaatttgcatgttatttggtatggcatatgccatatatttaaagcatttaatggcaaaaaaactttttaacatcaagtttctcttgctcccttaaaaatgctctttgagccattttaattagactgaaatgaaatagattccttaggcaacagcataaaaatagtaaagtaggttttaaaagtcttattggagaataatttcaagtatggttttatttgatgtaattatttatggattaaacacacagatagcagaatagatgaataatgagcattccctcaactcaggcaatttaaactgaattttcttgagcttttggactttcctttaattagcttggatctggttagtgactatatggaaattaatatttgttttcaccatcgctagtttccaagtctggatttcaagaattgtgctcctcagaaaacctcacccttcagtaactttttcccataagctcataaattgtaattatgctctcacagactaaatgtaagatcctactagtgtttggtttttgtaaaactgtaagagcaatctgtgcaaataatataacgtgacttggttattcttcaaaatattaaaccagtaccattattgctacatgccttttctaattttcccacattttatcagattaaataagtaccttcccatatcttttgggggtaattttatcagtatcaaaagccctgtcagagtctcagcattagcatttagctatagaaccagaattttgaatttatgtcctagttttgccaccgtgttatttagacccaatttcctattcaataacaatcaaaatatagcctgtccatcacccagatgatctctatatcaacatcagagagtggcagatgaagctctaatccctatatcagttgcacacatattgcttgtaatcgtgcacatccctgacttttgagtaatttctcggaaacccttacccatcattatcttgggattttgacttcttaaagaatagatttctccatatcttctcttcagagccattttaacttccacttatggtgcagtggtggctaagtgtagttcatctatttcatgaaaaatattttggtgctgattttgctgattggttgagttaaccaaatgttctagttatttgactagggagggttttttgtttgtgtttttactcttaagcataaacatactactttgccagaagtctccctttgaagagtctttccatggtcacaggaaaattggctttctcctgatttcataacaaggaatacaaatttacactttatacaagattagggtgagcaaattctaaacgatattattctatttttgaacttcggcttgacttctgagagggcttgacttctgagagggcttgacatgcagcaaatgtttgagaatcaaactcttaaattccaatccttacggtaccctgtgtgattcagaaccagtgaagcttgcatattggtaaggtagtggtaaaatttaaaaaaaaaaaaaaaagcaaaacgaacagaaatgttacaaagtaaaggttgtttttgtttgtttgtttgtttgtttgcaggggagagaggaaccaggaaaattttgcatgaggaaaaatataagacacgacaataaatataatttaaaagatagggctgggtgcaatgactcatgcctgtaatcccagcaatttgggaggccaaggtggatggatcacttcaggccagaagtttcagaccagcatggccaatatggcaaaaccccatctctactagaaatacaaacattagccaggcgtggtagtgcacgtgtgtagtcccagctactaaggaggctgaggcaggggaatcacttgaacccgcgaggcagaggttgcagtgagctgaaatcacactactgcattccagctgggtgacagagtgagaccctttctcaaaaaataaataaatacataaataaaataaacaatagcagttaaaaacagtatagtttgtttataataaaaacgtatttaaagcataagcagtatgtagttgattcattttctttaaaattggagaaggttaatattggataccttaatcttttgctctgttgtaatccatatgaagatttaaaggtttttgaagcattttatttttatactattaaagaaagtataaaaacttttgggtgactcaaaagcagattaacacaaatgggcagattgatgactagaagttcctcaagtaatgatatatgaaagaaattcatgttccacataaagagaaagaaagcagtgaacgacttgtgaaaatcgtgtttctataaatctttgaatatgatatgctgtcatcaatgcttagcaactgcagaaatatgcgtcactaacgaatcagattttattaaatgtatgtgtgatgtgtgtgtttgcatttgcacgtatatttatcccccttatctgcacagcatcactattacttacgtaactgcagttactcagttaaacacatcctaatagagaatataaaatcattctcttgagaatctaagcaaattgcttggttgcatttaagatccatcatgagtagcttttcctgtgtcaattcattatacccaagggcaattcctctatttcatcctttttcaaggtcatgggttgagcttgattaatatgactggaaaacagaatcataagtggaaaatatcggtctggtatcagaaaaggttttgctaagaaactgaataagggaaagcttcataatgaaaatactgcatcataagataagagttgtattggaattttaaaaattattttgggggtgatgaataagaaccataacaatagatgttaaggctatggttcaatggctgtaaaacaactttctatacgtaaaaatgtagctgacaatatatccataaaatagaacaaaaaatgaattgagctgagcacaattatgttatttaaaaactccagaagcattagattggaacaaggaaagtctaagtgtatgggcaaaacgcactaagtctctgacatgccatgtataaatattcatggcaataattttcccatgagaggaaaaaaatgttttaggaaatgtttgtaagtagaaatagggtggttttatactttcttcactaaagaaatctgtagattgaggggagtttaaaaatatttcctcaaagaagaaacaatcagaaattccctctttttttataagatacaaaaagacaataaatatgttcttaccacaaaatagtggaaatagtttaactttaggtaatggttgaaggaaaagtttgctgaagcataggatgtagcaatgaaaataaacgaggtgtgaggtttcacgaccaatgattcacacctaggattaatgccagaattcttaatagctgatctcgtaggtgggattatatgtggcattctcatatatgtctctaatggttgaatgtcttcactgtggatgcttttgctgacagaaattactcagtaaaatctgtgggcttagcctaagtttataatttgctgttacatattttttcttccccaaccggatcttctgtcacttgaagcatctctacgataatatcaataacctcaccaatctccaaaccaaaatcatcatgccaaaatgttcctatgcctagcaaactagttttccctttgccaagtacaaaaccttctgacttgacaaactacaagataccataccagggtagtttaggcaagtgtatatcacagccgtattcatctatatttagctatttacagtgtatctggctttcccaattaggttgtttgccaatgaagacaaatgttatattttatacatctttgatctcccaccaaatttttactgtgccaactaatagtgtttattcagtggctaagaaatcacactaaattggattctgttcatccccaacttgttaaaatatgtaacaaatccttggactgggattcttcctgcctcagatttcactgtagaatcaacccagcggataccataatacaacccgcgtattacacaaatctccatatgcagaatttacacatgtgatgtgggagaacatattccattactcttggacctctcagttagcataaggtataaatagaggtccaagggtcagaaatagaattttggagaaagcctgttatcagatttctccagagaaagttattgctgtgttgtaagtcccctttcctgcttctatggagggagggctgagaggtgttatctctctgcaatggaaagacacagaggacaggggcctgactcatttcttaaaaagttaaactttactaggctctaacccatgccagagaaatatatacagagactgaaagcctgaccagctgctttgatagcagaaacagataggagagtaccgctgtattgagatagggcacaacccccagaagttgtgagaaccaaggatgtatagggttttatctggatcagatgtaggccaagacagatgggggtagggagtcacttcggataagctaaactggggtacaggggtaaaggaacctcaccacaaagagaccggccacacaccacagggtacgcaggggctgaggaaggagccacaaaggaattatctgcaatagaaatatcagctaagggaactgcaggtgagagaatccagcaaggaatctttaaagattccatgaaaacactcatgaaaggaaaaaaagatggcttttatattggcctggtctacctgaaaacctcaacttcaaacgttggccatggccgagggtttatgaagccacccagataaacaagaactgtactatttttacacctcctctgctctacacatcactttggtcctggtagagctaacacagcatctaggtagtaagagactctaagaggagctaatgctatacttccgtttccaaccacaggcttctgcactaaagcaaacctcacctgggagaggatttaactgttgattacacaagcttttaagtttggattaacaccttggactccattctaattactgaattggcactatgtttgtgatctaaagtgtctgtagagctgtggagatgtcatggctccgccagaggttatgtccaggaacacatgaagatatgccacactgtaacaaagtgtaaggaggacagagagagagaaaaggaaatcttttttgcttacatcatgagcttacatcgaacacagtggttacaaatagatgagttttttagttagtaaaatgaattctccctacctaaagtaattttatgtagagtcagacgaggaaaactcaatacgtgttatctccagcagcctgtggcacaatctgaattgttcgtgctttatggggaaagaagtgtgtgaagaaaaaaatagtagtagtagcccatgaaaattctctcttatgggttgttttcctgagaatgtgtccagctgattttattaaggagggggactgactgtcaaagacaacagaggtgcccccttagtactcgaagaattagaaaatgtgttcagataatagcttgaacccctaggtgtgccaagagaaagggagacagcaggctcttaaacagtgttgttaaaattcacatttatttaaaacacagcaattagctaacaaaccttggtgacagactgctatgaattttgtgctgactccgtacacataaattaaaccattccaagttccccacgtgcagcttttgacatttgtttcgtacaagtatgctggccgtggggaggcataaactttgcttttaattcctttggcaacagctgtggatcattttgttaaatttcttgtaagagattcaaaaacacttttctgaagacaaaaaatgttgtctccattgcatgttaagctctaaaatgtattctatatgagtagttttcaaaatggtttttagatctgactgcagacagttaaatattatggaattatggtatatatagttgtgtgccacataacgatgttttggtcaacaatgtactacatataagaagatggccccataagattagaatactatatttttaccgtacctttctaggtttagatacacaaatatcactacgttacaactgcctacagtattcagtaccacaccatatgggtttgtagcataggaaccagagtctataccattcagcccaggtgtgtagtaggctctcacatctaggtttacctacgtatactccatgatgtttgttcagtgacaaaattgcctgaggatgcatttctcacatgtatcccaatcattaagtgacacgtgactgtaattttttttttccaatcaagtgctcctctagttgctttggataaacccatcaaaaaagtagataaaaacccctaagaactactcccccatacacacacacacacgcatcctgcagaaagggagagagaaagaaaagatgtcagatttcaataatttctaaaacgtaagaaatctctctaacaaaaaggcataatacctcaaaattaagtataaaatcaaaaattttacttacaagccttttccttttaattatggtcattagcataaacactctgattctctgagctatttaagcataggatttctatttttctactctgtacattccctgcaagactagcaaaatagtaagtatatagtaggtggtcagaaaatataggattgaatcaagcaatatggcagtaaaaatggtccattgtaaaatgttgagtatgacatcatttcgagtaatcaagtaaacattaattatttcataaacaattatttagtatcaaggcattgattgataaaatgttttctaactacattgggccttagcttagacctttcttactgaaaatatggtctttgactcagcagcattaatcccatcaatgtcccatcccagaactacagaagaatcagaatctatattttaacaaaattcccaggtggtttatacatgcattacaatttgagaagtgctaatttataccactggttttcaatcaaaactactcgttaaaatcatctggtgttgttttaaaaaaataaaaaaaaagagggaaaaaaaaaaaactattcctgagccacactccaaaccaattaaatacgcatatgagtccagggatgaagtttcttttttaatgctccatgaagttctcaggtgcagccaagttgagaaacattgatttaaacaaaacaatgaaatatcatgctggctatgctggaattttctgaaataaatgaaattgagttttgaaattaaatcagaggaaataaacttctaataccatatatgaaaactccagtaagacattacttaataccctacagattttaggatcaaatggaaagacacattagtctaaatatgccctctaaggctcataaatgcagtccaacaaaatatcttattcttattcttctttgactcaaaatcatcttaaacagttaatatcagtatgcagaataaaactgaactttaaagttctgcaaaattaaagcaaactttccttactgagcctaaagaggatctaatgtgtcatatttcatctttaaagcctgaaacactgttttcccctaggaaaaatcaaatgaatcaatcctcccatcaagtaaactaatatctcattatgacttagattcttgttaaaaatttggcagagtattccgatttgttttcatatatcaccataactatatagcacatccagaaatctccagaatgaataaatattctccaagcacacgataactaaattgacctaacattttgtgttaattcacaccatcaataaaatgactttcaaaaaggaagacttttcctaaaagctaaataatacaattgcctgggtatatcatatttttttgacgatattgatgaacaaaaataagagatgattttttttcacatttaatgtggaatccaaaagcgtctaagcaaaaaaagcttgcattcataacagataaatcaggaatgtagaaaatatgaattctatttttaattctggagaaaagggtaaacaaaaattcaaagagcgtaattaaaataatttaaatgatttattttcttatttagtcctctattcaacctaaggaagtagctattattacccccactttccagaagaggaaactgatgtacagagaggatagaaacgttgccaaggtcatactttatactttattgagtagaatcttatgatgatttgactcttagagtctttgcagtcagacagacctccatgaaaatctctaatatactcctggttatcaagactctacttctcaaccaacaagagtggaattccagaagtctagccctagaaacttacagcaaatgtctagtgaaccttaaaacgtctctgggatccaccgtctgatgccaagtgctttgcctctgtctctctaaatgttctggtctacatcaaggccattcaggtgtgttagaattcactaggtatattgaagtatacaggatatcatcaatgctttctaaggacataatcaggcttgcatcattttcactttataagtaagtcaaacttcagggactttttcatattttttaatcaaaaagggaaccattgaagataaaggagaaaacataaaaagcccttgctgtgtaaagattgacaaacaaggtaacttaagtatgacataactttgctcactttaagagttggcctggaaacatttctttgttcaataatagagtcaagtcttatctcagatgatttttttaacctattatttttcagcagatgcatctgtgtaagaggtagtaacatccgatgttatattcctccgtgttgggagttcactggtcactcaaactgcagagaccacaattgcaggcagtgctattcagatggactaaaaatcaaatgaagacccaggagttgtgtgatgcgatggcctcatataaagggtaggtggctctttctcccttaattatttctcatgataagtattgataaagcttcaagggtcagcaaagtatgtcctacaggacaaatccagcccacctcctgattctgtagagccatgagcaaagaacagttttaacatttttagatagttcagaaattaaaaagaagaatatttgatgaaacctgaaaactgtgtaaaatttaactttcaatatctataaatgagttttttttttaacacagccatgctcattcatttacttatggtatatggctgcttttaagctatacaccagagagtctggtgtataccatggcagaggtgagtaattgtgacagagattgtgcagtgtaaaaagcctacaatatttactatctggctctttaagcaaaggtttgccaacctctctctgacacaataatgaaaaaaagaaatgtctttcagcttagcaaatatggcagtgactctgttacttgctctttcttttggccagaaaataaactgaatctctgcaagcttccgtttccttctatgcattgtggggataaagaactggctcataggaaagaattcatttagcagactgttttgcacataaaaagcacttaataaattaatgtttcccttaagttggaagcacttagcaccttttctcctcctctatctgctaaaatcgtactggtccttcgaaggcaaaacaaaatactgtattttcatacaatcttctctgactgctcaggttaaattagttgctccctctatgtttccacagcattctgtttaccagtctgtcatattatgatcctcaatctaccttgtactttggttatgtctaagacccttcttaaatgcagatattatttcttatgaatttcatgacttgcataatgttaagcacagatagggccttatacacaggggacattcaatgtttgctgaacaaatgaaaagctgaatgaagatgaaaatgaacaaccaactgggggtatttaagtaggtttactgccctcccaaataataggcaacatgttatctaggaggttcagtcaaaggaatgtcagggaaaggctttctccaaccagtatcaaatattagactgtctaatttatatcttgctatattttacctatgaagatatatattccacttggctttagggtataaattaaaatatgtcatagcaatagcaactgccagagtcaaaagaggcatttagtgagaaaatggtagctcataaaatgaatatgttaattaggaacttttaatactttccatttttttctgctgctcaatcagtcttactccatcctgtattactaacccgaatggctttattaaccacgttcttttcaaaagtcaatttgctctatctttaaacaccacacacacacacacacacacacacatacactacctcacacatgaacaaatacacttttaaaaagctaacaaaaggaaaagaaactcagggaaaaaatctatgaagtgacttatatctcaaaaagctcttattaaagtaaaagcaataaaaacctgaattataggagagaaataaatctcttctcattggttatctgcttcaaggaactgatgccttgaggaatcagatgtttcatgctaatttaaatttttggcaccttcgattacatgaaatctaaaagattgctttctaaataatgacaacagatttcctgacaatgcgaacaacagatgtcaccaaggtaagcaatggaggtttaattgagtcttagtccttggaaaggtgatttcgtctgagaggaaatcacaggttacatagttgattaatgcaacttagataactatgcttgattggctggcagcacagcatctccaggaagaaccccagtctatcatctcaatgctctgattcatctttatgccaaaatacaatgtgcaaggtatagctgcagcccccgtctaaaattcccatgcattacgcttttcaatggccacagattaaaggtatttaaatacatgttagttatttccatttccaatgagagtttaataaaagactatatcttctctttttaatgagaatattaacaacattagtaggggccaagaagattctccaagtctatgcaagagattatatttatatatctgtttttatatctatcatcaatctatctgtcatctatctacctaaattaccattcagtcctctcttttcccgtaacatatcagtggagatgttatagtagtaaatgtggcattgtggacatttataaacatttgattaaaaccatggatttcccttcctgaaaatattcatatgcacatacatcaatttgctgtataatttccctaaacttattcatggactcccaatgttaaaaattttataggacattttaaattataaaatatgatttctgtgctattcaaaatcataaaaacccactatagataattttgcatcaaaaatcacaaatttctaacaacgcacctttaataagtttaacacaaatcatagttctccttccacatcacatattctctattctataagttgcttgacctcccactttgtaagaatcctttctgtttctatttgagtattcttgttctcccaagggatggatatctcagatttaaagataaagcttttattttaaaacatgaatacacaacccagcacagtactatgaaatctcagaagttcttcctaatgtttaacgtaaatatttcctatgccagatgtagctattttccttgtcacttttgcatcataggctagaggattacaaactgattacccagactgcacttctctgccctacatactagcaaattctgctgcttccaattttccacgaagagctcatccttcaagcatctactccatctggggagctgtggtggcctttatctaaaactagatttaacaccagaactctagatgtgggttttcaaatggaataagaggtcatgtgggatagagagctcttttctttcatactatgtgatggatgatatcgtttggatatctgtccctgcccaaatctcattttgaaatgtaatctccaatgttggaggtggggcctggtgggagatgtttgaatcatgggagcagatgcctcatgaatggcttgggtcatccccttgatgataagtgaactctctctctgagtttgcatgagatctggctgtgtaaaagtgtgtggcttctcccctgcattgctcctgattttgccatgtgacatacctgctcctcctttgccttgtcatgattgtaagcttcctgaggcttccctagaaaccaaggagatgccagcaccatgcttcctgtaaaacctgcagaactgtgagccgatcaaaactattgtcttcataaattacccagtctcaagtatttctttatagcaatgcaagaataatctaatacaatagcctactttaataaagtttgaactttgtatgcaaatgttacacattactaaaacatttttatttttatttatttattttttgttttttatttttttgagatggagtctctcactctgtcacccaggctggagtgcagcagcatgaacctggctcacagcagcctccgcctcctgggttcaagtgattctcctgcctcagcctccctagtagctgggattacaggcgtgtgccaccacgcctggctaatttttgtatttttagtagagaaagtgtttcaccatgttggccaggctggtctcaaattcctgacctcaagtgatccaccagccttgtcctgtcctctcaaagtgctgagattacaggcatgagctaacatacttggccctactaagacatttttaaatagtgaaagccacccactagaacataaaagaaaatttaaaaaaatgcctctcttccaaatttcagcagtcttaactaattttatttctctatattctcctagctttttaacctgcactcagtgttaccagatgtaatcaatgtagatacagccatttgttgatcgtatacacagtactggttaaatgtgaactctgcagacagactctctacatttgaatcccaaacccaggggttatcagccctgcaatcttgctcagttccttcatgtgtaaattagggaccataatagtactacctaataatattactgttaggcttaataaatgtaaagtccttcaaaagtgtttggcacattaaaaggacctaataaatgctatatttattatgactagttatttagttcctctatataacactaggttggagccaattttctgcagttgcagagtctacccaataactcttaatggccacacaatatttctttacctcttggcatgtaaactcatttaataatttctataccattgggtatttaaattgtttccatcttttactattatagctaatactacaaagaatatcttcagacatacagctcttttttttctcctttgaagtgattttattaagacaaatttctgagtttaataaatggctgaaaagctgaacattgttagtgagccctgtgttataaagagaaacaaaactgacatccattcaggttagtggcaaggtgtttcattaaagaacatggaatatttgtaatactgtagtattactgaaaaagagtaactttcatgggccacaatttcaattttgtgttccacatcctcctgcattctgaggtcaatggagtcaggacctagcggtttttcagtagaaatctttcacatataaaattcaaggcctttttgctctgatgaccatagagctatttttcacagaaataaagcttttcctgatggtcttgaaacaacttcccacagctcaatgaaaagcaaaagcatttttcttttctccaaggagcctcaggctacatgtaatacagcacttaatttcctgcaccttagttggtaactgttaaatcaattcatgagcaaagaactgaactttcttgaaattctccactcatgctattccactatatcaacatttcataaaacccctcatttctcccctactattactgggcaaagtgaactaagaagagaaaaagaaaagaaaaataattcaatctaagttactatgaaccacagcagatctcatgaagggtactggggagaaataagatgttaagtacattgcaggagctgacaaactaattctggatgagccaagtcacaaaaaattaagagaattattgtatcttatacgttatgtatccttcactatttcagcaaaggtaaactaaaatgacaaatatgtttccacacttacataacccatatattcctccagattgtagaagaaaaatgctatgctgaaatttttaaaaagaaggaaaaaaggtaagacagatgaatggatggagggaagaaaagtgggaaggaaggaaggaaggaaggaaggaaggaaagaaggaaggaaggaaggaagataaaagaatccactaattcaatgggaagaaaatagggagatataatgggtgttggtggatgttagaattccaccaaaaacacctcaaattccatttaaattgatttgatatgtaggtttttcttgcccttctgagtttctcagatagtatattggcaggcagcctcattccctgcagtaaggatggttcttaaaaaactggaccaaaatcaatcaattagacattgccaaagatttctctccaagtgtcatctaaaaatcattaactgtggcatgaaatatcatggacattgtataagacatccatgcatcatttttggttaccaaggaagaataagcctcatgtttgaaactacagagcctccttcatgtcatgtatttagtaacatccagtacatctgctggctttgtatgaattcagaggttcaagcactcttcaaattcttttctcctgtattctgtgttattcgcccattaaactttttctgagtcgacataagtatctgcattgttgaatgctgtactgtcaaccagaactattgtgaatctgattctcagcccatttgctggaagttacagtagcaaggctgaaacattacaatagcaaggcaaagtctgatttggctcagaattcctgatttaaactcccatcagcgtatcccacccatctttgaaatccaacctacaaagcctaacttaccatttcccacctacctgcctatctctagctttccctatcacctctgccttccttctttctactaatggtatcttccaacctttacttaatttactcctaatttttcctttagatatcaattcaaatatttctgtttggggggaagtctttcccaaccctcatccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaaaagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatctgaaaattaaacaatcacccagagacaaatccaaatttttttaaaaaagcatttcataaagacacagtttattctaggaattttcagtaactgttattgcttttttgtggtagctatgcttcaagtaaggctcatttcgtttcaagcctaacttagttccattgcagacaaggaaaggggacggggaggttatattttcatattatctgattttgtgaaattgctatgtaaaaatgtaatccatttcatgaagataaaaaactactttaaaacatttttaaataaaataaaacgtaaccagtgaaatatggctgcatgattacggggcacagttgaacctaattaccagcaaattacaaaccactccactaaatgaatataaatcctcaacaatggagaagggggctctatgactatatgatatgcttggtactcttttaaatgatacttccctatttgagtaaaacaaagaagaaactgcaaagggatgaggcaggataactgcggctcatttgtcacaaggctccaacttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaaggaaggaagagaacaggtgaagtggatagagccacacttcccacataactaagggcaagttagttttatcacttttgggtaaagtgttccctatgaggggatttactcctttcataagaaaatcaatctcttcttccaacaaaagctactgaaccacttatgctgttacataaatgtgttaatggggaaatccattcaaacatctgcactaagcactctgtatttatacatatgaatgagattgagagacactgccattcctactgttttagcttccactatagtggaaaagggaaaatatatacaatatactctgatccaaggagaaagaagaaaacttcacaaaatacaaacttgttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggcaagaaagagaggaagagagaggagagagaagaggggaaagagagagagatagaatatagaagaaatggtttctacttacagctactatctaatcccctggcttttctgaagttgaagccaataatatgtgaatactttaaggatacgtaagcatttgtccaaattagcatgactgatgttcagataaggacataacaaggacacagtgtggcactaaagaaacaaagttgctaataacatacagcttttgcaagtaaactggtttccttcatatcaatcactgtggaaggcttcacattttctttatccaacgatgccatcagtacaaagtccatggtttaggtgtttctttaaattatgctttaagaacctaggacaggtccttcaactgttttcaaagggaaaaaaaatacatcctaacaaagtgaaaacagatctttcaaataatatagataatgaagctgcatattaatgttttagattaaagatgattagtatctattatttcttttgttcagtacctggcatgagagctatctataagtaatcagactttatttatagataaataaaatttataggaagccattcgtttagactgagctcctgcaccaagcccaacagaccaaaccaagatggagtcactcatgctgaaattcctcatcaccaagccaaaactaagttgtttatttgaccttttaagcaatcaggagagactcacatccccaaacagtccagttttaggtactacgataaggaagttcctcctgcattaacctttgcaagtaaagtaactttgaaaagaccaatttgctttttgttttctatatatgttttcctctacccttttctgtttgtaaaaccaaactctgttcagctcattgaaatattcattctattttatagaatgcaaaattgcttgactctagaatggtaaataaaaaacaattaggatcttcaaactaaaatctgttgtaattttgtctttagaattatatctacctgttgggactagaaaaggttttgtgaaggtggtgttttctaagtgggaactaaaaagattggtagaaacaatacaggaaaacacaatagaaaaataatgaagagagtttgcccaaggaatggtaagatatcctttttagttaagtaaagtataagtaagataaacaactagaaatgtactttggggacaaaatgtgaagaaatatgaatgtcaagccacggaatttggactttactcattgttctccaggaaattatgaaagattataaattacgagattggcttgaccacattgttcagataactccacattccaacctcccagctaaggatattgcctcactgtcacctcactgagatggattggaacccctttccctgtaatctgaaactaacataaattatattaccaacagcatcttgtatgtatcacaacactccatataaaaccaacacctactgataagggatggaataacgttacttacttttctagattatcaatgttaacagtcagcgattcattaagaatcatcaaaccttggagttaaagaggctcatatatgcagtgttcaaaaagcaaacgtggaaacaaatgctcactggcaggagagctgattcaccagtcgtacagtcactgcagaaaatatagtccacgtgtttaagcactaaagtttcttttccctcacaagagcacaacttcaagaggaaatgcatgggtaaaatggataaatcccaggcctacacaacaacctagatgaagtctagaaatttagtgctgagtaaaatggacaagtttgttcaagtcatcatccagcgcaaatcacaatgttctgaatgtgttctgacaaggttttagagtgtagattcactacttttttggttacagcttattttaaaatttatgatttcttataaactcacagataaccaaggtgccttatgagaaaatgattctcattttaatgttgttgttgcaagttagaaaacaatacccccaactgaaggcctcagaatccaatctttttctgtccttttcctgtcctcctgcctctcagttccaatttttcctgaggttagccatagaaactagaccccttctttcccaaggtgggtgatagaaaccagaaccccatttccctgaagccagccaaaaaccttaacatattactctaacttgccccctctacctttctgtacaaaaattggctatgaaaaaattatctgacctaccttgtttaactgtaggtaataagattccctttccagagagggtcctcaccacactcagaagaaaggaatacgtactcagaaaggccaagaaaaatctagacagacaggtcttactgagtttccctactcagtctattagcattaaatcatattcgttttgtccaatcatatttctacaggatactgtccatactttgttaaacctaagaataaaaagggacaaattattcccctgcttctttgggccttcattctgaaaggcttcatgtcatgtaaaactgtgatcaaacaaatttatatgcctttttcctctcaatctgcctcttgtcaataattttcagtgaaccttaaggcagcagaggaaaatttttctcttagcccgtatactctccattcattgataaaatgattcactgctgtccctatcaaagaatagattgtttctaagtgaagatattatctcaagtttattcagattttagagatatgcctaggccagaagagagaagccagaagttggtaagaggagccaaatttgaggagcagtcataaaacacttattacttttattgggctgaatgagaaagcattctgtaaagatttctgtccatatgcataactgctgtgattgcaaaaccaagagacacagtaaagacggttttcaagggaaaccaaagaatgatgcttggtctgcagtgggggcagctgtttgatcaatctctatagggtattcacatgaagtttttggtccacaagaggcaaatctcttactatttttaactgggtaactatgagtattgcttgcagaacctacaactgtgttgcagtgctcactactgcttgcatgggtctttacagtgaacattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggggtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaagtttaagagtagggcttggtaatttcttcatctaaaacctagagaaagggcttcaatagggccatggagagtttttgatcttcttcccattgtactgagaagcacagtacaccaacgtcaaaatatagtcccacctaggaacgtagaaagcaagggcaaggagctcatcctatattttgactgaacggcattcccaaagctggtcaagacagaggagaatgagtgtataatacttctagaatagatgtgggccacatggcaaaaaagaaccagcctagagtcttttaaaactccaatgcaagagaacagggtaagaggaaacgaggctttaataggaaaagcctacatatggtagaaagtggaaaaccaagagctgatggaaaagtggtttgaaggtgagaagtcatcactgaccggacagagtttcagttggagagcccacaaagggaagtctctaaaaaacccttaactacagtaggtaagcgctacccccagattcttactgaagtaccaatcaagtaacaattctctggttcccttcctgctcctccctctccatagtctaactagtcctgaagatatcagtcatggtggttggtttgggcagtgggggtgactaaaatttttggtggccttcctgcaagaatgtcacagttagggcctgattgtggatgagagtgtggaatgaataacctttgaataacgaaggaagtgtttatattatattgagctgggaaatttacttattaagtgaataagtgttttacaacttgaagaaaaatgatgagtttcatccatggacatgggaaaatttttcttatgcataaatttttaaaggacagttaaagaaaatgatcagtttgtatactgattttaccttataagtcatgcttggttaatgtatgagtatatatatatatatatatatataaaatgtacattcccatagagaactttatttaacctagacagccactctgtgagataaatatgtctctcatttcataggtaaagaaaatgactctaagagagagcatttaagacaatcaatagcttgcttgaattgaatgaactgccagacatttttctaagcatttcacatatttatttcatttaattctaataacaaccctatgaagtagtcactattatattccccattttatagatgaagaaacagaggcatagagatactaaagttcacagccagcaagtgatatggtcagcaattacacctgtcagttgagcttcagagcctacagtcctatccaggaggcacatgatatagtgagtgagcagcaaagccagcgtctacaccagaaatcctgaatgagatttcccctagatcaatttgtgaggactcagctgtatcataaacaataaaacaaaagttaaaaaggaaggagggcagcacaacaggtctgtcactatcttgctgtgtggcatggggtaaataacttacattttctgggcttgagtttccatgtcgattaaattaaggaaatggactagagagtctccagggtcccttccagatttgaatttgatttccagctctaaaagaatatgtgtgtggtgggtagctaatgcatattaaattatgcaaacaatttagccttgcatttgactgcagggctgatgaaatatttttaaaatttacatttacataagagatagttttgaaaaaatgctatctgaacataacatgcaatcaaaaatatgttttataacatgtcaactggatgaaaataaaagacagtttcaaagatcaaagaagcctaaatgtgtttttttaaagagagtgtgatggggttatacatagattcattattattatttttagaactgcacagctgttttggcagcttgttttgtaaatcctactttgcaaatgtaatgaggtttttttccaaacaaatgttagttaatggagcagataacacatttatttccttgtcatagcttagcattaaataagaaatgtaacaagaattcagagtttaaaatatgaaacatggtatttggtctctttacttactagttacaaaattagaaaataactcaatattttactttctctccatatatattataattatctgtaattataaaatatttttcataacttcatttcttgtcacataagtcttttgctactgtaaaatcaatagttgtattactagtgcctcttcaaagcaaatctcaagtcgctgagcagaaatttttatagtatctgacatgatttaggcacttcttatgtgcaaaatactgctctgaatgctttacatttatgatattatttttttctcacaacgaacccatatctaggaactatcatcctcatttgacaaatgaggaaactgaggcagaaagagtaacttgccaaagttaatcagttagttgaagagctaggatgtgacaacagaccgttgagaggtgcagaataaaaccagaaacaacaggataaatagcaataatataagctaaaatattgtaatttttagttcaaatgtttgaggctttgatgtgatatcttagatatatttccacagaaggtctgtcttaaaaatgtaaaatttaggccttttttgaagccttatttattcttgaaaattctgtttcattacaaaaaggatttgacaagagaaatgctgttctccacttactcactacactgaatgatggggcctcagaaatttgtggtgcagttttccttacactttctgcagtctctcacattcagtgtgtggggtatattagtttcctggggctgccactacaatcaccacaaactgggtggcttagacaacaaaaacttattatctcacagttctgaaggccagaattctaaaaccaaaacgtcagcaaggccatcttccctctgaatcctctagggaagaatcctagtttgccttttcctagctttggggggttaatgaaaatctttggtgtttttggtttgtagccacatcacttcaccctctgcctctgtcttcacacggccttctacctgtgtatctctgcatctctccttcttttataaggacactagtcattggatggagggcccactctgaatcaagtatgacatcatctcaaggtccttaattaattatatatgtagaaagcctatttccaaataaggtcacattctgagattcgaagtacacatgaatttggaggacactattcatgtgtggagatactgtggcctggcattaagttgacattgacatacacctctgagagaccctatattaaacacataatctctgtaatgacttcacagatgtctccatgctgccgaaggtcgcactgtgacctcagcttgggcacttagcaacacatgggcaaacagttttcagcgatctcaaaggactgaggtgaaaggattaggggtaatcctctgagtacagtgcatccagggcttacctaaaacataacaaatatgtgcctcagccctcccaaagctgttccctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaacattcgtaagtgataggtggtgtttttaatcataagttagtaaaatgtgtattttattggtaggttatattttcaatcttctaaatatttctgaacaattgtctgattaattccttagaatgcaagctccatttgttctcagatttcttgccaatatctaggtgaacatctggtacatagtaggtactcaacacaacacatattttttgagtaaatgaatgaatgagtgaatgaacttggctgaatgaatgaatgaaactggatgacaaagaagagaatgcaaaattactagattcttaaatacacaacatgcccccttattactctagtcaaaaaataatttatgctaaaagagctattttgttttggattctcttccactgtgtgccgtccctccatactcccactatgagatgtttgaaaattttctttaaggagtggctaagtgtactatgtaccaaaatcaaaaagtaagtatgtaaatgactatatctttgttttcactgtggcttccaaggagttctaggtcaattaattgggtcaaatataaaagctccataggcctttatgcctacagattctgtatatctaatatttatctgatatatgtatattagatatatatatgtatatattagagagacagagagagctgtaacacatataacaatatgacctcgaattaatattttactcttgtttcccacattaagaagttcattcttttgaatagtttcaggtctacagaaattgcacagagagtgcagagagtatatactataaataaggcaccagatgtgattactcaggaagagcgaagagacatgtagagcttaatttctgcccatgaggtaagtggacgtgagagatatacacataaacagataaaatggatgccttgtactgttgaaaaagggatgaccatgttttgcaggcagtattacagtgtttcctagaatcaagaaatgctgtatgtgagggaaaaccgggagggacttcccagatgaagtggctcttggactggcctttgaaaaataatgtaaaggtacaacaggtatgagaaaaattttcgtgacatgaatggcataacacatatttttgaatgttatctaaaatattagatgaatgtaaccaccatagtctggggctagaacatatggaaccacagtctagaagaactattactatttatgttatttataatagtaataacagtatgaaaagttctttgtcagttgtgattcactctgggtaggacattgtgattcaccttgttttctttccaaacaaaaacattattatctttaataattttttgacatcagagaggcaactaaactcttcgttaaaggataaggttgagcacaggcatttatttgatcatttatattcagctctattcataaaaggattgaaaataatttccacacacatataattaaatagctataggatttcagtttttaggagattttagttagaatagttatttgtgtacacatgttatcactcctggttgggagagaatatcattttaccttagaagggtaaattgtcacccctttatttgccacaacagagaagccgattttcagtcactcctcctacatctttattccatatgagatgtaggtaatctcattagtcaaaacttgatgcactgggccatgtaaaaaatgaatagggctatttaggtttaaaaggtggtgggagagtggtcagtcggggaagcactattttatatcactgcctgaatagtgacaaagaattcctctcctatttccacgtggtcagcacttctaaaacagagcccaggttctctcaatctcagtgcacacataaaagcctgaaattctccttctttcctgctctaccagagaaattccacaaagctgaatgcataagaacatttgggatcacttacagacacagctttctccacaggtaggctctgaggtctaattcagatactcagaaataatcccacactctgtcttagagcaacactgaattctgcattgcagcttttccagctactagacacttgccactaataataaaactgtactttgctccccatttgcactcttgtccctattttctactagttagaacctagaaaatcattactccaaacctcaacgttctttctacactggaaagttcttgatgaggaggatcatggaatattcgcattttacctttggtgacatgctgatgatcacagggcaccctgcccattgtggatgttcaattaatattcttaaatgtaaatctggttaatataattctttgagatatctgctaaaatatgccccaattgctgctatattctactctgtccttcaaataatctttacaccagaagtttccaacacaaatgtaaaaaacatagtattacctttgcaatttggcttcccaatgatatgagactctagctaaatgcaggatatggggacagaagggagaggagattttcaaaaaaataggaagaacaaaatgtattgatctatttgatttttgagaagcaggtcacactgcagaacagccttttatctagcattccacagggagagagtaatgtttgtcatgattctcaaggcaaatcaatagagctagagaataaaaagaacaaaactccaaatctcaagttcccaattaactcagaaagcaatgaaatctagacaagctctaatgtaatgcactggctttcataaagtcatagaatcaacaggctggaagtgttgaaataagttcctggagtcacctagaaaactactggggaagctggattttaactcattggccctggtgttatgcagcaagcactaggctcttatcagattgctggtgactctgaagttatgaatgttactgggatttacaacaagctgattggactgcccaggagctactttagttaggttccaccaaggtacaagtacagacatagcctttattcggatacacattacagagacgtataacaagctattgtagtatactaagtactatttgggatttaccatgacctgacaaatgcagtgttcaagtcttgagtatactgctgccctatgaaatgaaatgtaatataaatcatgttctgccagtttaatccccatgacccttagtagttgataagcaatacctgtgacagtggaattattatctccattttacagatgagctatataagcctcaaagaaataaagtaacttggccataaccacattatttctaattggccaagccagtactaaaattcaagcctcctgagtctaaaccttatgctcttttcactacaatctcaagcaaatatcttcacatcaagaactgattttctagatcaatgacttatgaagaatatcagcttattacagggaatgcaacatgagtaaattaaatatcattcatatagtttgctcctgtatttttttttcaaaaatggcctatgtaaataagcatttttctaagaatctctcatgtgagtgtagttcagttactgtcattttcttattataacttgaaattcttttaaattctgaagctctcgtttcactttctaccctctgtaataaaactgaaatgtccaaaaaactaattatactttcatttttggtgtttatgctgtgaaccaccttttaggtcaaactaaaattattttcatggctgcctttagtaattaaaacttcttgcatgaagtaaaagaaataacatcctattgtgagagtattctagactatttcaaggttatcttgtttttggtggaaataaccaaagataattgagtgaacgaatagtgtgctccttaactatgacagcaaatgtttgcatatttacaatgtgctggagatacaaaaattagcacaacctggtgcctgtccctgacgagactgcagtttaggagagatggatacacaatcaattaaacaaaaatttatcaaacttagtcatataagcaaagaatggcaggcttagagaaggccagtcattcattcatgtgatgcaagtgaaaattccaataaggaggtgataactgaaccttgaagtaacagacatacttttgctacaatatgaactttaaaaagctaaggagtaaaaggatcaatcctagagctctgaattgtatatcatcggatttctggttaagttttccattacatgtgctgttggcgcccatcagagagaggttaattttctgatggagctatgaagcctcccaaaggtccttaccaaatcagaaaaccctccaactcaaatatgcatccatggtagactctgtttggaagcgttcccactcactgtttgcattcactgttactagtgctgagtactgtggtgttactgagttatggagaatttaaagcagccagaaatctgtaccctctttttcagttgcttagaatgatctgcaatctgactgaattgattgatttctgggatcatgaccagttttggttgtttcacatatgcttacaaatggtagatacagaggttttcaacaaggaaatgttaaatcgtctcccaaaaaggcacaaaagagagaatggaatgaactgattcttaatgaagaaataactgaatgaaaaagaaatccttttatctattgtgttaattaatattcacaaaacttttaagacaatggtttattgttgttctgagtatactcttgagattgatttttgtttaattatcttcatttttatcaacaagtgatcaaataacacaacagttccatgatagcagagggttttgaccacttatgggaaactttaagacactatatatctgctgctaagccatggcatgcacacttacaatgtacagaagtgttgctgtaaaatatgtcagcctttcaaaatgttttcttcagggtttacatcctatgcaattctaagataataaggcaatttacaaacttataaaaaagccaaaatagaaaattaatgatcaaacataaatggaattgtctgaatgactcagaataaattaaagactaccaggcctaaaataagaaaaatatagcatttgactatactaaccttttttctccaaataaattttgtcaatctccctgtttctttttgattaacgttcaatgtttagatctaatcacatcgactaccataataatttatgaaccatcctttatttactaattcccttagtgttacttccttaaccctcatctgcacttaacaattcactgctggatatattatctcattctccagttgtattccctttttgcctattgtctctccaagtaaatcagggaggaaccgtgtcttgtactttctttgtatcttaatgatacttaacacaactctatgcatatacctttattcagcagttgttcagaggttaacagtccgtgaaatttagcttattgttttaatgtgtttagctatctggtctgttgcatcaaagcagactagaagcagcaaccatgagaaaagctccgaaagctagcacagatgagaagagattacatttaaaaagccagccaaaatagtaaaaccactaaccccaaagtagactggggtccttcagtggaggggcaaatgattgcaaaaccttcagtgactctgagaatgtaaatgaaaagggtattcatctagattccaagttcaacaactatttatttaatacttattgtgtgccaagaactatgccagaatttgagtttacaaaggttgacacggcatctggatcatttgcttttgagatgctcactgtctactggtggaaagggatacattatcttattttcaaaaaaaagaaaaagtggcaaatgcgatgacaaacacaaacacattagagcagaagcgcagacaaaagatacttctttaacccagcctaagccaaaaagggcttcctggtgtagtaacttcccttgataaactcagttgccaagaaaatgtagttattgtctgttattgtttaataaggcactaatcactaatcactcctagaaataagttgaaggaaaggctttagaataaaaaaaatcttccaaaagtgcttcaggatttggggtgttcactataggcataactttgggtagaagtgacaagttttcaagcgatgtgtgggcagggaaaaacttagtttgtgaattgcaatgctactctgtgtgacaaagatgcgtcattcacaaaatacaaacaattacctaacagaaaaataaattcacagcaggaacaagagtgatttatagcaattaatgcagaatacacttaacacagacatcaagaaatactatcaaagctgaagcacaattacataaaccatctaggtatcgtttaagagaaagacaaaacatagtatctattctcccgaaggattcatgaatcttccttcaaaattagatttatacctgtgattaatttttttaatttttactaaattatggtatgctcttttgttatagctgatatccagatgaaatttatatttaaaatacaaatgatacttgtatcttaattgatgattccacgtttccacttaacagcctgaaagttcatccatggccatcctattttcttgaatcatcaactataaagtgttcataattaggattttggcaatgataaatgtacttaagcaatggagctcaaactaattcttatttaatggcttttcagtatcaaagtagacaaaattttagtctatcccaaaactagtttgtgctggttaccaaggaacatgggacctggttataaatccatttttctatttgaaatgacactttaaagattggctgcaaactgtgcactcaagatataaacactatatttccattttaaatgtcttcaacattacctaagctctcatgtgcaccatgccttttatgcttaacttttatcacagaactaccattcatgataccaaaaaaggcctcatgtccgagtgcccttgacatcctgctacaagaggaaaccactcactgatactcaagtctattatcaccaagaaatctttccaggaaattagatgacattcaaggaaaacactgataatcatgcaggaacctgaaggttatattttaaatgatttgatcagcctctgacgataggaaatagatttggggaaatagctgagcatctttcattcatttattcaacagttattgattatgtattcacaatgccaggctccattctaagtgctgggatgcaggacccaacaaggtagacaaggtccctggtctcatggaacttacattcctttgaatgagtccatcagtgcctagctaaatacatcaataatttcagacagtggcaagtgctgtaatgacaacaaaataggtaacgtgactggtgatttggagcaacaggatagcgtctcagcttttgtgccaaaaggaaggtaagaataaaacgagaaggaacactcactggaagatatgaagaaaaaaataagtagaggattcaaatgcgaaaatacaatgaccattctaagtcgatatgtgtgaggaagagactggaatcttgctgggtactgcacagacctggctccagcctacagaagagaagagcaaacaatccagagtgggattatcgactgcatctcttattttcattatgtgggagagttaaccacttttaacttttgtttattcactacaaaattagaggaacaacatcaaatttctaagtttgtagttaatattaattagtgtaaataaagcacttggtacatattagatgtccaataaatgccagttctctctttatcaggggaataagtagaatttacaaaatagggattacaaggagatatgaaacccagttataataatttattttataacacagctgacagtgcctcattcaaccttccagtaacccttcagaaaaggttttatcatctttctcttatggatgagaaaactgaagctcaaagagatcaagtgacatttgcaagatgattgctttgcatgggagcttggagttagacccaactaatatctcctcttggctggggatggaaagacaaagttgttggtcaaagggtacaaagttttagttagatgagaataagttttgagatcaattgcacagcagggtgattataatcaataataatatattgtgtaatgcaaaattactacgatagtaaacttccaatttcttaccacagaaaattatgtgagatgataaatatgttaattagtttgacttattccactttgtacatatatatcaaaacatcagtctgtacctcataagtgtgtgcaattatgatttctcaattaaaaataacaatttttaaaaagatttggctgcactacactgcctactgatcgtatccctatgataaagtaatacataagtcacagcttcagataaaggcgtaggagcttttcataaagtagtgaaagaaggggaagttgtaggagttacaatctgtctatagagtacaattccaagttacaatggttaagggcaagcctactgaagacagctaagcccagccctgtggtgtgccatttattagtcatacatgcgaaacacctagcatgctacctgacactaacagagtattcatttgcccaagttgtgctgctcgtgagtagcagggatgggacttgacctctcaagtttccaacacatcatgatacttatttcttcatgtaactagctgggaaattcacttgctacacagaaaagacaggttcttaaattatattgtattaaagtgactctttgttaaaacacaaaaatatcccaatagttacatgcaggttgtatccttgttaataacaatataggaatcttagaatcaattctggtctggtaagctataaagttatttacttcaaaaaaaaggacacatacaaaaaatatgtatataacatacatgtatatacacacatacatcgaaaaacatctatacatacaagtgtgtatttttcacctctatgcatatatgtgtgtgtatttatctatctatctacatatacaatgtcactatcccttgtttattaaataacattaaattaccatgtctccagttcatggactgtacatgtatttgtgcataaataaattgcttttcttattatcttctggtgatttactactattgagtaggagagcttcttgtatacgaagaacatctgatatatgtgtatatatttttataaaacacttttcatttattaattattctatggacataacagtttgagaatcttatggatgttactttttaaaaaattatcactacaggccaggcatggtggcttatacctgtaatcccagcactttgggagggcaagggagaaggatcacttgaaaccaggagtttaagaccaacctgggcaacacagtgagatctcatctccataaaaaaataaacaaaattagctgggtgtggtggcacacacctgtggttctagctactcaggaagctgaggtggaagaattgcttgggcctgggaggtcgaggttgcagtgagccaaggttgcaccaatgcattcctgccagggcaaaagaacaaaaccctgtcttaaaaaaaagaaaaaaaaaaattaccatggccagaggtttgttccagaatatcacccaaaaatattcctcaaatgaatactctgggaagtactggcttactaatacagagcaaaaggtatatattaatagaataaatgtgagaaacctatggaaataagtaggggaaataaatatatggaaacaaatgagtcatagaaatacattctttctatgttttaagggaaatactaaagttatgtaacctttgacacaacttgtggagcaaaagattgtgaatcttaactaaaaggaaaaaagaactattttcccaaagtcctcataaaagcaaagtgtgctatattcaacaatacgtgtatcaaattggcattgggatcatgcagctaacccaatttgaaatgccatttaagtagaaataggaaggcaaatcataataattccacaatcaaagctcaaaacatgtgttgacactcaaccaaaatatgaaaatggctaacattcacaccaaattttgattacactcatagtaaatttaaaactactcactaatattgctcagaatcagaagtttgttcagcgtgttataagcgactttctaagggcaagttactttgttcacatatggaccaagtagctattgacaaatcacgtggtttcttttcaaatgctttgtgtttgtggcattttattggtcattgtgtcaggaataccaaacaatttttttttttttagtgtttgcagaatattatacagtacaaacataaaataatatgttgcaatgagtcagcatccttttctaagttttataaagagaattcgtgataatttactttaggacagtgaccttgattgctttaaaatgcctttaatcagtgctaatttctcatcttaaaggaaaatggaaacatctgagtcaattctatttctacattgtcttacttataaaataataaaataatgagaggatattaaaggaaaaatcattcatttattcaaatatgcatacaattgctttaagtctaagatattgaaataaacatggcaccgttaaaaatattttaacggtctatacaattttctggcttgtaaagtcagtctctctctctgactggctcactttctatctaaaacatacctatctgaaacaacaaacaacacacttcaatacaaacataccagttgaacaagggacttcttatttattttcaattttttgagacaaagtctcgcttggtcacccaggctgaagtgcagtggtatgatcatggctcactacagcctcgacctcctgagctcaaacgatcctcccacttcagcctcctgagtagctacaggactacaggcatgtaccactatgtccagctaggctttttttatttttttaagatgggggtcatgctaagttgctcaggctgatctcgaactcctggcctcaagcagtcctcccacttcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtgatgtttactgaaaaaaaaatggtggaatttagaggaagaaaaacactttctcttgggaaataaaagaaaatcatatgaaaatttacctgttacaattcgttaacagaagagaaaatgaagtgtatgtatctggagatttccaatcatctttccagtgctaaatttgaacctcattctcaagggttttctaaaataaaacttaacatacctttccatcgtcacatcctcatgtcctcaaggctaatttgatttagggattattctagtgtttcgatttgctatcagtttgagagcctttgtatcaaaaagaagtgccaaattttgtgaggttcttaagagaataatgcaggtgaataaagcctcagtatactgggcttctcaggaatgtagcactgactgccatttataattaattaaagatttagagattctgtacctttcaaacgttccttctttttgtgtggaacattttctaatatatattcaacatttgcctgccttttcttttgattcagggttgtttctcctagttcttgcttatcttcatctgtttgggtagttgtagccaatggcttataaacaatataactttatttcttacagttccagaggatgggaagtccaatatccaggtgatggcagatttagtgtctggtaagtgcttgctcttctggtcgatagatgaggctgtctgtctgtgtccctacccaaatctcatcttgaattgtactcccattattcactcaagttgtgggaggcacctggtgggagataattgaatcatgggggtggtttcccccatactgttctcatggtagtgaataaatctcatgagatctgatggttttataaggggtttccgctttcacttttctctcattctctctttgcctgctgccatccctgtaagatgggacttgttcctccttgccttccaccatgatcatgaggcctccccagccatgtggaactgtgagttcattaaaccttttttcttcccagactcgggtatgtctttatcagcagtgtgaaacagactaattctcagagtccttacttggaggaaggggctaactagatctccagggtctcttttataaggacatttatgacatttttgagagcccttatgacttaatctcccaaaggccccatttcctaaaactaccaccttaggagttaggatttcaacatatgaatgtaggggggcacaaacattcagtcatagcactgttccctgtcatcgctgtcactcttttctttttctcctttttaagtgtagcttcctgtctccttaggcaaagaaacaaaacaacctaggttggaagaagcacagatatcagatcatataaaagcagaataatttctactcttacaaataaagtgcatgagattgtatagaaaggcatcacaatttgtctttttaatgtttaacatgcttttttgctttcttcctgatcttccaacatattttggcttatagggaaaagttttgcaactataacataaaataaaagataagcaacagcaatcttctaaattgataggggtaaataaactttaattagattaggtaactacttttagaaaaatataatatctctctataaagacatattgtttaacactaagagggctcccttgagtatataaaactaagaagtcatcaagaggtttggtttcttgaaacacaaactctcagaattttgcccataagaccctaacttaaaataataccagtggactctagcaggttaattatcctaccaatcaaagacagttctatgcagatgtaaacatattgtttctagtgacaaaaaatgatgaggctttaagactcagagtgatggagaagaaacggtatgaatcttgcctcattctcttgctagcattcagtcacctccccacctcctactctctctggcttacaaaagccgacctatctaagagaactgcctagagccttctggcaatacattgtactttttggtgtgggtcagtggcaggattggaactagtaattggatttccgcactcccagttcacttatctatccactacaaaacagcatgttaattttggaaatatttataccactaggtcatcatgacctttgaatataaccactggcaccaattatataccaggaatctccttatgcctcacctaactagagtcattgcccatggcagtatggacttcagatgccttctctcctggataactgttcgacatatataaaacctcaaaataatgtgttatatttaagaagaattcgaagacagaatatccaagtgtggatatatcaaattaatgtctacatttctctcttaattttctatccaaggaataagagctaaatataatcacagcaggaatcctaatgaaatgtttcaacaggaagcaatattaaagtatatcaacctagagtgattgttttgatagactgtcttaaaggtaaatctagattttctctttaaagaatactgaatctcaaataaaatcaaatctcttccctgaaatatctgtcaaaatcaaattggtatagactatttttatcacaaacactcccatttttcatagctattccaatacaactctgatttaaaaactgcaatagaaatatttaatttaattaatttatttttaaattttattttattttttttgagacaaggtcttgctctgttgcccaggctgagtgcagtagcactatcacagctcactgcaacctccatctaccaggctcaagcgatcctcccacctcagcctcccaagtagctggaaccacaggcacacaccaccatgctgactaactttgtttttctttcttttttttttttttttttttttttgtggagacagggtttcaccatgttgcccaggctggtcttaaattcctgacctcaaccaatctacctgactcggcctcccaaagtgctgggattacaggcgtaagccaccatgcctggcctacaatgttttcattttattttatttttttttttttgagacagggtctcactctgtcacccaggctggagtgcagtggcacaatcatggctcactgcagccttgacctcccaggctcaagtggtccccccacctcagccttcccagtagctgggaccacaggtgcacaccatcatgcccagcttatttccatattttttgtagagtcaaggttttgccatgttacccaggctggtctcaaactcctgagctcaagtgatagccccgccttggcctctaaaaggggtgggattacatgtgtgagacactgtgcccagcctcattttatttttaaacaaaatcttcaaaaattgtcctgatttaataagaaaatacaacatcctaaaacatgatattaatatttaccatctttagttgtacagattctttatttctttgtaaagaacattattaggtcttcataagaaatgaaatattgctctttatgagtttaatgcacataagtaatctataattctgtatgaaacttttacaatcccttaagaaatgtcctgcaaatttgataatatcaaatttaaaaataaaatacttttaaggtccaaactttagatttcagaaaaaaacatgtggagtacttagtttatacagcctaactctgttctatcatttgcactgataacattattcctgaacacattttagcccaaacccagggaagataggcttacatgcaagtttacaaaaggaataaaatccaggtagtcagcaaagtgcccacaaatgagaaccgaaattcttctaaattgctttgttcaagtttcattatctagacttgtttttggcacaacatggttattgctcaccctttactatcccttctaccagcacatgttgtgaagaacaataaaagtactagggtcaatatataggtatgtctgctcaaaaaaataataataagagaaaaacctatttggttagaatttcccacgatttgcgtcatagcccacaaacaagaccgattcattcacttttctggaaatatgctatgaagcaaaaattttaaaaattaaaaacgtcttctggattgctagactggttcagtcgcaatactttgtttgaaaagggaagagaaaagtatactgtttggtaattggaactcaaagaccacatcctgtgttgttaaatgcagatttcttgattggcatgacagagtatgcaatataattatttttaattgccaattcacatatctaaagaaaagaatatataagactcccagaggcactgttctatagcaggagtttaatacgtcaatgcaggctttagcaaataagggcttttgtcaatatttccctggcacatcacccacaacataacaataccacttagaatttatataggcccttcatttgcaaagtgctttaaaataattaatccccagaatactcatttgtcaggggaatgagcaattgattataaaactgaggatttcaagcaagaaatggtttggataagttcaaaaaggaatctcattttgaaatagaatctctatttgaaatagaatctctaacatccccaaagttagcagtgctgttttgatatggttaacatctttaatatttttaggcactgataagttgaacccataggtttctttatgctctctatatttctcgaaagctcacttctgtactccaacgtgtgtgcagtttttaagagccacaggtttttccatacattctcaaaaatggtagaatgtctatatttctgaatataacactgagaaggcatttgtaaccgctattacaatattagaccattagcgctgtggtggcaagcacaagttcactattgtatacccgagactgaacacagtgcatggcacacagcaatcactagtcatcccaacataaaaagctaatgttctctcagcttcattaactcatatctttatttgttcattcatttaaccagtcaatcaatcatcatttgttgagctctgctatctgcaaatcactgaatgatttagcaagaagatgagaaaaatgttatctgtcccttgatctcatagagtttacaattaactagagatatataggtaagtgaaaaatgaagatgattaaagacaacaatagaagaacaggaaggtcggagaacaaaagaagaaagaaatatttctatttggtgagtgtcttagtccattttgtgttgctataaaggaaaatctggggctgggtaatttattttaaaaataggtttattttggccagtcacagtggcacatgcctgtaatatcccagcatttcgggaggccgaggtagacagatcacttgaggtcaggagttcaagaccagccgggccaaaatggtgaaactccatctctactaaaaatacaaaaattagccaggtgtggtgcatgtctgtaatcccagttactcaggaggctgaggcagaatcacttgaacccaggaggtggaggttgcagtgagctatcgtgccactgcactccagcctgggtgacaagcaagtctctgtctcaaagaaaaaaaaaagaggtttattttactgatggttctacagactttacaagaagcatggcaccagcctctgcttctggtgaggactcaggaaacttctggtcatggtggaaggagatgtgggaggtggagtctgcatatcacatggtgagagagggagcaagagaacaaacagaacatgtcaggttctttttaacacacagatctcattggaactaagagtgagaactcattcaattcctcaagaatggcaccaggcaattcataaaggatgtgcttccacgacctgaacacctcccaccaggccccgcctccaacagtgcagatcaaatttcaacacctgatttgaaggggacaaatatccaatcaatatcagtgaggattcaaaacaatgcttcacaaaagatgtagttttacttgggttttgcatgattttgataggcagaagaaattggagaagattgttgcagactgagggaaggccaagaagtagaaatagctttcctgccaccaccaatttggagaaatttgtagctgaaattatatcacttttgactacactctgtaaattcaaatttgatttgtgttgctgagaaattctggatgagattggcctgtgattaccatacaaattggttgtatgtaaatatgtgcttctatagtgtttgaggacatgacttattctttcatatatctgaaatattcctcagattgtttcctctcctaatgtatattgtatttaaaaaatgagaaaatgtaagtctcttttgaataaaaggctgaaagacttctatggcatactacaccataattacttatatgcaaacatacaataagtctacagaaactcctcaaatacacatttaactttgttctaggcattatggaggatatagtgttgttcccaaaagaatgtcttaacagtgctgatacattaaaaatgttctataaattcttgttaattaaatattacctgatgagtttacaatttgaagggaggacgagtgactccagactatgaggagaacgactggaatgccacatgaagtcgtagacagtgctctctgtgcaatgagtaaggcacaaaacactgagccagtcattgaactcaagtcttcccgatcccagtctaagatagtctttccacagatacattgattctattagatatttcctcattagaaggacttcatttcagtactgaaattacaaagctgcctcaggtatttatgcattttatttttcttcccctgtgctcatgtgatgctccacctgtcccactggggcctattttctctatggattgtgttcatctcccacaaaagccaatagaaactctggcaaaacataggggagcacaggcaatcccttctgccacccctagggcatgctcaggaagacactggtatcgctgctaatagcacctaccaggtgtcctgggttggaaaatcttacctactctgtcacatggcagccctcctcccagagctagccaccagtggtacttactaaattataatgatctactttaaatatcagtaaatgatggtgcaactgactttaaaaccaatttggatatttgctggacatatctgtcattgaggccgattatgaaaggttatataaaacttaacaatggggctgtccagatgggacctaatagtttaccttaatttttagcttaaacagagacagcccaatattacaatcctggactaccaatctattaccttccaaatgcctggggccaggtcctgggggaagcatggtaggtgccaattttggtcaagtcaggtctttcttgggggcggtcatgagaagtaagagtgaagagttgtagataattatatttcataataattcattttctttataatgttatgtatttttttatatataaattaaaaagtattattctaaaaagggaatccctagacttcacaagactgccaagttgatccatggcacaaaacggttaagaatccctgaaggctcacctggcgcagtggctcacatctgtaatcccagcacttgggaggccaaggggggctgagcacttgcaactaggagtttgagaccaccctggacaacatggtgaaaccccatctctcctaagaaatacaaaaattagttgggtgtggtggcacatacctgttaccccagctacttgggaggctgaggcatgagaattgcttgaatccgggagtcgagatcaccccactgcactccagcctggaggacagagtaagattctgcctcaaaggaaaagaaaattcccgaaagattgtccagaaatcagttaatgtgcaagcatagcaaatgcatgggacaaagaagagtagagaggtcactttccataaggaaaacacaatgaggtattgaaagtccaaagaaacatggacttaaaatattactgtgaaaaaaaaagggcaatagaaaggagtttgcaatatctggaaggggatgggttaagactaggtgaagataaacgaatcaccgggcatggagaaatcattccaagacaagcatcagggagaaaaccgaatactctctttatcttgcaagtagtgtcttaaagaaacagggtcccactaaatagtcacttgggagaaatagccaagagctactaattattgtttagttactcaattcatccagtaagtaaaaatgtattgaacacttattatgtgtcaggtaccacatgctaggtgatagatatccaatggtatagaaacaccacaaatggtctttgaccttgtgaagcttacagttgacttggagagacaggcattagttaagtgagtaagaacccaaaaaattatgataagctctacggaggaaaagagtactgtggcaacaaaggcatgcatagtctcgtggtcagtggaattgaagttttgacctgtaagatgagcacaaattggccaggcagagtggagggagggtgttccagatgaagggaggagcatgtagaaaaagagggtactgctgcttagtattttgaattatgacactcttcaacacactgcagaaattgggtagattctccaccttgagaagaagaaaagagagtatgggagtagaagtcaggtaaggaagggagcagggaaagaaacaaggaggaggaggcaaactttcgccatctaatcctttgactggagcccgagcaaccacctcttcttttatttactctccaaatcagagccatcttttctctcttacaccttttgccatgaaaagaatatgatgaagagaataagagaaaccctatttcattttaatatttaccaagaatccaaaatgtacaactgagacggtgttatggagaatataaaagtgagcacaacacttgctttgcagaacaatcaagtgacagggagaaaaaaatctaacagaacgcctgctaggtgttgaagtagagccaccagccctctgggtggccttaggcaggtcatgtctcctctgggagccttcctttcacatctgtcatagagcttgtaggcaactgactttgtgaagttcctgccaggttaaacagactctgctccatttttcagactgttattagaaaatgctcaaatacatctgagtttgtgtaggattggaggcagttaatatatttaaggagtcagacatataattaagattttgttgttggggtgggatttctcccccttttaagtctcacttttgagaaactggaacctgaattgagctgttcagagatgaagactaatatatcataatgtgcacttactaattcactaaatgtctagatgttgatgttggggatttaaggaggggtgtttactaagaccaggcacgggactaggtcccaggaattccaaattgcataaaatgtggtccttgcatattagtcattcaacgggctcagaatggaaatggccatgcagaaaacagtgagcataaagagtttactgctgtatcaacctggacatacaaaggaagaactctgagaccactaagaaggaagtaagtgttaatgggagaggtacatgtggaaagttttgtcacaagtcttgcattggtgcctgatcttaaggagtgaacaggagttagctaaacaaggtgaagaacattccaggcagacagactatgataagtaaaggcaagaagggaaagaatgaacataatgcttttccttccccagcatctatttcagtcacattgcagataaacaggattttaaacatgggaagtcatccaaatcagacaattctcattcttttatcaaaatcctaaagggaacatttttaaatctcttttgtaattgctaggaaaatgatgtgtgcccagagtccttatttagaaaaaacagtccttattttttaaatcaaacaatatatcaattttccaatagagctggaaccaaattctgcatttcatatgttaattgcaatgtactttttcttttgtaaggtgcatgaatatggtctgtcagccattacacaaatttaagtatggaaaaaaaatgggcttcacaaaaagcaatgaaatgcatcaacatcagagattttgtcacgttagtagacaaaaacatcgacttgaaggatgtccttgccaggttaggatacgtcccttttctagctaatgtcaacctagactcagctccagtcagaaatgcctgcttggttggcagctgctgagagatagcaactcctcctagcaacagatggagccaatcaaaagccagcagcagtgatccttgctgttaagtgcaatgacatctcatttatctggcaactccagtgaagactgtatagtgcacaagataattactaagagactgaaatttacattcccatgcaccagggactattagaatttcaacagcatgattggaattttgcctaaaattagatgtctgtgtgtttaaattatgaacaggtatcagagtgtggtggattacgcttaggttttaaagacacctaaaggtgactgttagttttatcacttactgcccatgtgttctgaggcatgatagtttccctgagttttaatttttccatctcttaaaataagatacatacattgcctggcctaacatatctcacagcagtgttgtgctaatcacaaaatatagcagatctcaaagccctttgaaactgtcaagcttcatgtaaataaatactaactgacattttcctactattagagaaacagcatttaatatagctaatagcttcagctcccatctgggtaatctccagtaagccatttcatctttatttcctcacctgcccaaggaagataatgctaggacgtgattcagggactggctgtgaagactgtagtaagcactcaaaaatgttaactaacaattattatcattccatcatttaatgctgcgagaacttgaggtgttgctaaattggagacagtttttattcctactaaatgacccccaaagcaatattctatagaacccaaaaacacatgtatccaagggatcttgcacaaaactctcttaaccctccacagctttttaacacattcatgcatgctagagattatttccaagacatctacttcccctgttgggcaccgagcgctttacttttgctgtctcctcctgatgacctctccattccatgaaattactattctcctgctctacatataactaaaaacttgggatagtccatggtttatttgattaagcaagtgctaccaagcttatagttcctcacaggtctgtctaaacagagtatctactttttatcttattatcaaaattctctcctgcatagaaaggaaagaccaggaaatttttttaaaggacctacagtagtcagtttctcaattctcactcaactccacttgcttgcggtaatatttaatattaaaaaggtataatataattatcgcatataccatactttacatgttataacacgtgaatctgttatacagttaagaacaggtcacaatggccagtattctgctggacccaaatcagtaagacttactgacaagaactacagttttaagctacaattttaaaatatcctctctgcttcataatgcttattccatactcagaactttagtagatcccactttgaatgtcttaatttttgtactgtttagctttcttgctgtataagctcctttgagagcagaatttttgtttcattgtttgtagcacacacacccaaagcatctagctcactttgtacacagtagtacatgcttaacaaatagctattaaagaaatactcataaaaacaaaaaagaaagggatggagaaagaggaggaggattggaggaatggagcagaaacaagagagattaacagagaagggagaggaaggagggaaataaggagaaaggaaagatggaaacagaagaaagaaaactaaattgttataaatgcatgaggagagatatcaaagatgtttgactactttaaatacaactcttagaccatttttcagatacagtataacactgtttctcattgccactcttgtatgtcacctcttagtccttaggatgactgatgctactacagggtgtcaaaaaaatggaattttaacaggcttcattttcatacaaactcaaaaagctaaatgtaaaaaaaaacaaatttttaaacagagatataatacctttgtttgtgttttacttttcttcccagaaatacacgtcgagctgccctttctctatatacctcccactccttctctgcctcccagccagattctacacgtcagtttgctcgagtccccagctctcacgtcctcaaaccatcgccgtctctcttccagacacacacctcagccaatattctggcttccagtgaaacacaaatgaagaaataaaagtcttaaatagaaattctaaactcctgcacatgatagaacatttacttttctaataagggagagaaaggtggcttaggaaaaaaaaaaaaaatatatatatatatataaatatatataaatcctatgaaaaactgtgtgaaaagatctagagttaagagtcttagtttttgtgtcggacactgatattagtgacccctatttcctttgagaaactttctatttttctaagatagcaataatgacactgctcaatccatctctctggttttttttttttttttttttttttgagatggagtctcactctgtcgcccaggctggagtgcagtggcatgatctcagctcactgcaagctccacctcccaggttcacgccattctcctgcctcagcctcccaagtagctgggactacaggcgcctgccaacacacccggctaattttttgtattttcaatagagacggggtttcactgtgttagccaggatggcctcgatctcctgacctcgtgatccacctgtctctaaggtttttatgtggatccagtgtcattacaaatatgaaaattttaaattttaaaaatgtacacaaaaacacacagttggattaccttttctgaatgcacatttttgtttatatgatttcaattatatgttaggggacacaacaagttggaaattcttacacaaatccatccattatggacgctctaagccactaattcccactactgcaaccaggtatacataaaaacgtgccttaacccccagttcaggtgagttgcaggttatgattctccaatgatggaatactctgagaaggcaaaaaggggcatcatttttctgggtggcatcataatcactaccaaaaaattggtcaaagaagcggggcatggtggctcacacttgtaatcccagagttttgggaggctgaggcaggaggattgcttgagtccaggagttcaaaatcagcctggacaacctaaagagagtttcttgacatatatttctaaggggcaaatgaatgaattctagttctcaaccctgtattgctgattgatatatgttgaccatgaatggttttctggtggccccagagagtcgacaatggtttgtcatcaagggcttatccagggcagaagctaataaaatatcacttgcacagattaaataacaccacatttcaggagaggcagtataaataagagggacctctggataatgaatggatttaaaaggtccagcctgtccaaatcaattttctaatctcataaaatggggttgaacccaataatttatgtttccttccacttccaaaatttaataatattatttacttgttcctttatttatttaaaaatatttatttacttaaaatgagaaaagtacctgtgaaagaattagatttgtttaatattctcatggacactatgatcacacatcatgtagtatttaaatgtgatcaacaaatagttgaaaatgtgttatgtgaaaaataataattttcgcaaacacttttacagcacttaccatatcttaggcatcatttcatgtgatggaagacaaatatatagatagacatggatatggataatgattgaggtaagaaatacaatggagacagagacagaaaaattcttttaatcattacaacaaccaacagctttagaacattaaccatgtgttaagtaattaacatgttatctatgatgccagataaaaaaggcacaataaatagaaaatgttccttatcgtcacctccagggtacgctttaggtaatgaagttctaatatcagagatagcagcaacgacaggatgctaattgtggtgaatattagaaaagaagccactgatgtagtctagccgacctctatgatcacttttatcaactgaaagttaaaaaataaataaataaagctagagtgggcacaatgctagatagcagagacagaactggcatatttggaagatctctcaattctacaggcagaatttttttaaaacaaaccaaacaacaataataacagtttactgttaggggaagcactgaggttgggctttaagagtttgctgagaagctgatttgcaaagataggcaagcttggaccccagtgaagtggtcaaataaataacagtgctcaaagagttatatttactgccacgcaagatgaatcatgcctctttggggaatgctttttctgaaatttcatttcccattttggactactggatcagtctctcagaagagtttggaatgtggccaattacttccctctgcatttttcatctgagacttaggctgtacaactccattttacattttcacaccatacatcttagatagtagggacttcattttgtgaagaataagacaccaaaaatatagtctgtttgtaaatatagatttgagaataaagaccaagaaacgcacgttagaaatcttaagaaatgaatttttactataattatctacagctctatgctccatacttatattttaaattataatactaatgaaaaaaatcactgttgagatgataaattagcagaccattaaaagcttttaagaatgaaaaccactctccaacgatattcacgtgaaaaaccagacagtaaaagaacaaacaagtaaatgtggaaataaccagaacccaatatgcaactgtctcaatcacatttaacctcagtattactagagcactcaaaagtaataggttgttaaaccgtttggagggcaaatgacattggcagatctaatggcaaaacaaacaaaatatcaaatatatttaaaatttaaaatatcaaagaggccaggcacagtggctcacgcctgtaatcccagcattttgggaggccgaggcgggcagatcacttgaggttgggaatttgagaccagcctgaccaacatggagaaaccccatctctactaaaaatacaaaaaaattagccgggcatggtggcgtgtgcctctaatcgcagctactcaggaggctgaggcaggagaatcgcttgaacctgggaggcagaggttgcagtgagccgagattgcaccattgcactccagcctggccaacaagaacgaaactccatctcaaaaaaaaaaaagaaattaataaacaaataaatttaaaaaaataaaagtccaaaccaaataaggtcctttaaaccactgacctacagcaatccattttacttgacggagcattgggtaggggaaagattacagataagttattttaaggaattaaattaggtgaatgttaaatattctagaattatataaaagaaattgtcttagagtaggcattgaaaaattagttcaaggtctgtacccacttacttttcctatgagacaataagtacaaacatgttttgtaaatatacaatgtaaaatataaaatacaatgtaaatattgtatttcatctacagaaatattacttgctttttgtaaattaaagaatcaccctcaatgtatcatgcaggagcaactccatttctgggtatcacataattttaaagcaaagatgtaaccataaacatgctaaattgactataaaaaataacatgcagagtgcaaaggaagagaataaaatgaagagcacaacacagccattagtggaaagaaagactgctgctatgatttagaccattcagggaaaaccaaagcagaaaccatagcttgtgtcagtctcattaagattaaattcacaaatatcccatctgctatggtttcctaagtggctacagtgaggacacaaagcttttccacacatttgaagaaactgtggcaacaaaaaactccatcatctctgtggaggtactgttgggtgggtgatgggggtgagagagtttgcaggaaactggaagatgggaactggaagataagtcggacacagcctttgccttcaagatgctgataattcatttctggagacaaaagtacaaactcaacctaaggtgggagagaggtacaagcagaaagctatggaagaataaagaaaggcagactacttcttcagtttcaacaggaaacacagtgaggatttcatggtggaggtatactgggtcttaaagaagaaacaggacattgataaataacgatgacagagagacatgagcactgactgagtgcatggaaagttgagatatatgaaatgactgaaaaggaaaggaaaacatgtcataaaagtaaatgaaaatggagatgaagccagagaattatgctggcttctagagggaacccatcagaaaatgttattctaggctaaactatgttgaaaatctttcatccttcttaaaactctgtacttctcagtatttattttagagtacttcttcttttactcttttttcttctttttaagagatgggctgaattaaactacacaaggtgaagtagatatagaatatttaaaatggtaaattatcgagcatgaaatctcatctgattcaatgagtgaaagtaatattgattaacccagccactgaccttgagtaacagacataagaatactgtaataaacacaaaaaagtgctggtaaagtatttgtcgcaatgccaagagctacaacctggattaacagtcacacttcacaaaatagacttctatgactttagatgtgcttattatgtctaacgatgaagaaggtgaaacaaactaaactgagagtggaagacacatgttgcccctcaactgtgtgctattttgatatcgtagagatgatcattaagtgatttatcataaaatgtatgaactaaagataaatatttaattatagaaagtatgtcttcatgtgtctttctataaagatttctatgggcttcaaacttcagttagagcccttttaaaatatttatacttaaaactgcaccataaattgcaatttgcaaatacttatgaggaagtaatattctctctgatgcaaggcaccaaaaatgtacattgcagaattgatacatacatttctatatctggttttcattaaatagctcaaaggtgtcattttaaggtacaaaatattataaaatatctcacaatacatgtttaaattgatctaaggacagaaagtaaaaatctgttttgcaatttaatacctactcaaatgtaccacctcattaagagatatgtataatttttttaagtgctgacaataatcatttggaagcccaagctcagtaagtacagttaaataccagtcctaggaaaactcttaatcaggaaaactcttcttgcatagtagtcttctgtggtcaaaatcattgtgtttacagttgtaagacacagcttcacaacgaaaacatggattccactctgtttccactacttcttccacttttttggtccatcaccagagtgttaaaatgttgtctcacctctccaatcgtgaagaaattcacacctctgtattactttaaaaaatgtaattcaattaatgtgtattgaatacataaagaacaatgattttatttcctgtttaatctcaattaaataatgattaaattgacattttagcttttgtttggacaaattatctttctaaataacagaactattaagacataattcccatacaatacagttcactcattcaaagtgtacaactaaatggtatttaatatattcacagagttgtaaaaccatcaccccaattaattttagaatatttttcttcacctcacaaagcaaccccacaccctttagctgtgaaccccttccattcctcccatccccattcagtgctatacaactgctttatgtctcaatagagttgctttttctggatattttacataaatgaaatgataaagtatatcttttgtgactagcttcttccatatcacataatattttcatggttcaatcttatcgtagcatgcatcagtactttactgctttttgttgccaaataatattccattgtatgaatataccaaactttatttatccattcatcagttgatggacatttgaattgtttctacttttaggctgttatgaataatgctactatgggtatgcatatacaagagtctttgtgtagacatatattgcaaattttcttgggtacacatctagccgtggaactgttgggtcatataataactctgtgtttaatcttttgagaaactgccagactgtcttacaaaatgcctgcaccattttacattctcactagcagtgtataagagttcccatttctcacctacgtgtgttattatcagtcttttttaatatagcctttgcagcgggtgggaggtggtatcttcttgtgattttaatttgcatttccttgatggctaatggtgttgagtacatttcacattgctattgactgtctgtctatctatctatctatctatctatctatctatctatctatctatctatctgttttcagatcatttgcaccctttcaattaggttatatgtctttttattactgagttataagagttctttatatattctagatacaaatttcttatcagatatgtggttttcaaaattttctcccattctgtggattgatttttcacttgattgtgtcctttgaagcacaaaagtttttaattatgatgaaattcaacatatcgattcttcttttgttggttgtgctttagatgttatatccatgaaaccactgcttaatccaaggtcataaaagtttactcctatgctttcttccatgagttttatggtcttagctctaaaagccataggttttagggctctaatccattttgggttactttttcatttaggtctgtgatccattttgggttactttttcatatgtcatgtgaaaacttagcctttaattttttttttttttctgctaccattcagatttcttaaggtcttcagacaatggcaacaagatcttttcattgaaataactaagaaagtttgtggaaaacccataagcatataaataaaaaagaaagcatttcaataagtagtacataaatttttagaaattaaacatcttattcttggattatatgtacaattagtcaaaacgcaaagataatacaaatacaaaacaaggaaattcatgagagctaatgaaaacttaaaatgttatgccgtggagcttgccgtgagccgagatcgcacaactgcactccagcctgggcaacagagtgagactcggtctcaaaaaaaaaaaaaaattatgccaagacacaaaatatttaatgtttctataaccctgcttctctctcttatggcacctaacaatttaaatattttattatagtattaacgtatagtgtttgcctttgtcttctaccatgattaaagcatctataatataacttggtacatgataagtaaaaatattcaaaattgaataggtgaacaaattaaaatgaatgaattctagaattggcactttttccctgttttgatgcataattttctctccttttcatcctttatgttttagcttaagtattacatccttaaagaaatttccagagaaattctgtcgaaattagtttcctctattattctctattacagaaatacatttcattctttcatagcactaatcctaaacagtaaatgtttacatttattttttttacatgttattgtgttctcccaatatgggagatggaaggtttttcattttacttccaatgcctaagacaatgtgtgacacattaataattttaaataaataggtggtaaatgatagtgtaaatgggatcatagacaacctgctgatccctggattttcaggaatagctatattgaaaccacaggcacaatgtcattgctatgtcctttttcatggtagagctttcagttcccacacaacctttcacacttccctgaagagaaaaccttttcccatctattgaaatcgaagaataaaggttgaagtagtaatgcttattcatccttgcccttgctacagaaattttagaggtaatatctagcaatctgcaatgaacactcatcaagcaataagcttctgtttccaaatcccagatgagttctaatttatttagacctgaataaaattagaggtaatctctcttccttgtagtctctacagttcaatatttggcttcccagtagaggttcataaacctgtcaactaatagttatggtgattagaaagataatatgcaatctaatgaagagactatgtatgcatatctatgcttcagtctactccctttttctctctctctttcttgccctaaagtcttatattatgcacagttaagtttttggtctagagaggtgtggctgctgccaggtgctatggactgtaagtctctattaccctcagattcatatattgaagcctaatgctcaatgtgatgcaatctggaggtggagacttagagaagtaatcaggtcataagagtaaagtcctcataaataggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagtatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaaccaataccgataaatgtctatctttagacttctgggtgtatgaggaaatccaaacctctgatccctttaaaccattgttatgggcatcactttcctcacagctagactcaattcctcattgatacaggaaagtaaacataagaaatttgttattaataattggtcttaggaaataaaatcagaagaggaaactttcttcttagtgaggttttgtgcacatattgacacctcaaattacccactgagttacatgtagaattatgtggaaggcatgtgtaaggtgactgcataattattgccaaaatctgaatccaggattctttagaaggttaaataggtgccaccaataattatactaagatactaggcataaactagaactcttctggatgaaccaggacatagagttaccccatgggagaatgatgttcacagtggcctcaaaataaagttctttcatttcagttgtagctggctgaaaggtatgtcacttaaattctatatattcccctaacataactactaggttttttgtttggtgcagaaataaccagtaggtataccataaatacagcagactgtgggcttgtggagcatgctgcactccgtgatctatctctgtctatcattgttcttatttgaccccatcacaggtgtttaaaatttgtttcgtcgttgttgttgttgttgttttatgtcttttttctcagtgctatatgttcaaagagccaacttctctacagacttgttcataagaatgacttgtttctgcttctctgctttgccagatctctattcctttcaaatttctactgaaaaatccactgatttcccctttgcatttaggacacataaattctttctcttttcctctccctgaaggttatgaaagtcctggactgtagctttattttatgttgtatacttccctccaagtgagttatataaggagatagttccgagaaggaaaatgcccagaagttgaaaaaccaggtcatcctagggggaaaaaataagtagccaatacttttttaggattttcttgttaaaaacccaataaacattcaaatatgaaaactactaatgtttttacattttgcagactggggtatagaacagcaagagaaagcagaactaataaagacaggagatcttttggaaatcagggtgaactgatttcctacagcaaggccataagctacagcaaggccataactcttcagaaggccattgtgtgatgctttggcaggaacaacaaggaggacatggactaaatggagcttcagctttttcagaacatgttactactctcaaaaattggttcactgctttatcagtttagcagttcataaaaatgtaacccaaaccgatttatgtaaaaagggcaattattggctcaggtaactgagagttttggaggtagggctggctttaaggataagaatgagaacttgttgctccccatgttttgaaccagacctcctgtcctctgaatgttggaatcattagcagaagggatctccctctgtggtattaagatggttagagtccctttatcttttctgctccaaatccagtttaaaaaataataatagatcattgaggtggagcaagatggcaaatagataacactccagcagctgtcctccctctgctaaaacgcaagaatgaataactacctacacaaaaaaaaatccttcataataaccaaacatcagatgaattatcacagtatctagttttaacttcatatcactgaaagaggcactgaagagggtaggaaagacagttatgaatcacctatatcaccactttcccatcccccattagtggctgcatggcatggagacagaacctgtgtgtttggggtaaggagagtacagtggttgtggggctctgcattaggactcagtgcttccctgttacagtggaaaacagcaaagtgaagaacttgccggtgcccagatagggggcacctagaccagccctagccagaggtgaattgtctgtcctagtggtcagaacttgagttctgccaagccttgccactgaggtcctaaatgaacttgaaaggcagcctagacaacaaagcctgcaattcctggacaagtcctgctgctgggctgggctctgagtggacttgtggtgcatgtgacctagtgagacaccagcccaggtggctaaggggatgcttgcatcacccctcccccaaccccaggcagtgcagctagcagctacgggagagacatcttccttctgcttaaggaaagaacaggggagagtaaagaaaactttcccttacaattgggataccagctcaaccactatagaatagagcaccagtcatgaggcctgcattccaggccctagctcccagatgaaatttttagacacaccctgggccagaaaggaacccaatgccttgaagggaaggacccagttctggcaggatccatcaccagctaactaaagagcccttggattgtgaataattagcagtggaggccacaggccttgggtgagacttaaagctgtgctggcttcaagggtgtcccagcatattcccacatgtagtggctataggaagagactccttctgcttgagaaaaggagaggaaagagtaaggggggcttctcttgcagcttaggcaccaccttgaccacagtggagtacagcatcaagcaggttcccagggtagccagctccaggccttggctcctggatggtatttctggaccagtcctggggcagaagtgagcccactgtcctaaagagcgagacccagccctggcaacgttcaccacaagctgactgaggagcccttggacattgaatgaacattggcagtagccaggcaatgtgtgctgtgggccagggatggtagtggccacaggaagagactctcctgcttaaggaaagggaaaaaggaagagtaggaaagacttgttttgcagcttgggtgctagctcaaccacagtagaatagaacaccagcaagattcataaggttctcaactccaggccctggctcccagatggtatatctgaacctacatgggggaaaagggaactcgctgccttgaagggagcaagcctggctggtttcaccacctgctgattacagagcccttgggccttgagtgaacataggtagtaaccagacagtgctcaccacagaccataaaggagacacagtgctgtgctggctttaggtatgacctagtgcagtcccagtggtggtggccacaggggtgcttgtgtcatctacctccagctccaggcagcttagcacagagagagagagagagactgcatttgcttggggaaaagtaagagaaaggaacaagggtgtctgcgtggtgatccacaaaattctcccaatcttacccaaaacaccaagatggtacctcttgtgagtctacaagacccacaacattactaggcttggggtgccccctaatgcaggtatggctgcaatagccaaaaacttagatcacaacacccaagtccttttgaatgcttgcaaagtcctccgaaggaggacaggtaaaacaagctcagactgcaaagactacaagaaatacttaacttcaatgcccagacactgatgaacagccgcaagcatcaagaccatccaggaaaacatggcctcaacaaatgaactaaataagaccccagggaccaatcccagagagatagacagaattcaaaataattgttttgaggaaggtcaacaaaattcaagataacacagagaaataattgagaatcctatcagataaatgaagagactgaaataatttagaagaatcaaggataagttctagagttggaaaacgcaactgacatagtgaagaatgcattaacatctcttaacagcagaattaatcaagcagaataaagacttggtgaacttgaagacagcctatttgaaaattcacgatcagagaagacaatagaaaaaagaattttaaaaaatgaagcatgcctacaagatctagaaaataacatcaaaagtacaaatctaagagttgttggccttaaggaggaagtagagagagagatcagagtagaaagtttattcaaaagaataataacagagaacttcacaaacctagagaaagatgtcaatattcaagcataagaaggttataaacatcaagcagatttaaccccaaaaaagattatatgaagacatttaataattaaaattttaaaggtcaagctaaagaaaggatcgtaaaagcaggaagaggaaaaaagaaatacaaaaaacatacaatggagctcccacacatctggcagcagacttctcagtggaaactttacaggccaagaggagtgaatggcatgacatatttaaagtcctgaagggggaaaaacaaaacaaaacaaaacaaaacaaaacttgtatcctagaatagaattatccagggaaaatttcctacataaaggaaggaaaaatgaagaccttctcagataaacaaaagctgagggattatatcaacaccagaactctcctccaaaaatgctaaagggagttcttcaatctgaaagaaaataatgtgaatgagcaataagaaaccatctgagggcaaaaaattcactggtaatagtaaacacacagaaaacacagaatattataatactgtaattgtggtgtataaactattcatatcctgaaaaggaagactaaaacatgaacctatcaaaaataataactactgggctgggcgcagtggctcacgtctgtaatcccagcactttgggaggccaaggcaggaggatcacttgaggtcaggagttcaagaccatcctggccaacatggtgaaacttcgcctctactaaaaatacaaaaattaggcgggtgtggtggtgcatgcctgtaatcccagctactcaggagactgaggcacgagaagaacttgaacctgggaggcggaggttgcagtgagctgagatcgcaccactgcactctagcctgggtgacagagtaagactgtctcaaataaataaataaataaataaataaaataactacaaaaacctttcaagacatggatagtataataagatattaatagaaacagaaaaagtttaaaggcaaggggatgaatctaacatgtagagtttttattagttgtctctttgcttctttgttagtttgtttatgcagcctgtgttgtcatcagtttaaaatggtgggttatattatttgcaagtctcacggtaacctcaagacaaaaatcatacaacagatacacacaaaaaaatagcaagaaattaaaatatgctagcagagaaaatcacctccactaaaagaaagataagaaagaaggaaaaaaggaagagaagactacaaaacaaccattaaacaaataacaaagtggccagaacaaaattccttctttatcaataataacacagaatgtaaatgaaataactatccaatcaaaagacgtagagtgcctgcatagatttcaaaactagagccaataatgtcttgcctataagaaatacactttacctagaaagacacacatagacagatacaaagatggaaaaagatattccatgcaaatggaaaccagaaaagaggagtagctctacatagatcagacaaaatagatttcaagacaaaaaccataaagagacaaaaaaatcatataatgataaaggagtcaattcagcaagaggatataaaaattgtaaatataaatgcacccaacactgagcaaatattatcagagctacagagagagaccccaataaaataataaccggagacttcaatgccccactttctgcattggacagatcatccagacagaaaatcaacaaagaaataaacttaatctgcactatagatcaaataggcttaataaatacagagcattccattaaatggctgcagaatatacattcttctcagcacatggattattctcaaggatagaccatatgctaggtcacaaaacaagtcttggaaaattcaaaaaaactgagatagtatcaagtatcttctctgaccacagtggaataaaaactaggaatcaataaaaaggggaattttgaaaactctacaaacatatgaaaactaattaaataatatgctcctgaatatttcttactcaataaagaaattaagaaataaatgtaaaaatttcttgaaacaaaagaaaatgaaagcacaatatacccaaatctataggatacagtgaaagcaatattaagaggaaagctgataggtataagtgcctacataaaaaagtaaaacatttctaataaacctaacgatgcattgtaaagaactaaaaaaacaagagcaaatcaaacccaaaattaggagaagaaaataaataataaagaccagagcagtagtaaaggaatttgaaatttaaaaaaatacagaaatcaatgaaataaaatgttggttttttgaaaagataaacaaaatcaacacacttttaagccagaccaatgaacaacaaaagagagaagacccacataagtaaaatcagagacaaaaaaaggagacattacaactgctaccacagaaattcaaaggatcaccagtggctactataagcaactacacaccaatacaatacctggaagacaaagataacttctcagacacatacagcataccatgattgaaccctgaaagagtccaaaacccgaacagaccagtaacaagtaatgagattgaagctgtaacaaaaagtctcccaaaaaagaaacttagttccaggacttagtggattcactgctgaataattttattaaacatttaatgaagaactaatacctactgtaacaatttcaaaaaatagaagaggagggaataatactcactctgtgaggccagtactacccctgataccaaaacctgataaagacattcaaaaaaaaaaaaaaaaccacacaaaaaaactataggctagtgtctctgttgaatactgatgcaaaaacacacaacaaaatacagcaaaccaaattccacaacacattaaaaaaaccattcatcataagcaagagggatttatcccaggtatgcaagaatggttcaacattcataaatcaaccaatgtgatatgtcatatcagcagaatgaagaacagaaatcatataatctttgtaattgatgctgaaaaatctcttgataaaattcaacatcctttcatgatcaaaaccctaaaaatgatgggtatagaaggatcatatcttgacaaaataaaagccatacatcgcagacccacagctggtatcatactgaacaaggaaaagcagaaagtctttctctaagattagggaacaagacaaggatgcccacttttcactgctgttattcaacataatcctggaagtcctagctagaacaatcagacaagagaaagaaataaaaagcatccaaattggaatggaagaagtaaaattatctttgtttgcagatgatatgatagtatatttgaaaaacctaaggacaaaaaaaaacacacaactcttcgagctgataaacaaattcagttaagtttcagggtacaaaatcaacatacaaaaatcggtggcattctatatgccaacagtgaacaatcagaaaaagaaatttaaaaaaatcaatttacaatagcaacaaatgaaatgtaatacctaggaattaccttaaccaaagaagtgaaagaactctacaataaaaactataaaatattgattcaataaattgaagggggcacaaaaaaatgggaaatattccatgttcatggattggaagaatcaatattgttaaaatgtccatactacccaaagcaatctacagattcaatgcaatctttatcataatactaacaacattctttacagaaatagaaaaaaataatcctaaaatttataatttatattaaaccacacgcagacacacacacacacacacaccccagaatggccaaagctatcctgggcaaaaaaattaaaaactgagagaatcgcattacctgacttcaaattatactgtagagatatagtaaccaaaacaacatggtagtggcataaaaacagacatgcagaccaatgtatgaacagaatagagaacccagaaataaattcgtacctctacagagaactcattttcgacaaagtttccaagaacatacattggggaaaggagtctctttgataaatggtgcttggaaaactggatatccacatgcagaaaaatgaaactagacctctatctcttgtcatggacaaaaatcaaatcaaaatagattaaagacttaaatctaagacctcaaagtatgaaactactgaaatctggcaaaagatctgagtaggcatttctcagaagaagacttacaaatggcagacaggtatataaaaaggtgctcatcatcattgatcatcagagaaatgcaaatcaaagctatgatgggatatcatgtcactctagttaaaatggctgttatccaaaagacaggcaacttcaaagcctggcaaagatgtgaagaaagggaaaacttcaacactgttgataggagtgtgaattagtacacctatggaaaacagtatggaggttcctcaagaaactaaaaatagaatgaccatatgatccagcaatcccactgctaggtatatccaaaagaaaggaaataggtatatcaaagagatatttgcactcctatgtttaccacatcactattcacaataccaggatttggaaacaacctatccatcaaccgatgaatagataaagaagatatggtatatatgcccaatggaatattatccagccacagaaaagaatgagatcctgtcatctgcaacaacattgatagaactggaagatgttacgttaagtgaaataaaacaggcacagaaagacaagcatcatatgttcttatttgcaggagttaaaaattaaagcaattgcacacatggagttagagagtagaatgatgcttaccagaggccaggaaagggggacatggggagtagggttggttgatgggtacaaacatatagttagatagaatgtttcagatcaaacgtttgatagcccaacacagtgaacaataagctaatgtacattttaaattacctaaaagagtataattgaattgtttgtaacacaaagaaagggtaagtgtttgaggtaatggatacttcatttactctgatgtgattatttatcattatatgcctgtactaaaatatctcatgtggcagggcatggtggctcatgcccgtaatcttagcgctttgggaggctgaggcaggcagatcgcctgagctcaggagattgagaccagcctgcgcaacacagtgaaataccatctctactaaaatacaaaaaaattggctgggtgtggtggtgtgcacctgtagtccctgctacttgggaggctgaggctgcagaattgcctgaacccaggaggcagaggttgcagtgagccgagatcaagccaccgcatgccagcctgggcgacagagcgagactgtctcaaaaaaattaattaattaattaattaaataaaatatcatatgtaccccataaatatatatgcctaccacgtgcccacaaaacttaaaattaaaaaataataataataaaatgcaactctctttcaacagataaagtcttgagcctgaagctaatttgccctaattagatgagaaatactcttcaagcaatcccccaagaccagagtgactaaagatatttgattaggcaaagcaggaaccagcactaaaactagcagtgagattaatcctacagaaactttatggattgatgctcaggagctgtttgagggtacaccaagcatctttttaaaatatatctactgctgctactgttactgcttatggctaacactgagtgttgagtacataatatacactgccctagggctttacgtgcatctttccatttaatccttacacaattctatacagctccatatcctcattattacccctgttttacacataagaaaacaatctagaaagttaaaaaactttccaattttttcacaaaggaagtaagttacagggctatgattcaaacacagttttatttctaaagcttacattttaaattactacttaatattccctgattcactgatgactaaagaaatacaatctagaaactttggaaatatgactacttgttggcctaatgtggctaatgacaagatggaaaagaaaaatataaaatctggcatcatattcaaataatttaaccaaaggtcctcattagtgctgctctcaaaagctgagccttgcttttattttctaatgaaaaatgtttctagaaacatatatgctaattttccaattaaggttagccctggagctaaagtattaacattttccataagttataaactcttagaaaaaaaaccaacactatttactatgaatacattgtaagttaaaaatggatgcttactgttaatccttactgaaagtataactaataatctgttgtttctgaaaaaagacaacctaatcccaacaaaaaataacccatgtcacatgtttgcaagcgataattgccaggttcttgggttgacagaattccatattttctttctttttttaactgaaaaaatttccagttcatttaataaatatatatggggtgaaaaaagaaataggcaaaatagataatccttttccaagtgctataccccccaatttttttaaaggaatgtgacaaaggtcaaggaaatcacgagcatatgagaagaaaaaattatgtaaatgatctaaactgaatatttaacaatctacctgttgaacaagcccctaagatttggcctttgacttttctctatttaggcatcattaagttcaaattctatgattcatttgacattaatagttaaggttcttgtttctctctctctctcgtctttcacttttctgagacgtcactcacttgctgtcccaagaaagagttgtgaatatgcctcagatttcagaactttccatgagaaagtacgttgataaggaaactcaaattccagagtgggcaactgctttgtacctctactccagatatgcttgttttataaagcctgcgtatctttttaggatggaacagaattctttcactgagagattaactgtaaaaaccaggtggcttcccaggaagatatcatggctaatctttacctctcccttaccttttataaacagtatttagtacagaaagaaaaacatggcaatatcagctcttaaaactacagcaccatatcagcctcaatagggaagcatgaacactaagattcctcgagtaaactttacatgcttcagtagaatagaaacagactactcaaaagtgaactagtcactgaactggaaagtgtgtagggtcatactcaggaaaattattataaagcccattgagtccagacagccagtgaattattgccaaaattaaactgtatgatgcctctatcaaccgattcaactagacttcagcagatgtctgaacattggaattacagttttcagtgccatgagagatattaatctatattagatatgatccctaacctcaaggaatttgcatctgataagatataaaaagcattaagaacaaattctaacaaaagaaaggaaatacagagataaatgtcccatcaaagtataaaatgtggaagttatttggggctgcagaaattgggaaaatgtttactgggtcctaaatgatgggagaaatttggatatctatgatagtgaggaagtaaaagaaattagaggagggaataacaaccactttctcccatcatctaccttgtggacataaaatagtcctctccttatagttaccaatagcggccctttcatttttcttccttagagatcaccacccccaactcatgtttctcaataactcctgacacagcttttcaatataaaatcagtatcgtcatctcacaatcttaacattgtctgcttgcaccaaggcaatactttaagggagaaattcccaatggtgcagaggacatgcatcaatcaagcagtctctctttcatttttgttgttggtgttatcactgtaataaagccatcacaaacaaggtgataggctgccccggttttcaaagaattatgctttttatattatgttggaacactgtagtatggcacatccttaattgcaacagcaaataggagaagcaatattgattaaagaaatgaatattgaactagaagttgctttttcttaacctgcctcacaatgctgagtgacctcattttagtcacatgacttctctgtttcccaggcatacttttgtcactcagcaataatagagttattgcaaggctcaaatgtgacagtttatgtgaaagcacatgggaaaatatgagaagcattccaatggaaaggttttattgcacataaggccaagagcagtatggtattatgaaaagctcatggttgtggacgtgaagacctagatttcaactctagttctattagtcaccagagtgggcttatttaagtcaagcacctcactaagcctcagctcttcatcaatatctactggttcatttccatccctcctcacagagttgcggtgaaattaaatacaaatctaaaagtccttcagaaacaacaaaaactaaaagtacactgtattatttgcactagcacagccattaatattgttaccatgattctcatggttacagctactctgataagaacttataatattacttatttattagaatatagactgactaaaataagcgtctttatcactatttcagcttcaaatataattggtacaggttaaggccctgtttaaacaaaaaactgtgttcgcacaatttgactttagtttatcctttagttaaaaaaaattctcatttagttcataaactacctaattcagatttggacaataaatagtctaagtttataaaaagtaaacaaatcatcgctatagtttgaaaaaaataaaccttttaaaaacattataaccaatattaaccactaaaatgccagcgataagtgtgctaagcacatcaaactattcattaaaaaaggtccaatgtttgcctagttatgcgttctagacatgtttcaaattatacaaattgctttttttgaggaagggttttgctctattgcccaggctggagttcagtggcacaaacgtggcttactgcagcctcgatgtcctaagctgaagcaatcctctcacctcagcctcctatgtagctgggaacagaggtgcatgctaccatccccagctaatttttaaattttttgtagagacagattctcacctcttgtccaggttcaaactgcattatttttaagtgctattctcctagatgcgaatgtcaaggctcctaagttatacaaagcagtaagttatatttttatttcccaagtgctgatatgccagatattacacccataaatttcttttctttcattattttcttcttctgagctggggtaagaaaatagacggtagtcagatgagtgagggcgtgggactggaagcagagtcacaggtacgtatttatggactatggcattcacttcacttggacattggacacataaagaacttgtccaaaaagaggtgcagccattgcccttggtttctggaaggtaatttgtgttttcctgagagccttcggctaaatagagaataacactatgatttagggtaggggctttgggtcacacaatatctgtggagtcagaggctgggatcaagcacatgcgcaatgaatgaatcctgcctacgtaacagacgccaatgacatctcttgacatagaggctcaggtgagcttcctgcttggcgacacttcatgtgtattatcacatgttggtacctgaagagtaacatgtcctgactcaacaggaagacgacaatagaagctcagtatttggtacttctactgaatcctgctttaggtatttcttcccatggcagattttaatctgtccctctctcaaagataaactgtaaccgtgagtataaccatggttttcagtgaggtctgtgagtccttctggaaagttatcaatctaaagatgattctgtgaggccataaacttgcagttggtgccagaagtgagggtggtcttgaggactatgccctctaacttagtagttggcctaaactccttatgacagctaactaattatgattataagagcaaactataacaagataagaattgtatctatttcattcatctttatatgctcagtatgcagtctggtgcctgagatgtggtagactttcaatcagtatgtattgaacaaattttaggtttactgagattgctttgaggacaaaccagcatttgtgcagtggtttgtaagactaccaattaaactttgatcaatgtaatcatagttaattgtgcaacaattgtatgaaatttgttccgtctatacttgaaataggcaattcttcaaaattcaacaagtctttactgagaatcttcctttaccagggaatgtgtttaatgctgtggttgggccaaatatgtggcccagatggcccagatagcaaagatgaatacgatgtaattcctgcccaccagcaaaataaaagtcaagtgctcagatattacagcagaagtagcatctaattctcatagaggatggacaatggagacaggtgacatatcaggtaagatttgagctgagctttaaggaaaattatgaattacataggtacagaagagaaaaaggcaaatataacagtatcagtgatagcactttagtaagtcttatttttactctttacatattttatcacatgtatcattctatcaagttacctaaaatattatatcactagtgttctaaccacaatttgaaaatctagctttataatatcataccaaatgatgtttatctacatttgctttatttatacaaggttcagttcaaacaactcaaatataaaaagatgtgagtcaatttacagaggatggtcgagggcttacttgggttttgtctttcctgtataaaatgaaaatatacctctccttcaccactcccaaccgaaatgcctttaagcactgtgatcatttgagaaaatttaggtggtcttacaagttttgtcaaaaacttttaaaactcaaaaagaataaaacattaaaggatattacattttaaatcaaaactggttaaacagcaaaatttttaaaaggcactgtctatgtataaggtaaaatttgtagaaaaatctgtttcaacagattgtaacacagaatggtatttcctgaactatcgaaaaaggtgtttcagaaacataagtttccaacatgcttaaccttcttttgtttgagaaagagatgcattaagaactttttatttactctattttttaaatgttatttaataccattaaaattattttggtcttcctttctaaaaggcactgtgagattaaatttaatcaaggagttgaaaaacttgtatactgaaaactactaaacattgtcaaaagaaatcccatgtttatgaatcagaaaacctaatattcttcaaatgtccatactaccggagacaatctacatattcaatacaattcctatcaaaatctcaatgtcgttttttgcactaatagaaaactccattccaaaatttatataaaatctcaaggaacctcaaatagccaaaaccatcttaagaaaaaataaataaataaagctgtaggtcgcacaccttctgacttcaaaatgtagtggaaaactatggtaatcgaacagtatggtactggcacaaagagacacaaacaccaatggaacacaatagagaggcccagaaataaaccctttaatatgtggtcaaatcatcttcaacaagattacacaatggagaaaggttagcctctcaacaagtggtgttggaaaaactgtatatccacatgcaaaagaatgaaactggacccttaccttacaccacatgtaacattaattcaaaatggattacaaatctctgcataagaggaggctgaggcaggagaatcgcttgaacccaggaggtggagattgcagtgagctgagatcacaccactgcactccagcctggcaacaaagcaagactccatctcaagaaacaaaaaacaaaacaacaacaaacaaacaaacaaacaaaaaacctcctagaataaacataggaaaaaaccttcatgacactggatttggcaactatatcttggatatgacaccaaaacaataagcagcaaaagcaaaaatagacaaataggactacatgcaactttaaaaattctatgtatcaacagaaacaactaacagagtgagaaggtagcctacagaatgggagaaaatatttgcaaatcatatatctgataagggctttaatagccagaatctataaagaactcctacaactcagtaacaacaacaacacaaaacaactcaattaaaaagtaggcaaaggaattgaatagacatgtcaccaaagaagatttacaaatgactagcaggtatgttaaaagatgcccattactactagttattagagaaatgcaaatcaaaacaaaatgggttatcatctcacacctgttaggatggccactatcaaaagaaacaaaaagtatcaagtgttagcaaggatgtgaagaaattggaactttcgtgcactgttggtgggaaggtaaaatgatgctgctgatagggaaaacagtatggagttttctcaaaaaaaaaaaaaaaaaaaaacaaaaacaaaaacagaattaccatataatccaacaagatcttgacatttgtacgctcatgttcattgcagcagtaatctcatatccaagaggccaaagtaacctaaatgtccatcagtagatgaatagataaacagaatgcagaatgcgtataacatacaatggaatatttttaaacattaaaaagaaggaaatcctgtcatattctacaacacagatgaatgttgagaacattacgctaagtgaaataagccagttacaaaatgcacaaatactgcattttcccgcctatatgagatatctaaagtagtcaacctctttgtaactataagtaaaaaatagtggttgctaggggctgggggaggagaggaaagagagctattgttcaatgggtatacagaattttagttttccaggatggaataaagggtctgtagagattacctacaagggaaagaatattaaactgatgagaaacttctcataattaacaacagataccagaaaccaatgtaatattattttccaaatgctgagaaaaatattggtctactcagaattgtataactaccttaactgcaattcaagaatgaaagtgaaaggaagacattttcatggaaaccaaaagcaagttcaccatccgcacaccttcacacacaaaacaattaaaggtttagtttagaagaaaagtgaaatcagagaccaaatttgatatacacacacaaacaaaagttctatgcataaaattattcaaaacattcattaatttaacgattagctataacataactaattgtgcatatgattttattttaaagtgcaactaatcaaactggcagcaagaaaggttgtgatatttactagcaagaaaacactgtaacctccataagctgttggaaaggaagacagaaacactaaaaaatatttagcaaagtatgtcgtgatttatgtatgattaaaaaaaataagactaaccactacaggaataaaaatacagcctgaggttacaaacttgcagaagaatttaataaaataaaaaaatgtgaataaagcaacagaattttttaaaaaagaaaagagaaacaaaaggaaatttaaaaaaatacaaactattatggtaaaaacatatccagatacatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatactgcttgtgaatcttttgggttctaaattagcttatgtaggtcctcttagtttgcttcagcactctcctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagataccccaataggtttacaaaggtaaactccattacaaaagaaactccctcttttggctcaagattcccaccccctcgtaacctcagaactaagcaagaaggacagaaggaatgcatctctgaaaagcttcagaggatgaaaccacaacccagcaatccctccaaactccctccttcccttatacaattgtctcctgcttacaatactgttgtcaaactttctgtgtttttcttcttcatggacctttggggatcaattctagtctaataaactgaactctatagcttctgtggaattataacctgaattatgactttttaaatatacataatatagtctacatttagctgcttatttaatgactgattaaatctttaaagtaagactaactagaaatattcaaaataacatcctcttgccttttttaattttaattcttacatttaaaatagactcacaataactggacattaagaattgttagagctgtgacacactaagagagcccattattttgactgaaaatgtatttaattgttattttaagcagaaactttgaaaaaaggtatatgtacacatatagcatatttatagtgtaaatacaaaatatagtgtatattttgatctgaatattttcaggagtaaaaaaaataattgtaatacaaatgacagatgtattactaataagcaagtatgatgtacctgttggagctaaaggaaaattttcccttcactctctgtagcttaagtgaaaatcgatggacaaaaggctgattaagaggagaaaagaaatacaaatttattaatgtgcactggggagaattacagggtgattaccccaccatgcgaaatgtggtacacatggttatatacccttctttttagaggaaagggagatggggatgtgtggatgattttacagcgacagcaaatgattttgggggggagttcaatgaacttaaagaacatacaatgagctgggacaaagtcttttgggtctgcagagtaaaccatggtttgtgacaaaatgctgtctaggtgtattgatggacttctgtctttcttcctgtgatacgagttcagttaatgaaaactcagggaagagaccaaaggtaattgttttcttctttggcaggtccgagcttaggcagataagggaactccagagaacaacttcatcctgtgctttgggagagacaggattaagacacaggaggcagacggagttcagaggagacttgaggctgcttcttctgtgcagcatgtaaaaacaccatatttgagagtatcaatttctgagctccaaggtaccagagttttgtttaattgaacattggaagagcctaatgaaaattagtcaataactaatttagaatccagcagacatatggaaacttccaaaataaccttgtgctatttactgagatcataaaaagtaagggtggaaatctgtaatcatgattttcaaggaatttttttcatgaactacaaatagccaactctcttacaagaaagcggaaatacacacatatacacacacaccccattcagtgcagccacattctctcaacgcataaattattatcctgagagtgagacaagcatcataattgtgtttgctactttaaaatatgtcagtgctgataatgtagccactgatggctacctaattttgccagtttgggatttgaaagacatgatacaacattgtgtccaacatgctcatttgaaaagtccaaaattaagccaatgaaggtagataatttgcccaaagggatatcaagatagtaaatgaaatgcaaataaaactcaaatatccttgctcgtaatccagagctcattccataaattcatattgcctttaaattaaagttattctgagaatctgacatattagataaaacatagacctactaaatacaaacaaagccacaatctttcacaaattatgaacgtttttttctccatggtaggacagagactatttccagacaaattgaagaattttcctccctgagccatcctccatgcttaaaggagagataacaagagaaaagaaaaatgtcttgctctttgaattaaacagaaaggtaaaattccaaaaggagagtatcctgcagaaatggaagctagacacaaagaatttatatcgcatggagagtaactgcaatatactcattcaacaagacatggtccttaacactctaaattacaaaacctcaaaataatcccgaaaaacaggatcacaaaatataaaatgacttcaacttccaattttcttgcctaacatgatggttactccattacctctcagtggtagttcacacacatacacacaaatacacactacaatgtacttactgaactgtagagatagccttcaccattcatggccacatagaggctagccttcactccttggatggccactacacgcaggcccacgggaattagattgaagagagctggggggagaaaaagaagggcggaaaggatcagtgaccttttgaataaataatccttcttataatcattcttttgagaattaaaacctattaattgaacttggtagaaaaatggagagagaaataaagagaggtctaaaaacgagagaaattgacttcttgaccctgcaccagcattaattacctatgtaacttcaggtaaattacataaactctgtactaaaggggttggattagaaggtctctaaaggcccagctggatctgagatttcaggatccctgatccttaaaatgatcctcaaacagtgtaatataagataattttttctaacaaacaaataatatggaccgaaaaattctcaacaggagaaaacctatctgtagtcacaagaaataacaaaatactatctttaaaacaggccaaagcttcttgtttttagtattttccttgttgttccaaacattatattgaacacagaagaagaatgcaaaaattactgacttattggtgataacattcagacaaaacttttttcttgatatctcaattttttacatgtaaataaacagagataaacagatggacagatgattgatagatagcttaagctgtaatggatatattttatatccaggtgggaaatacacacacacacacacacacacacacacatatacacacatatatacatactatatatatacaaatatatatacacatatatatatgcacacacacacacatatactcaaaaccattaagaattaatttgacaaaagtaattcaacatcctaagatgaaatggaaacatgcttgcagtctttacatattcgagttgctcatcactcaaaatactcaatagtctatatgtccacttagagaaggaattcgtagatcagaaaaaaagatacctaagagaaccttctatttttcttccaacaatatttttctgtccttgggattatttcagttacttttgagatcacgaaatgagcataaacagaaaacactgcccccaccctgaaacaattcacattgcatatggaagaaaagcaatcatatagttaggctctatagatggcaacatggagatgaattaagtatctcacggctgtatgcataagagaatatctctgcagttcatttcagtatcctggcttaattagaagttcttatccactttttctgttgataaaattcctatcagttctcgtcttcttagtttttaatacaagatacacataaattaacccaagggctaccattatttagggatgcctctatttttctcggcttctctcaacctacaatagtaagctaaacacacacacatgcagacacacacactcacagtatttggctttcagtcaaatgttcaattgacagttgtagaggatcaagtcttagaccacaagtttagtagaacaggattccattcttagctgtcgacatcggatcagtccttttgcctctttgaatccatttccacattttttacgaaaactgagactagataagaaactgtaagtagtttcttatagattaattgttggctcaatttagatttgaactggttttatttcttgctatattcttaccagtgtccttgtgttactgaaacaacttaagaaatacaagaactagacaaagtctagttggggagaaaaagctaagacatatggaataatatgatacagtgtataatttacttctataattaaatgtaatatatgcattctatatatatattccctatgttacagaagttcaggaaaatggaagctctgtgtggcctgaagtattcatggaatgccttacacagaaaatggaacctgagttgacacctaaagaagcggaagttgagaaagccaagaacagaaaacattttagtgaggtggaagttaggtggttttgcagagtaatgtgtgtatgcagaaagggactggcagattggtggatttgatttatattggggggaaatgagaaagaacagcatgtaaataaaataaggataaataaccgagtctgtcactctaatcttagatatctggactttaccaaataggcaacaagacgtgtgacatatgaaaactagagcaacaacacagattatgagatttgcagacacatagtttctaaaccctccactcagtcacttggctttgagctattcatttaacttctctgccttagttttcctatctgtaaaatggacatgataatgcttattgcacagagttgatagaaccaaatgcattgtcatgtttctgaaagtgattcacagagatgtatcctctctaagagctatttgtcatgaatacctaattcttctgtttgtcagataaagttaccataagactattgtaaaaactgacatattacctcagtaatattttttagtttatattcagcagattgctttaaagctttaaaatctaataccttatatttgtgcaagattaattttcaaagtgctgatacattcattaattgtatttgatcctcaaccataaatgctatgaagaatttaggacagaatgattaccttaatttatagaagtacaaaaagatttagagttaacccaggggaaaatgcatctaaacaaaggctttcaggctccctaatgtggttacctgttcaaaacatcatatttcatctttttgttctttatttttcttttttgacagagtctagctctgtcatccagctggagtgcaagcaattctcctgcctcagcctccagagtagctgctattataggcgcctgccaccacaacccagctaatttttgtatttttagtagagacggggtttcactgtgttggccaggctggtctcgaactcctgaccttgtgatccacctgtctcggcctcccctttttgttcttttaatttcctctaatatccatttttgccttcttgcaaataaatagattattcagctacaccttctaacatatcctgcaaccagatgtaggtcctatggacccactactggccaatgagatgtaagtcatcacatcattataagcttgaggaatccttccttaaagacagcataaaggtgtcctttgtgccccttctcaacctttgcctattgctgtttgaatggggatatggtagctggatcatctcaaaccaaaaaaacaaggactactccccagcgggtgttggcaggtgagctggaaggagctgggtccctgagagctttgtggagcagtggcacaagtccaacattcaattacccaggtctggcttttacgtgagaaaataagtccttgttctcttagtctgtgcgatgcagagccaactctaatcctaactgatagagatgctaatgaaagcagaattaatatgcaagatatgaactagatgcaaggtacttcattttaaataaaagcagatactggaaaacgattaagttcactgataattactgtgagaaggagaaaagacttcccaggataaatgctaagaacactggtttatgtagctgaccatagaaggaaaagcaactataaagtttttcctacatggaatgagagaaaactgataatgctaggcagggacaaaaacaagaaacctgtttgaaagttttatatgaaccacaacatgataatggcctttagctggtttgctttgtgagacttactaagcccatttttaaaaatcagtaaacgatttgaaacgagactttattggtaaaagctaaacatagtttctctggaaaggtcctcatctgcctcctaaaagtcccaaaaggtggcaaatgacttactgttatctattaattatcttcagagtagcatactgtggctccagctcacaggagccctttgctactcctttcactactcctcaaagccactgtcctaactcatagtaactgggctgcttgactccacccactctttaagtcccttgcatcctcttaagccattttcctgcttacaacctgcagtgattcctccctgtctccaatgtcctttacaacctggctccaacccacatttccagcttatcacctgtcaccctttccatctgctgtaaccggcttcacagagctttttgccatttcctaagttccccctcgatctttaactaggctggagtttgtcctcttttgtcctctatctctttttggaaagcttatcttcccacttctaaatttggccaactcttttcatcatttaaggcctaccttgttgaactcccccatgaatcttgcccaaaacccttcagaaataatacttcccttttccagatggcttatttcttgtgtatatttcggtaatgatatttagaacatggttttagagttctttgtttatatctctgtctccatccctacaatgcaagactcttgagggtagttgctgtaatgtctagcccaggtacatgtacacagctttattaaataaatgttattatatgggttatgacaaaaacacgttatttccaggaatgtaggttttcttgttagaatgaaagttctttttaagataaaaatgaaattagaaacttaaagcatctcagcctgatactcaaagttaatctacaacatacatttgtgctacatggcactttcactccaatactgagtgcttctagtaatttgatcttcctcctcctaccttctaaactccatctttttgctaacttagctccctctgcttggaatgtcactctccctacatcttcacactgaaatccctgacatgcgtgaaatgacacaccaaatgccaagtgctttctttcacttcttagctgccctattcctggatccagactatatttatcacaatttatagttttattcttctaaaaaatctgtttcctctgccaaccacaaccagattgtaagctctccaaaacaaaactcacatcaaaactacacttgtataatacaaggaagggaggagacagatagagacagagaaaacaagagggagaatatgcagggtagtatatattctgtgtatattagcaatcccagtaaacatttgcagactaaataatactacaattatatgccaaatagagtccaagtatttaatctgacattcaaagatcttcttaaacttgtcctttccaaaaggagtatcttgttctacatctttttgtaaagttgactcttgtattttgaaaaatgaaataatggagctggtactcttggcttccataaaccaagctcattcataaaacttcacagaaaaaaggtaatggaaaaggtaatgaagagaaagtatagtctcttcaacaaatgatgctgaaaaaactgggtattcacacatgaaagaatgaaattgggcccttatgttataccatacataaaattcattcaaaatggattaaataattaaatgtgagacctaaaactgtaaaacccataggaaaaaaacataggggaaaaagtcaacattggccttagcaatgatttatttcttggataacgaaaagcacaggcaaatgaaagcaaaaactagacaagtgggattacattaaactaaaaagcttctgcagagcaaaggaaacaatcaacagaatgaaaaggcaacttatggaatgggagaaaatatttgcaaattgtatatctggtgggggttcaatatccagaatacataagaaactcctatgactcaaaaggaaaaacaaaacaaataagccaattaaaaaatggacacagggcttgaacagacatttctcaagaacaacaaacaaatggccaacaggtatatgaaaatatactcaacatcactaatcatcagataattatgagctgttaacctaaaataaacacttccaagttataaaatattaaaggatcactttgattaatcatgctacaggaaagactgaattatatttctctctacaagaaatgtataataaaattgttgtcatatggaaagacattcaaaaattatatatccataataatgggaaggaaatttatagacttgctgctatcaggcaattaattaaaatgttgtattattttcctgagttgtatcatctttgatagttctcagcttttcaaaatttaaactgttgtggtatattttctcagtctaaatactcaattttgcatctaattttcatttcattatatttattttttcgagggagaaccccacataagataagctttaggacctacaaaacctaaatcattctcatattgaaatttaagtggaaggagaagatgagagaaagtaacaaatgagaaaagaaaaactaaatagataatattcattgactgtctattttttcaggcatcctgctaggtaggcattttgatatgcgaaatgtcattttattataaactcagtatttgactacttaaaatagcttcattgaacagtatataaaagtcctaacttctttgaggggtacaaagtgaaaaaaattgagaaaatgtaaagcaccatcctaacatttggagttaacatacagcacttgtaaaaacctgacttagaagtcatttattcttaccataaatatttgttaggacttactgtatgccaaataccatgcctaggctaaaaaaagagtgacgaacataacagttgtggtctctagtgaaaagacttttatctgtgaatctttccgaggtttccactactttaagggcaagttgaaggtaccagaaacttttattatgatccccaatgcctagcatgatatcttggttttagaagctgttattcaatatctgctgaataaataaatgaattaggagtagtttctccttacacatgtttattcataacttttctcagtcatatttttataattaagcatgtaagaaaaaaatggaagataatatgtattacacatagactaaaggaaagccaaaaaacctacatggtacaaagtctgaaatggcagaatcatgggatgcataggcctggtaagggtaggagtatgtgtgtgtgtagagtgatgcaaggttggagggaattaagaggaaggaaagagtttggggaatctgttacaattgagatattaaacatcttgtcagcaaggcgtggtggctcatgcctgtaatctcagcactttgggaggctaaggcaggagaatcacttgagcccaggagtttgcgactagcctgggaaacacagggagactccatctctgtaaaaataaaaacaaaaataatttagtcaggtatgtgtgtgtgcctgtggtcccagctacttgggaggctgaggtcggaggatagcctgcacccaggaattcaaggctgcagttaagccatgattgcaccactccactcctgcctgggtaacggggcagggcatgcctctgtctcaacaaaataaaataaaaaataaacatcctgtccaatgatactgcaccaaaaaatgtactttctaaaagtgctatgttttactcagcttaatttctacctgtacacaccatattattccagtaagaaaaaggtaacagtcaatccaaaacacataggaaaacaatgtgacaaccaagaaagtttcaaagaaagagaagaagaggaagagagggagagagggagagagggaggaagaagggagggaaggaaggagaaaaaaaagctcattacaaattgtctttggaacatgtaaatccagtatctttccaagtaacttctaaggacagactcattgcttgtaacgaagaaaggtataaaagagtacagttgtatttagaaattctagatctattttgtcaaatggccaataaaaaagattcatcctgtgacccattaaaaacccatgtggaacatactgagagagaatggagatatttgggtttataatctgtgcattttcaatgttagatttccttgaaaattcaatatcatttcccacatctcaaaatgttctcaatcaagatattttattagagtgtgaataagatcatatcctacaaaatcttaaataaaaagttaagttagtaccaggttattttctcctacaataaatcctatagtctctcacaataatatctataattataatattcataatatttgcaggccactcaattggtttttcctcagttatgaaattaatatttacttctgttatttataatttacttaagtcaattattcaccctccccattctcaacaggaaaatgctattattgaatatacagcaaaggagtgagctcttaaatcttccaatacaaaagtggttatataaattatggtacaatggaatgttcacccaggcaaattaattattcattcccttaccctaattccacagcattccatacatagcacttatcacagtgcttattaatatttatatgtttgtctgagtttccctgaaaactagggattcatagaatataacatgtttttgttgttgttttgcatccagattgcatttcaaaataaagcctaaacaattgttgttactgaatttaaccctctaaaacagcatttcttacagacattaaaggaaagatgtaacttgccgtattcttttagcttttaagtcaaggaaataagtggtcttggtgactccaagtaatttaatgaggttgcaattttttgaatttctgcaatcagaccttggcgatgactttgagcagtaggatataaataactcccacatgcgtagtgttccaataatggaacactaggcataaatgagttaaccactttgagtatttcttggctctgaatgcttcactggattgttatgaagatcaatgagataataaaaacaagccactttttaaaccataaaggatacaaagcatcactatcagtgttgtcagtgtttttgttctcattgttgttttcatatctccacatctggagttttcatagtaggaggaacatggctgggtggtcattattccatagttcaacttaaattttttaaaatgttatgggagaaaaaaaaaagcatgtattccatcttctattattgaagttcccataagcaaaacaactatgtggttaaaataaaacactgttaagaatgtaaacatcaacatactttaagttatattggttcactgctttaagtatgatgtcctattttataagcaattggccaaatagtccaactgactgatttattttctcactgaatttatcgacttacagagctgactagtggtttgggacttcagagactaaaatttttcttctaagcattggctgacagcatacactgtgggttttcagcataacaaaaatgagcagcattgtgatctctttatttgataaggtagtagaaatatttgccttagctctggtaaaagtcctgtcattgacttttaatcctgataatatcatataacctttcctatgatagttcaaaaatgttcaaaaatttgcataattaacaagtcaattaaacgtgattattttttcattaagatgaaaaatgaggcatatcactattgataatgaaagcaaatgcctgtcattactcattctctggagccatttgtcttacacagacttgtcttggagcccgtctggtctgaagaattcagtgaacagcacaggtgacggtccataagatcaatgggcagaaacatcttccaagaaatctttgcatgttttgaagcttttagatttgcatcctctataaacctttcatcaaaaactatgttgccaaaatcaatactatggcctactaggtttattcattaattcatcacatatattccagacattgtgccaggcacttgcaatacagtggtagaaaggacagagatggtacctgccatcatagtagttaaagtctaaaatagataaaagtaaccacatgtgtaatatgtatccatctttacagaccaggaaactgatactcaaagatactgttttcccaaggttataaagtcagctagtgaaaaagctaagctgtgaacctagattctggtggctacaaagctgtaaaatattgttgctcttaagatataacataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggggaatggcgtgaacccgggaggcggagcttgcagtgagccgagatcgcgccactgcactccagcctgggcgacagagcgagactccgtctcaaaaaaaaaaaaaaaaaagatataacataaaattctaatgataacaattcaagtagttgtgaagaaagtaggaaaaacagactataataagaaaatgtgaaaaccttacaaggaatgttttagccaagtagaaccatcctgctcaaaaggtaaaaaatctttagtttttcttagataaaattacacacaggcaacacaagcacacttatttgagttgatttagatatgctcaaagctttgcacgttgttatcattaatacctaaataagaaaatatgactgcctaattccaaaaatattaagtggatctatagaaataaacataatgtggaaagattttttttttttagaaattagggataaaaaaggacttgaaaaataaaatgattattttgtccttactattctctacttcaaaatctctcattcaatccatgtctactataaactccagttagaaaatttttctaaagtattgcattttactcattgctcaataactttcattggttccccatttcctacaacataaagcttacactcccttaagtgtcagttaagacactctaaaatatggccccatgatacttccaaataatctctttgcttcatgcaagctagtgggttaatttttcccttacatggtgggagctttctccacttcctgattttgtgcctccttacctgaaatacaactgtcctaatcttaatttatttattttgttcccattcttcaagaattgggttaaaaccaaacttgttgatcactatggcttttgaggatctgttagatctctgaaatctggtgattcttctaatcacttggtagtaccagtgacaccttttgttttacattaaaatgtaaaaccttttatgctctgggaaaagctagaaggcaggaattgtatcagattcatttttgtaatccagtaactagaacgcagttggccttcaatatgttggtattaatgaaaataaagcatgcatatggcaggcatatgtgaaaactcaatcattttgtggtagctgcctgaaacaatgtcttaaggagacatttgaagccaggcaacaatgaatgttgtgagaatttagtgatgtctgcagtgaacacaggaaggggtacttcagccattgatttgtcatttcccacttgagggcctccttttataataaaatagcatgaaacattccataaaaacagcgatgatttgcaccgtactttaaaatcaatatcttattgtataactttgactcaaagttataataatacaaatttggaatgcaaactttaaaaattgaagaaaaaaaccaactctccagaggtaatttagcttaatggttcacagactttgctgcatattaaaaccttctgaaaagtttgaaaattctgatgtccagactacactcataataattaaataaaattgcctggaattgaagacaagtactttttaactccccagattattccagtatgcttcattgttgaaaacaatttaatattcaatagtctgggatagttctagcaagctcacatgcgatactgattcttcccaaatcttaccagtcaatgaaccaaaccttgctgctcaaagtgtgaacagcatcaccatcatctggagcttgttggaaaggcagaatctcaggctgtatccaagaattattgaatcaaaatttgcattttaacacaattacaatgcagttaaagttttgagaagtgctgtgtgcttggttctcaaagtgtggtcctcctgcagacttcctgattcaaaaacaaagattttggagccattgttgagaacctggatctatgaggagcggctgctgtcttcctttacgtctcagtagggcttttctgcccagatcatcagtgtcaaagactgggaagagaccatatgtaactgtatattccaaccccttcagagggaaactccaagtgcactagatgttaatcttatctaaattagacttcgatcaattcttccaaagaaaagaaggttggtctaaggcctaaaagagtgctgaaactacagatgtggttcaaaaatggcttcttacccaatttgtcaaagctctgctcaagtccttcattttttctgaaatggctcttgatcactcttcagtcagcattgatttcccctgttgagactttccaaggcacttccttccataagagtacattttgatattattaacttaaatctcctacatattattcccattttgcggatgaggaactctggtttcaaagtgttaaactaattgcccaagtttatccagctggcaagtggagatactcatattaatatccatgattgtctgtccctaaaatcaaatggactatttataacactatcctgcttcctcaagtatgggaaatgatccctggtatatactatagaaacaataaaagtgatgttttctgctcgtacctaagtaggaaggagcaaggagttctctttaggatatttgtaaaaattcaactgtaatactgtggagtgggcttaataatgctgtgcatacatagtctcacataggtatgtgttccagattcggtctcaatgtcaagggaagcagatgtactaagtgcaacctcgctagatcttggctggatgcctgttcagtaccactctatctaggctgctgaataatacatgaaaatatatatccacataaagacacacacatcctacacacctcaaacttctcaaatcagatatatgaaataggcaaccaggttatttaaaatctttaaaattattgtataatggtttattatctctaaaaaatgttttaatatatattttaaatacgtcaaacacattgaagaaaaatccttgcaagttcactgtttagcctgtctaaagtaaacctccataatattttagaactaaaccacgttgccttcttaatgccttttgaaagtgttgtcagaagaatgcagaggtatgatttaagagattgtttattatacactgggaaatattaaccaggaaagataaattcgagatacagtgtaaactgggtgaaggtattaacattggaactaaacttgctgaattcaaatcctgggtctattatttaatatctttaaggccatggactaattatttaaccttcctgtgcctcaatttactcatcttcaaaatagaaatgattacagtaccttttatagggttatcacaagacttaactgagtacaattttgaaaattttcatagctgtactgaacatttagaaggtgttcagtaaacagttactattatctgatatgtccccaagtcatagattaagaaataatgcttgacacgtaggtgaccattttattttccaaatccttcattccaaatatgtagttcttctttatgcttcatggtagtatgccctagaaaatgctaatccatatgagtatacatttataatttataccttatttagctggtggctaaaaacagtgcttaatcaaaccagagacatataagaaactacactgcaattcattaagaatatggacaaatctatacaaccttgcaatcagtaacttatgttgaagacggagcacaggatatggatatagtagaaatgaattctacttactgtacttagagcaaatcaactctcacttcagagcctcaaagtaaggtaatgaatttcaggaattttaaagtgatctctaattctcactcatcaaaattttaatacccttttccactacttcaagaaaccctctctttttagtttcttattcttaaaacacctgagtgtgtattttctttttcctgcaacatatgtttaaatttatactgctgcccttagatgaataataaaagcaatgactctctctcttatgggcaaatataccatttgcttattttaagaaaatgatgtctctataattgtcaacatgaatatatatattcatgtaacactttgagaatatatgtaacactgcgaaagtgtcttcttttactattattgctatagaattcacttttccagactaagcatactcaattttcttcctattttcaaaatggaaataatttccttactcatcccttgaattctcttaaatcatctgtcattctcaagacaaaatgcaagcatggtcccattagcattaatttttcaagctgggcattgtcacgcaaagtcatattcatttttgatggggttgttctgtgaattcactttcattcatttattcaacaaatactgaatacctaatatgtgccaggtattcttttaggtgctggagacatagcagtacaaaatgcagataaagctcattgcccccatgaagcttatattctaattaaatcttttggtttcaatggtataatgattatactattgctactatcaatgaacttatccatatccattatcaaggcgttactcattattaagaatttattacaggccaacacagagataaagcaggtattgtcaatgcccttaagtagttcataaccaaaaagaagtcagccagtcatatacacaataaatacatacagatgaaacagcataaaatcataagagatgtacagtttgttcagagaaaaagtagaatgtacagttaaatcagaaacaggcttcaaagacaaaaggcttttagaggatggcataattagtgaaagaaataacataagcaagtataggatagaataaaaaaagtatggtatatataagtaatattttagtagtaagaagacataataaaacaagtaggtatattagatagtggtaagggttctaaagatgaaaacaaaattcaagtaggcaaaggagactgaaatattgaggatagggactgagatgtatatagattaactagaaaagatctttttgagaaaaggcttcccttttgagtggagtatgaagattatgagggattgagctatttagatatttggaaggacattccagaaagagggggatagctggtcccaatgccttcaggcaagaacatggttggtgtgtttgaggaacagcaagatggccagtggaaagaaagaggagagataatatgtgaggagggatgaaggagacaacgggtgagattatataaaacgttattggtcataggaaaaaggtcattggcttttaccccgaatgatatgtgatgaaagggattgagcaaagaagtgagtttatttcgttttatcttttaactgggtcactctggctgctgtgtggaaaataggctgatgcggggaagctttaagtaaagagaccagttagagagttattgcaagagtccatacaaagaggatagtagcttggactagggagtggcaataggggtattgagaattgctggaaatctgtatatgtatacactgaaagtagcagtgaattcactactgtgttccaattcaatgcaaaagctattgtactatttgctcttacaattttgccttcttttgtaatgtgtttaaaataaaaagtttcccatttttcaaaggtgaaaacaaaaatcattgtcatcttgtaggcttgcaaaatttcagatctatcagagatactggatattatcttttctaaacgcttcattttacagagtagaaaacaaaggattcattcctcagaggagaaatgaggggtgggggaagtaaaccaaggaacagaaagtttgtgggacttaaataagttcactcagctatttagagaaagaacctggactggaaaccaggctgtctgactcacagcccaagctactttgtcttacaatcggtgatatttaaggggtttgtactgttcgtttaaagttctgttctgttattttgatttaacaaacattgagtgaaagccacaggtatctcaaactgaaaagtcttcaggccctaggcaggtaggaagaaaatgtggggaaaaaagtagatgcatctgttgcttacatacaatcattcccccttcccaagcatgccagctaaatgaaacacatttgtagctctttggattttggaaaatctccattgcttggctaagcagaagggcaaataaggaagtcatactctaatagggaaaacacaaaagcagataaggaattgcagtatataatgtgacttgcgcagctgtaaacaaatgcataaccctcaaatacagcagagtgaagtgagtgagcgtggggttctgtatgggggtgacagttgagacaagatggctaaagaagacctcacatggacaaaagaaacaagagttgaggagggttttgaagggtgagagtggcttgcctcctggataagattggcaaagacatcgcaagcaaaataaatttgcatatgtaaaagctccaagacatacaaatctgtgatacaggcttacctatatcactacatatttttcatatttttttcttttttttttgtaatcctccaaacttatatttgatcatatatctgtccagaattgagccttgactctcttcaagtaattaatcaaaatgtaacagatttcacacattgtttaagatgatagaaagtttgaatttcagtgtctacagacctctgctttccctattatattaggagtcagatccccatagaaataggcttcacagtcccagaacagagattgctttcattagcaaatgtgagcacttcaaatcctgggggcagaggaaagatgccagttgtacttgctgcagtgcatcagaataatctggatggcttgtcaaaacacagattgctgggccccagcctcacagtctctgattcagcatgtctgaagtgatgctggaaaatgtgtatttctaacaagttctcagatacatagatgctgctggtctagggactagacattttatgaatcactgacttattcttcaatacccaccagtgtaaacaccttcaaattcttccatataataatagctgccactgctaagaattctatttctgttaaaatggtcactgtgtatgagctccttgaaaacaaggggtctctcatccctgttgatgaaaataatgacagcagatgacatttattaagaattactgtgttctaggtacttttaaggaatcaaaccatttaaactacacaacagccctatgatctaaatattattattattgtcatttaacaaatgaggaaatttaacagagaggggttaaataactaattcaagggcaaagaatctcaagtcagattacttggacccaaattctggttttagcatttatgtatttaactctctagatctttaaacacactttgagactatcacacagggatttgcaaactgatgatttcctgcctgctggtaacatatctttcagaacaaagggtatttagggaaatggaggctgtcaatcagtttttctgagcatacctttacttctatatcagaagtaaataaaagactatcaaaatcttagtgattcttggctcctctaatgttgtactatctgaatttgtataaatcagagaatgtttatgtgacttgcccacggccaaagcactagtcatcacacagagccaaaaacagatcaaagacaacctcagtcctcagctctttctaggaatacacttggttaaggagctccaataagatttttaaatactatgtattctgcctagaaatatgcccataaaaagtcacagagtaaataagaaagaatatcatttcaaatgactcgttttgctttactgaccagaaagatacatgggagcagaagtctttttttttttttttttttttgagatggagtctcgctctgtcacccaggctggagtgcagtggcacgatcccagctcactgcaacctctgcctcctggattcaagccattctcctgcctcagcctcccgagtagccaggactacaggcgcccgccaccacacccgcctaattttttatatttttagtagagacggggtttcactgtgttagccaggatggtctcgatcacctgaccttgtgatccgccagcctcggcctcccagagtgctgggattacaggcatgagccactgtgcccggctgggagcagaagtcttatgatcaaaaatatatataagatcaagaagaaagtgaggagccaaggctgaagaatctggaggagttatccccttatgattttatgtaagggggtaagccattcaagaaaataactagtgtttgctaaaattttccacaaatattatttggaggcactatctttaaaattaaaacacagtcaatgaaaacaaatttctaacaaatttagaacatctgtttaattttttgtagtacctgcatgcccttgtgataagaaatagatttccttcataattttcctcagctaaccatttggatcatacttctgttcatagtttagcaataaaagcttctgctgactttggctgtgtctatatacttgtgactggtggtatcaaaacatcatatgtttggtattgtatagaaaacataacgagtgactaaacttttacatttccaattggttttctgaaaatcagacacagaacattttgaaatgtttgttgttgctaaactcacagtgaatttagtacgttcataaaatctaatgaaagtgtatttgtattcataactgataagaacataaagtattagaagtctagactgagagaatcttaagaaataaattccagattaactaaatatcaaatataagaaaagaaagaatacgttacaaaaaacaaaacataggagactttttaaataattttggataaataaaggctttttaaattggaaagaaaagctgacggcagaaaagcacatttaaaataaacaaaaaagaataaagcatggcaaaaaaaaatatcggaggcaacagaattagaaaaaaaaggtaaatcacaacaaagaactgattttttaaatacagatttcctaaaaataagaaaagacatttcatagaatcagatatagacagacagttcatagaaaaggaagtaaagatcacccttaaacaagtgttcaacctaactcataatttaaaaaaaattaaaatttacattttaaggtaacaaagaaccaagttttttgtttgcttgtttgtttgtttttagttttcgagacagagtctcgctgtgtcacccaggctggaatacagtggcacaatctctgctcactgcaacctccacctccctggttcaagcaattcacgtgcctcaggcttccgagtagctggaattacaggcatgcaccaccgtgcctggctaatttttcttgtatttttagtagagacgggttttcaccatgctggccatagctggtctagagctcccagtgtcaggtgatccacccacctctgcctcccaaagtgctgggattacaggcgtcagccactgcaaccaactaaaaccaaaagtttgataacacattttgttgactagatgataaggaaacacaattttagagtaaatttgcataatggagagcaattaggtgacatctttcagaatgaagaaagcacatacccttgacccagcaattctacttctaggtaactatcctataaatacatttgcatatatgaaaaatgacttatataggaggatattctttataggattgtttgtattagcaaaatacctaataggaaattaagtatttaaattatccatttaaatatgtattatatgaaaaaatcttgcagatatacattttaagttaaaagaaggtgctgatagatcaatatagtagatagataaagacagatggatggatggatagatattgtacatgttgataagtgcatagactatatcaggaaaatatcaagaatgtgcccaggtggcaatggagggtgtgaatgaaaattgcttttgactgtgtcaatgacttccaatgaatatcataaacacacccaaggttgaacaaagtttgttttaataacactcggcaaggaggaaaaatacacaccagagcagaactggggtttcttggtaagaggatgtaagaaaagatttacaggatttgggtgtgtgtcaagtggttttaaggagggctcaaagatatgtgaatctgccccagattggatgctctaaggatgtgggtgtaattctatggctactatcttagtaattcttttctagaaggcaagaagaacagagcaaggttaaagctgtgtttggtaaagaagcagcagccacccacataatctaggacagagacatatttgttcattttgtaatttaggaaacatttttgttttcgtcgtgttcagacatgattacagggtcttgcttttatcttgacccatcatgtctcagtggctttgtctaattgcaaatgtgaaattgtctatattcaacagaaggagaccaagtcttcttgggagtgtcaagccacctgctggctgtcagggactgttttgctatttctcaactatacgcccttttgtgcctttataatttggtgccacatacttatcttacctattcaaaataatttttaaaagaatatcaggactaaatgagaccttaaaagtcactgagttctgaaaccatgcccctcccaccaccactctgcttcctcctcccacaccaagggggttttcttgtaaacctctccctttgcctcaagtgccaggacagcatctgcttcagtatctccagtctttccaccgtactaacttgtcaggcagcccattccatatcaaatgctcttaatattttattgttcagaggtaaagagaacaatacctttggttataatatctttgttgttttctccctagcgtttttgacctcttcaaatgtatcttgtcctatggtaactcaggaaacaaaataattagctttttaattttatgtaaaatattcctattaataccctccaaactgccattgtcttttttgttccagtgttccaacacagttttgtgctttttatcattacatttgcagagattcttatctgttcctgccgacaaatccatttgtgttttgtactcaattacatataattagtcttttcttcatgaacaaaagaacaggtgtctttatcaattctgtgaaatataccatggtaaggttggttagacctaatgatgtctagtgaaccaaacaacacatttctgacagatgctcatagtaacaagattcttttttcaaacaatcaactgcttctactcctacacacacaaagtagagaaagaaaagacattttaacaacttagaggtttataatttttctatgaaacaaatgagtagaatttaaatccttcttcgatattttgacttctaatccccactctgacaaagtatatgtaaaattatttgtttttatttgatattcttcattaaaatatgtggggaaagtgtcagaagaaagcacattagttgaaaaactggtaacattttaataaaagctatagcactctgtaaataatattcactagtgtcaattttctgatgttgatcagtatgttgttacgtaacatggtaccattagtagaagctgggtaaaaagtataaaggaattcacttttattactttgtaatttttctgaagtcttaaatgattttttaagttaaaaaatatgtggggccaggcacggtgactcacgcctgtaatcccagcactttgggaggccgaggcgggtggatcaccaggtcaggagatcgagaccatcctggccaacatggtgaaaccccatctctactaaaaatacaaaaattagctgggtgtggtggcatgtgcctgtaaccccagcaacttgggaggctgaggcaggagaatcacttgaaccagggagtcagagtttgtactgagccgagatcacaccactatactccagcctagtgacagagtgagactccatctcaaaaagaaaaaaaaaaatgtgggtaacagtattttagccaatgacctacagccactgaactccagcctgggcaacagagcgagattccgtctcaaaaaaaaaaacaaacaacttttctacatattgacggagacgttcatgcacctagtcattcatcattcactttgtattgagtgcttactatgtattacagaccattcattctaggttctaatgatgcatgaggcatcaatcaaaatcttttcactcatggaacatacattcttctgggaaagaagatcaaaaataaataaacagcaacaatacatatttcagaaagtgggatatgaaaatagagttccaaggtgagaagtgtaatttttaaaggactgttaaggaaggcatcttcaacacctataagacagatcttagcagcactatttgtaatggccttaacatagaaacaatgattatacacaaaaaggaaaatgaataaatatgtttgtatacattcatacagtgggatattttacaaaaatgaaagaaataaagcaaataaatatattaccatatacaaacctcacaaccataatattggggattaaagtacataaaatatatttatgataatgttctaacttataaaatattttaaaatatgcaaaacaatattatgaattaaaattttttcttaaattagatatatatgagacatacaaaattccagggagttattatatctggtaatgatgaaaagtaagattccatgagggaaaacacaacaagaaggttaaactatattgatatttttaattaattttaaagctagtggtaggtatccagataaacttgtattaatctatatattttgtacacctaaatgattttaaacacaatttattaaatttatcttaataaaatattaagatagtttatcttaataaaatattagtttaaatttgggagttcagagaatttttaaaagtacttatttgacacaatgtgtgccctatggtgtgtgtgtgtgtgtatgtgggtttgtgtgtggtatgcagaatgacattatgctaagatatatatatgcatggaggaaggtacaaatgtacacgtgggtgtagatttacactagcagttcacccagcgtcagcagagcaagcgttgtcaattattttcctagaaagagtgaaggaaggatttgtcctagcttgaccccacacttgcacttctacccttctgtctctgccccatgataaatgtcatgcatttgcaagatagttggctgggtaaaggtagcattttgtagattgaatatggctaatcgtcttacttggggattgattctatcttcatcaatttataatttttcaattttttttaaagttagatggacgatgctgacagggatgttgatatatcatcaccatctccagccattagattttatagaaattaaacctgagaactagtaatatcttggagttagtgcagataagtgacacaaataagtggttccctggttcttgcatctatatttgtagcctcactaaatcgacattcagttacagacgcaataaatgaaagtacatggagagaaaagtatcctgattcttctacactgagttgaaagctttaatcatttaaagaatgctttcacaaaaacacaagccaacaatgcaaaccaaaatcagccaatcaacaacttagcaaaaaatctgagagcaagaaaactgaaatgaaattctttataataagatcttttatttattgtaaattatattttaaatgtgtaatattaactgaacaaagaataacttagaaagggtggacaagggcattttcattcattagggattttaaatttttcctcaaatagttcttaataatttaaaagacgtttcactacaaaatatctagcttcctaaattactttatgcagtttggtagattatcagcctgatcacaaaattacatccatcagaatcacaacttgttgggacagatatcagtgagcatttattgtgtgctcaacactaaagatctagcagtgaagacagacaaacattaggaaacaatatggcaccatacataattttagaatgacatgaatttgccctcaggtatctgtatatgattatgcagaatttgaaagatatgacagctatcaatcttgcctctggagcttgtatttgacatttttctagactgcaaattcattttgtcataccgtgatgattgcatttaattttttaacttgtcaactctaaagttagagcacttaaaaactatatccagagaaattattattaatctttgaatgcccagcatttttatttccccccccaaaatttttaaattccatttcaggtctatcagtcttcattatcttcttactattatatatatttattatatgtaccatatgtaattataatatttaaatatattttccttttaaaatcagcaattttgcctttaacataaaataacatatatatatatatacatacacatatatgcatgtactcagtgtttaccttaagaggtaatttttgtctgtcagaaattgtgttctaagaaatatagaacttgttcattattgaactataacttgttcatcacttggttccgggatttaaataccatcttgtgttggaagatgtgcttgtattgttcctaggagtgtgtatcatcatgctgcctaaaaacactgtgatgggagtatattcttgcccattgaccaaatggacaagcctcttaccttctcttaagtgcataacctctctcctatactgtctttgctgtaggaaatcatagcaagaaggataaaggaaaagacactagcttactaatagttaaatagtttgaaaggcatagtttggtaaggcagcttagcaatgctttaagtataagatacactgggccctacatttgatttgtaatcagattgtaagaagctaatgtttcttactgtagtcgctgttttcgtccttggtcccatcaatggtaccatctgggtgcatctgcaggaagtatccctgctggctgaataaccttgtcacaatccctttgagctggggttctgcaaaacaaaataattattcaaatttttatttggcttacacaaatgcacacttacagattgttaaaaacatcctgtaagtaaatacgtaaatgccaatagcttaaatattgaattatgtatttgggagttgggtgtttcagtaacatatctatgcttttttttttccatttagaggtagagctttaacacttttagcagtaaactaaatgcaaataaataaaagctaattatgattgggaaaatacagagacatgctaaaaagtgagttattttcctcctttgtgcatctggtgtctgactgcaagatttcaccaactttatagtcccattccagaattattgtttaggccaaaatgcctctgtaatttctaagtttctagtagccataaccaggtccataagacttctatctctgcaggatgtcagctctccatcagaagttcctgggttttgaatttgtgatcaagttcagccagaaagaatagtttggagaagaaccacaggcaacagcaaaaacttccacggccatgagatgtcactggcaaatatgtggaaacgcaaatttcaccttcactaaatacttcatcagagaggagcctcagtgttccaaagttcatttctccagtacaaaaaaaaaaaaaaaaaaaaaaatcaagtcatacatatttatctaagtatttcaaaccagaattgctcaacttttaaaaaccctctaaacacaaatactttcaaactaacctttgtataacacatttgaatttttgtgcatcagctaatataaatatttaaagctttctcatcgcagtgctggctgccagcaacaatctagtttccaccgcatcaccatttttgtctctattgttgagcaaaaatgaagtattctagtgcccttatagctctaattatttcattaaaatgaggagaaaaagaaaaatgctgcttctggtgataaaaatggaggcaaagatggaaatcatatgattgctgaagtaacaacatggtatcctcagaaggacaatcgctgaatttaagctagtcaacttcatccttcatccatttattcaactaatgtttaccaagaatgtcttttttctgccaagcaatatggcaggcactgtgtgttacactgaatgcattattgatatttaggtctaaaagaattctagttaagcatttaatgtgattaattctttgagaattggcctacaccctataacaagtgtctgcagttgggacttttgcacatgtgacttgatcacattcacattatttgggaatatggggcaatgcctctatcaacacatctttttcaaagcagtcctacaaagcaaaagagatgtcaagaaaattgggaatgaggaagcagactaatgagcaaagaactgaactggaaattaggtattctaattaatagatatgtattatctttatgagttaaataaattccgttttttaaatttgtgaacctcaatgtcctcatcaataaaaatctggaagttaagctgaatggttgtttgttccttcatatgagtctctattcactttgagcacattagaatcctctgccttgaatggtgtcagaaatagaagaatggatttgtcttcaatgcatttcctccataggctcatctaatcccacaactatggacaagtcagggacacacttggctagctaacgtcactgcaaacaactctctcttttttttaaaattatacttttagttctagggtacatgagcacaacgtgcaagtttgttacatatgtatacatgtgccatgctggttggctgcacccattaactcgtcatttacattaggtatttctcctaatgctatccctcccccacccctccaccccacgacagtcccaggtgtgtgatgttctccgccctgtgtccaaatgttctcattgttcaattcccacctatgagtgagaacacgcagtgtttggttttctgtccttgctgtaaacaactctctgtgtgcctctgcctttggctacctggctgacaggcagcttctgatgtggtagactcacctatagatttgaacctcaaatgctgtgtggccccgatcaactcatctaacatctgagtttcaagtttttgtatctatatagtaagatttttaaaaagtcctactctataatccttgcaaatttcaaatgaatagtgacagagtacaaactagaaaacccataaaatatacatcctaattaaagtctaatgtttcaactatgaaaatcaaggacacggtataagggaggtaaaagaagcattctgagaaaagagtatgtctccagcttctgctttagtaaatattaactgagcttgtaaagccactaaagtaaacagtgggctaaaagtacaggatataaaacaatagaggggaggaagagggcaactgtcttacaattcacactgtatttctaataagcttgataaagtcactttaagaagtcaccacatgttctcactcataagtgggaattgaacaatgagaacacttggacacaggaaggcgaacatcacacaccggggcctgttgtggggtagggggaggggggagggatagcattaggagatatatctaatgtaaatgacgagttaatgggtgcagcacaccaacatggcacatgtatacatatgtaacaaacctgcaagttgtgcacatgtaccctaaaacttaaagtataattaaaaaaaaaaaaagaagtcatgtttttattggtaatgagatgcatgccagtttagtcgttaaagcctgtgaatgattgtttgttttctttgtgctcctctttctgtacctgtaattaaacacttcttttgccctggtggagccatcccctgttggagccctgggaattcgggttggtaactcctgctcaggataatgagcatcagactctgagcacccatctctgagagcagtgccagaacaggcccagagtctgcgttttaatcatgttgtgatatgtgaaaatgaacatcctgcattacagaagtttcaaaggagacttgatcatctattgaaaaaaataccctgaacatatataatatagatggggcacagaaagctgtgtagcctgagtggcatcttgtatgtctattaccatcgatcaagtcctaccaacctttccaggttcagctcaacatcaccttctccatgaagactcagctatcgtaagtgagaatctcctttacgatgaggaaaaccagaacatgttttgctctattttaaagaaaggaggtataaaatgagaccacttttcagcatatccagcatcctgggtacattcaactaacacacgtttatttatcagactatgcttggggacccaagatatgaagaaaacgaaaacctttgctgtcctcagggagcacccagtctaatgcatgaaacatatttgtgtataataccagtgtgggagagctgataaataaggaagtgaatcacagtgatgtgatgtcaccaaggagcaagggaccagttctgcctgaaggttgggataaggcacttcatctgtcacttaaagaatgagtaggattgccataggcaaggaaaccagagaaagggcattccacacaaaacatcacaactctgggaatgatgcagcctggtatagacagaatagagaaaagggttctcaaatgcagacatacaagtaagtacctgttctcaacaaatgttctagcacaacagtgacactaagacaaatagggtcaatggaataggttttctatgaagctaatattttccagtttatatgactccttgattttaaaattatgctcttccattactgtttttctttttcttaatgaaatgatgactatattattagatggtaggggaggaagggttggtttgctcccttttgtgctctaaagtggtgtggcaaatactgcaagcatttcactgaaatccatttcctcttttttctgggcacccagctagaccatatgtcctagcctcccttgcagttaggtttggcagatgaatgagtgtcatatggaatgtaagtggaagtgatgtgtgccattttcaggccaaggtttttaaaagcaaacattctcctccacactctcttttccttaacaccggccagattaagataacatagccctaggggctatagaaacaacagaatggaagaatgttgggtccctgaataacaggtaaaggaaagatgactgccattgaaatacctaccttggaccgtgaactgaataagaaataaacttccattggctgtgcataatgggctttggacttccttccaaaacatacagtatgcaaagggaaggagagagtaatattatggtggagaaacctaacaaacaaagcactacctcagtcaggcaatcaaggctaatatcatcaattataaaacatgctgatagtatgttctcttgagattatgtgatgagaatagcactttacctctgtgatcttcctccaaaaaacccacaaccccagtctattcatgagaaaaaaaaattagacaaatgcccgttaaataatgttctacaaaatacttgaccagtactcctcaaaatggattgttcatcacacaaagaagggataaatgcttgaggtgagagataacctatttgccttgatgtgattactatgcatcataggcccgtttcgaaatatcacttgtaccctacaaatatatacacccaccatgtacccatacaagttaaaagtaaaaaattaaaaaaaaaaaaaactatcaatgtcattgaagaaaacgaatgtctaggaaaaagtcatagataaaaggagtctaaaaagacataacaactaaatgtaatggggtattctgaatgagatcctagagctgaaaaagaacattatgtaaaaatgaaggaaatctgaataaagtatggattttagttaaacatactgtaatgatatagattcttcattgtgacaaatattgtacattaatgtaagctgttactatgggaaattggatatagggtatatgagaactctgtactatcttcacatctctataaattaaaaaaaattctaagataataattatattaaaaatactaagtacagctaaaaaagcaagtaataaatgttttcctcaaagaggctgagtgacaaggaaggtaaaggatgggacctcgggttcaatactgcttcccatcaggatgacatggcaatttcagcagaacgtttgaattcagagccactcagaaaagctgacacatgctggagctatctagacgttcctgccggcttgacagtccatctagtgctatgaagtatttcctaggtacacgatggaaacccagaacagagacagagccaaggggtcctggtcagaaatctcaggatgaatattcaattacaggaaataggatgaattttagacgtggaaaggatcgacactttacttcattagcttcaaaggtaaaaaaaaaaaaaaaaaaacaacaacaaaaaacaaaactctggctcggagagacagtgtcttatccaaggtcacacagctaacacactgatgagttcagacaagaactcagctcctatatactgaatggacatcatcctttcctttccaaagagcaaaatccttaccttaccaaaactgagggttggggagcaagaagggagaagagaggagagaataaggaggggagagtatctagctgtgaatcagttattaaagtacgtgttgatagaaaagcagttacagaaaattgtgcaagaaatatgtatctatataacctttgatactaaaatcttctagggccagcgtattcacatatacccaaactttagagaaaggttctgcatataaactccaatctaaaatgaaaactattataacaataatgaaaattatgtaatgggggccatatctagagaattaatagtacttttgataacaatggctgtatattgaacccatctccttcgtggcaggcacacttctgatacttttactgttgttttatttattatgcataacaactaactgtatgaggtactcttttctcatttttcattttttgttgagattcaaggaagctgcaccactttgacccaaagtcacagccactccctagtactgttcagtcactttaaaagagtactggcaaaacaggaacctgtccagaggaaaggagccaaataaagagggtataaatgactgtcatatgaagaatggctgaattaacagtggccgtgcagcctagaaaaggaagcatttggagggatgtgagagcctagaagagggaggatttggagagctgtctccacgttcttgaaaatccaaagaaataagaagcagccaatttgttctgagtggctccacagagatagacctagggccaatgggtgaaagttacaggaatatgcagattaaaaagaactttctgtttattgtattcaaagacagaacaggtcgcctaaggaaagagtgagttttctatcactggacataaccagaaagaagcagaaaaactacaggtcagagcagctgtgaaggacgtggacgtctccaaaggcggagacactctgagtgagaatgaaaggtcttttctaaccctgatgtcctggaaagctttgagataagccagatggtccactaaatacaatttcacttttctgtttccttagtcggtgcttaagacagggaattaaaaagactgtttaccaggcatccagaaaatgcaaccttctttataaatgttaaacatagattgtggagtagtttgacgggttcttttaatcagcctctttgggtttacaaatgtgccttctgtattaacatttaatgttgtccacttaagggaaatgagattgaagaagctgttaaatgtgattcttgtcaagggcttcgggggcattacattgatgcagacttcaaaattagactattagggttagaaaatgttcataagcaaatacatttctgaccaatcataactaaagggtatagactagggcatatttacataccataaaccaaagtcccaggcaaatcagaaatgagctacagtaagcatttgaaaagggacagaacttacctggacttttgaacacactgaaaaattgcaactctactgatctatggggattcagtaaaaatatatgctatttagtaaaggagaagcaggcctgaggcccctcattcactcaacagactgcagtgaacagacctggaggaacaccttccagaactgaaaggataaggctgaagacgtgtcactctagcctggcagaatctgctctgtggagtaaagtgagtcatgtcctgtccctcatcttcgatctccccattggtcaaatgaagacgagagacaccatcagcagctaccttgctgagggccgtgaatcaaccccaaaagtgctgatattccaagaggattctgtaactaagtgcattctatttcagttatcaatagatactaatggcacgttttattttttaaaaatgaatatttattgagcaacagcctttgtgacagttattcttctgggcaaaagggataatcggtgcatgctagtaaatcaactctcccccacctccctccccttccaaaaaaaaacagagcagaaaagaaaatccaaaaccagactttcatgggatgatttccacagtgcaactacttcaactatgactgctttaaaactactacttgacatcactgaacatagatgtgaagctggaaagaggtgagcaccatcagctccagctcaccaatgaatataactgaggataaaacataaagcgtgcattctagtaggaagatggaaaataaacatgtaaacaataaagtatataataaaatgttagtataagtgctatgataaaaattaaagcaatataaaaggatagagcatgcaagggatggatgtgctattgtggacagaacgaatagaagataacatcacagaagcctaaagaaagagaggaaggaaaccattaaggatatctaacagaaatacattccaggagcagggagcagcaagtataaagcaatcctaataatggtaaagattaataaccaacagattagaggctctctgaagatccttcctctatgccaagagtccacaaactatagccctgtggctgccaattttgttaataaagttttttttttcattttcttgctcatttaatctgaacagtattagagcatgaccatgcccattcactcatgcattgcctctgctttcatgctacaacaacaaaggtaagtagttgcaacagataccctatatcctgcaaagactgaaatctttactaacagaccctttaatgagaaagtctgccagccctttctctacttgctttctcttgcttctgtagacacctctgcctgaaaagcacaacccctgccttcctcctctgcccaggggtcctccagagccttctaagcacagctttcttccacagggtcttccctgacaccctgaggcaaaattaatcacttcctcttcaaagctccattgtgcataggttaggagagctgtgcactattttagaggtgcttgtttacacccctgtctctgctgctgaactatgaacctctcagggcagagaccttattcatcaactctatcccagcacctaacacagtgccaggcacaaggtagatgaggagtgtttgtatgctgaaggaatgaaagtaataagatatacctggcattttcctttgtcacctgtgactttcaaaggagcttctcatttgtacaaagagctgcttatagcctttgaatataatgcctctggcctctaatgcgtttcttccaattttgtcctgcacactgaacacagtctgacaagcacagcagcctcctccataaactgcacagtctccaaagccctgagttgcctcacatttcaacaggaatcgaatgaccttgagacaggcaatcctcaatcttcatattgtctcaaagctacatggaaagaaaataaccttcatttttggagtttcctcttcaccaaagcagtctgagctgtagaagacatgagacggagggcaggaaaactgagctaagatgtgaaatgccaatagggacaaggtttttgtactgagccagttttattcctcatagcattagcccccttcctcctagattcttctttgtaatatgctcatgaaaatttaaaatagttccagcaccatttattgacttccaacatgcactaggtgctgggtacaaagatgagtaagatgcaattcctgccttgaaggcacccacggcctgatcaaggagacacatacacaactaatcattatttccgtgaacatttaaagtgctgtcataaatgaacaaataaaatgccacggaatcacagaatggggatgctaattttacctgggatggcaggttctgggacaagaaacagttgaaaaaagctttaaagatgaagtaccactttatagttagcctagaataggcaggaggattttgctttgagcagcaccagcaggagcaagggcacagacagatgcatgtgcttagcatgtgcagggaccaggtatgtagctgggtgtggtcagggtgaaggaaatatgggggtgcatgcaggggctggaggcgacagcagaaaagaagcagggtccaggacacttgaggatctttaagcaaagctaataacaagttttactttattctttaagtcaatgatgtccaaacttttctaattatacatctctatcagtaaaatattttaaatctacagccttcatatatgtacatgtataatttatgccacgtgtatgtgccactctgtaaattttgtgtataatataacacaaaataggaattttaaaatgagatcaatgaaaaacacaaacaaaagttgtaattgccaggcatggtggtgcacacccgcagtcctagctgctggggaggctgaggtgggaggattgcttgatcccagaagttcaaggctgcagtgagctatgattgcatcactatactccagcctgggagacagagtgagaacctgtatctaaaaaaaagttgtaatagttttttttcatagccaatggctgtcatgccccacatgcttcagaggccaatgcattaagcaatgggaaaatttggaaggattttaagtctggggctaaaattatgagggtagtattttacaaagtcaaaggatactgtggttatgggagccagttagggagctattccatataagaaggaccttagataggcagtggcaatggggatggaaaaagctgtcagccagaggactgactgtgcttggtgtgctaacgtttcagccaccttaagaatgaaagtctcatttcagttgtaaatccaaatcccaaatccgaatccgaatcaatcgtcatcttcctaagggagcactatttaaatgtagaatattaatgaaagtgtgggtgaagaaagcttaacgcaggcattcccatgaagccaaataccttcttgccttttaagaatctctgttcatggaggggagtttgacactggtcaacctcactgggttacaactccctggtctttctcaaatgatcacccagagaagtagacctggaatgaacatggctttccaggcagctcaaaaatgattgctggagaatgccgaccacaagacacttcaaacatgaagataatcctaaaatcttaagatttcagagccagacaagccattcaggataatctaattcaaagctcatgttacatatgaagaaacaaaacaccagggagaggggaaagtcgcgtggcagcacatcttccaatccctggagtcagagctctttaatataccaggatcttccagttctgtgcctcccagaggtttcctgatcttatcccaaacgagctgcatggtatccagaaagccatttcatttcttcatgcatagccatactttgcttcttgtgaaattgtttagataactaagacccactgaactaaagcttgttctaagaaattaggaagacacattatagtgtgctctatgactaggaagccacgcttatatggtagatttaactttcagacagaattaatgtagataggaaaatccacggttagttaaacagtagcaatgggcaaattctcctgaggttcattcacagaaaggaaatgccaagcagttaacaaatgccaggcactttatgtggattatctctgaattttcactgaaataatttaaggcaggtactatcattgggcttttttttttacatctatattagggaactgaggcttacagaggtgaaatcactagtgctaaattacagagttaatccatgccagagccagggtggaaggtttttgctttacacctcattgttaatcatcagttgtcttttgaagaactctaacatgctaatacatctctctacttctttaactgtgatcagcccacaaaccctgtggaaatctataaagccaggggccaggaataaaaagcaaacactaaactggagttgcagacatagcttttggcctcctgtcacaaaaaaaagtggcggggctgtagacacttctatgcacacagaaagtgttctgtaataaaagcatcctcatttggcatagaaaaatcttctcagtgagtctcttttctcacagacacatcttttggcaccagaaataaatgaacaggacacattatttgggcgagcacaggcatgacagttccctgacatcaggggagctgcacaaatgttggacttgtcctgaaactgccttggatatcagagatctgtttatccaggttggcaagcctgaggaattccctcatgcagcccaaatgtaaattaccttcaggtatattattatggttgttaaatgtgacttttgtctatcatcttttcataccatcacacacacacacacacacacacacacacaatgctttgcctttgcagagtcaaccagagtgagttctagtggtgtaataatactttcggcaaaagagcagttgagagctccaagaacacatccatcagccttgatcctggtaaattcaggcaccgtggtgcaggggcatatgcagggcagtgggatccggacatttggggtctaattccaattgtttgcttctctccatccgcactgcctccacctttgttcaggccatcgagtgctctgggctagattccactaacagcctcctcactaacactctttctcttccaaaccacactacagtcaaggtaatattttacaatataaattggatcatgtcactcttctgcttaaactctttaacagcttcccatttcatttacaagaaaacgtcagacccttagcatggccgggagagctttgcaccatctggctcctgcccacagtttcatcatcatcttaattgactctctccctggctcactaagctctaggcacatgtgccctctttctattcagacctagggatttttgtacctgcatttccctctgcctggattgattttcttcctgaaataaattcaagtcactgcataaatacaatttcatagaggtcttgtctaggcctccaacctaaatctgccgccacgtttgtacagatattatctggcagcacactgttttttttttcacctcccttcattgcacgtagtcgaatttgtaactagatagctatttctctttgttgtttattatctatttcccactctagactgtagcatccctgagggtgaggccatgtaacttttatttattacagaatatctagttcttagcatagtgcccattaacatacaggaagcaaacattttttttttttttcagtgacctagtttcttctctctgggcttcaggtttcatctataaaacgactgtattggaagagttccgtggctccaagtctaggtcccagaaacctgagggactctcaggtcaagatagatacttacaagctatttttaataagttagaattaaaaatggagaaaacatttttaatagatatatcttttaccactgtaaatcaatgaagattattaaaatttcagttaaattataatctagacaaactatattaatacaattaatttattacttgatattacatcacacaaaagagcactgaaaatatttatcaaatgtggataacacatacactgtaaatatgtaaacatgggttgggtgctataacttagattcattttgggaggctcttagggacaagtgaaacacagatacagggaactgccactgtgactgataatgatggactgtgacatagaggctaagatctcatgaataaagaaatgaaccagtgttttcagacaaagtgccaggacaatactttcaagggtggctgatctgactgtagacatgatcaaaagcctacttctctcatggccgactccaagaagcatatttcaggattcaatacagcaaggattgatctacccctagctaaggaatctctcaaacttatggagacggtcagcttgactttaacacctataacctattttaaaaattgaaaacagtttcccatttacatgtgacacattgtattaagaaaaggcatgatttgtcaacaaataatttttaaagggcacacgtttgggagaacaattaacattaaaatgtatgttgcattttgtttaggtgttacagaatcaaaaatacaaaaacattgggttttttatctgatgcttcaaaatcttgcactttgttttataaaaactggtttaattttagaatctctgtgttttctttctagtgaccacataagatgaaaaaattgaaactcttcccaagtatgtatccacacataatccattctttccatggatcacctgtgtagtcataaatgggaaaacaaattagatacaatggtcataagattttcttctttaactctgatattgaggctctgaaaacatctatatgtaccacgtaggaatttttattcgtaattttaatttgctttgatgaagattatcttgattatgatttgaagatttattatagttttacctatccattaacagttttattaatttgaattatctttttagcatgaaatatttcaaacatgcagaaaacagaaaactaataataacctttttaacagtgcttaccatgagccagggactcaaatgatttctatgtctagtacttactcattccatctttgcattagctctatgaagttagtattttttttctcattttatagatgttaatactaaggtgcaagtgaagtgactgcccaatggctcacccaaatttcataagcagaagggctgtaaagatttgagcgcaggcagcctggctccagaacccatagaacagattatcattctcactgcctctcaaccaggtactcatcacccatatttaacaaatactagcattttccataattgcttcaaatcgttttatagaatcaaaccattacagtcatctctttaattccattccattactttgctaacgagatgcagacatatttctgaatttgggaggtagccttcctattcatatttttgtgcctgtactccctctgtaaatatccacaaaaagtacctactgccctttgtgtgttgtgcattttaacataaaaatatgccatgtatattatcaagcaatttgattatctcattcaacattgtattaacaccaaatatttggattttgaatcttcatctgatttgaaattcccataatagatggctataatcattttgctttaactttaattttctgatttagctgtttttatttctatcatcttcgtttgtggtttttatttattatgcatttctttgcttcattattttatccttatgttccttcaattagattgatttagtctcccttatactctctccaatttttccctttatcttgaattggaaattacagttctgtctctattattttagtagtaatccttacatatctaacataaaggtgtagtttaacaaaatccaagtctaactgttaattactaagcttttatcaaataatgcaaacggctaaaaactcaaatccacatattcctattactggctagtattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaaaatgtctcagtgtttggcattacatttgtttatttatttctctctctttcttattgtaattaactggacacataacatcaaaaagatgcttactttccctcagcattctggaaaaaaatttcatcatcttctagcaactattattgctgacaggtctgcaatctatctttcatttgtagttaatctgtcttttctctctgacttcttttaaaatattgtatcttcatcataatgtgattttataacattactataatattcccaggtgtggattgttttaagaatccacatgatgggaaaagcccatatgaattttggggttctgcaaattctctatcttaatctctttgattatagatgatctgacattgtatcttttcttctttcccaggactccattgaaatgcatgttggagcttctttatatatatttcctatctcttaaaatctcactcaatgttttccatctattaatctctcagaagaattgatttgtctgctttcatctccaatttaatcattttctcttctattatttagagcttatttttgaacacacacataaactttctttcttactattgtcattgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgcccggctaattttgtatttttagtagagacggggttgctccatgttggtcaggctggtctcaaactcccggcctcaggtgatctgcctgccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattcaacttgttgagctttactcttctttttgatggtttatatccttgtatggtttcaattatcagactgagattttcctcagagaaagttgttttgtgtttccctggactgtgaaacacatggaaagcttttgtattggcctcttgtagtatttcacggatttccccagctagagagaagttcttacgttaacttctcagactggaattccaacttaacaaggagagtttgatattgaacctcacccaggaagtggtccccgtttgggtttctaattcctcatagacaacactttccacccattgccctaggtggacacatcaagttccttttagttttccttggcagatagaaaatttttctagatcaccatctctcagaaggagcactgtctctgtacaggcccctgcctgcctcacacgggtctgacacccagtctcctgtgcccacataaaggttaagcctgatgctcacctgttgatgcctatgccattctagtaatcgccacctgaagtacagaaactcagttcctgctcatctcgataaatataaattccctcttcttttctggcacatagagatttcccctttttggttttgagcgcaactatgcattttaatttttgttgttatattttctccagcagattcacctattttaagtgggaggcagagtcatttcgtaacagctcagattacaatagtcaaagtcttattttagcgtcaatgtttattatgcctctaacaagtagaacattatgggggtaacattaaaactataatattcaaaattatcattgtggttagaactgtgcaattaggacataaaaacactctgaatgactgagtcacgaacacatctgcctgatcccttccaagtgtcaggtatttagtaggtgagagtctcccagggccagacactatgcaaggagcttgggatacaataggcagcttattagtttatgttcccaaattttaaatcttaaaggaaaaataatttttaaatagttcattctattgctttaaggagaataatatatctgaacagatgttttccctagagaattgaaaaccaccagtgaggaaagctgttcttattaccactccttacaagagaaaaatagaaccctagtgcaggaaaaaatgtcttttctggtattacgcattgatcaaaattagacgagatccctttcttctgactctttcttttctttctttctttctttctttctttctttctttctttctttctttctttctttctttctttctttcttctttctttccttctttctctctttgtttttttttctcagtgtctcactctgtcggccaggctggagtgtagtggtgagatcacagctcactgcagcttcgaactcctgagctcaggagattctcccgccttagcctcctgagtagctgggactacaggcgtgtgctatcatgcctagctaatttttgtatttttgtagagacagggtttttgccatgttgcccaggctggtcttgaactcctgggctcatgccatccacccacctcagcctcccaaagtgctgggattacaggtgtgagccactgtgcctggtctcctctaactattaaaatagctttcccaaaaatgcaaagatatagacacaactacttttgtaactggaaatttaaataggtaaaccttagattattcataaacataattttagtaaacttaaatttaagatttccaaaagtaacggaacagggattcattttcgtcattttagcaaacagctcttcaagaatattctttggtataagtttacattctgatttaagaaaatcacatttatttgttgtttcttgttccattttaatcctttttctccaaactccaagaatcaaaagcacttttttttagggtccgggggtgcaggtgtggggttgtgggctatatctatattttaacttttattttaggttcagggatacatatgcaggttttttatacaggtaaactcatggattggggggctgttgtacagattatttcgtcacccaggtactaagcctagtacccaatagttattttttctgctcctctccctcctccgaacctccaccctcaagaaggccctagcatctgttgttcctttctttgtgtccatgatttctcatcatttagctctcacttataagtgagaacatgtggtatttggttttctgttcctgcattagtctaaggataatggcttccagctctatcaatgttcctgctaaagacacgatttaaattttttctggctgcatagtattccatggtgtatatgtaccacattttctttatccaatccaccatcgatgggtatttaggtcgattgtatgactttgctattgtgaattgcaaaagcagttattcagcttccataattcatacctacatttcccaaatgactgtgtgataaatacatgtgtatatgactatttaataaaaacattaataaatacaaataaaatcatgtattctggagataacctaacaaattgtcactgtgtatagggcaagggatacataagaaatccctacaccttccactcaattttgcgtgaacctgaaactgctctaaaaaaaaaaaaaaaaaaaagcctatcttttttaaatgtccttttgtactctgttatcttcaacaataaaaggaaaaaaatatataaagacatgagggacactaaaagagctctcaatcctttggggaatctttaacaaagcaataatatttacaaagtggctatttcccagaatgacatcgaaatttcacatatacgcgtgcacacacgcaatgcattcgcacacaaatagataattgtggatttttattaagtttaacatacctaaagatgctgccttatttactcaatttaacaataataagtcaccacactttggaagcaatatactctcaggagaagtccacagaaagaacactgctccaggattcaggagacttaagtcccagtcccagctttgccattcactccattactcagctttctaaaggagttggatcatcaagatcttttttacctcttttgttctatggctttaaaacaataatggtggtagtgataagacattgacttacgattttattatgttttagttattggataccataaagtacccagatttgaacacattcaaacaccacagcgttacataacacactttttatagctcactgcttggggaaataaataacaggaaattaataacaatatttaaattaaaggctatgccagaaatctctaagaacactaaatcagatccaactttaggcagtaataattaatatccactaataattaaatagatgatgtctagtttcagttccaggtgtccaagtttcccttccttgtctcattaagaattacaatttactgcactgcagataaacctttaggcaaagcatatttcatctgtttgcttaatggactggtgtcttcttaaaattcagagttctagacttaatattggttgtgagataatttatggttgatttcaacattttctatctcattggaaaaatttccaggcttatttcaaagcttgaaaccttaccaactttcatttgcctgaatgaaaacataacaaaccacattctagaatctagcaaagaaagtatagatggtggctaatagagtataagttcatgagagagaaaaaataatctaactataaataaatgctctacaccataaaacactatcaaatggtaacaattatgttatttcagaaatagtgtttatgtacagaaattctaatttctgatagcaagatagtaaggcaaaatcagaaaaacctgcccctgattgtccaataaaaagtagagtacaacttgttagatttcatagcacattgttgacaatagtcacctcatttcaccagaatggctttctctcccttggatctaatagcaagggaaagaatgctgagtttcatgcctaggccagtactatccaacagtaatataatgcaaaccccacgtaagtattttaaaacatttctagtactcatttttaaacaagcacaatatacaggtgaaagtgtatattctatttatatagagtatatatttatatacagtattctatttatatatagtatatatttaatgacttgttctatttaacataatgtatcccaaattagtagtgaatatagaaattattgcaatatcatacattcattttcttcatgctaagtcttcaaaacacactgtgtattttgcaatcacagtatatctcagttcaactagccactttcaagtgctcaaaagccacatgttgctagtggctaccatattatacagcacagacctaggtggttggacatcttgacagacacatttctccaaacagcacccgaccatctattatacaaagcaacaatgatcttgaagactttgttaatactgataacaacaaggtacaggtaatcaaagaccacgtacattctgaaaaatacgcaccaaataaggtgcaagcaaaaattatatcctaaacctactgcctgcctgccttcattccttccatcctaaccttgatctttccttccaccaataccctggtcttgataccacgccaaggaacacaactatgaacaaggcggtatggctagtgtcctcgtgaaattgaccctcttgtcagaaagaaactaaataaataatgccacaatcagttattataattacaaatatgagaagtgttctgaaggagtcctggctgctatggaggataaacctcaccaaaccctagggcgtcaaaaatggctccctcaggatagaacattgaagatgagtgtaaagaaaaagaaggaattagctagaggaagtgagtacgtgtcagaaaaaatgaggagtaaaaaataataacactccacacaaggacagaagtaaaagaaaaggttcaaagtcagaaacgactttttggtgaatttttttggtgaatttaaacaactgaaagtgtggagttcagagaccaagagtctggacagtggcccaaagaggagttcagatcattcagaatgttacagagcaaggcggaagaagcagtgtgaaagcaagggtcatttgggaaattctgaatggaaaaagtcagacacataggacatatagggagtgttatgtagactagcataacactttttttttttttcttttttgagatggagtctcgctctgtcacccaagctggagtgcagtgctgcgatctcagcccactgcaacctccaccttccgggttcaagccattctcctgcctcagcctcctgagtagctgggactacaggcatgtgccaacacgcccagctaattttttgtatttttcgtagagaagtggtttccccgtgttagccaggatggtctcgatctcgaccacgtgatccactcacctcagactctcaaagtactgggattacaggtgtgagccaccgcgcccggcctagcataacactttttattgagcttgtacatcaatcaaatgctatgctatagtccatctacactcaggctgatcaccctgtacccattttgccaatggtgtagaacttcaaatatatagccataaaacctaaacaccattgcacaaatgtagcctttgattttatctacctttgtcctagaataatggcctttcttcgcttaccaattcttagtgtggtcttctctattacctatagcaataaaaaaaaaatacgttggtataaaaaacaaagtcagtcacacaaaacagctggtttacccaagcaataacatgttttttccttcctttgctataatatagagcaagtaatcaaacaaaagagattggttctaaataaattaaaattgtgtgacagtcataattcataattatataaggtatattcatcatttccctttaataagttgtattaccccaaaatatataattattaaatttgaatgtaaattaccctgtaaaatgaatgcctatatttaaaacttttcacttttatgaggagtaatggcaagtcattgaaaagttttaagcataagaatgatatctaatctgtattttaaaagctcagtagagactgataacgagagaacagataggaggatgagcagggagacaagtgagaaagtaacaacacggccagtcaagagatgccagtgactagtttgtgaagatgtaaaattgtcttgacttagttattaattgcatgtgggcagaaagggaaatgtgtgggagcacagtaaaaatagaaagtggaagtatgtaatcatggcacagacagaatttccttagaagacagcaaagtagatccttcactgatctatttcccccaaactaacatatacaccccagcatggcatggaagacaaaacccagagtttatacttttctgagctaatgaacatacttctctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgaggtcagaactcccttaaaatgacatggttccaaggattctgatttaaaaaaaaaaaaatctgattaaaaaaaaaaaacctattgctataagtaatagagaagaccacactaataattggaaaagaaagaaaggacattattcttggacaaaggtagatgaaatcaaaggctaaatttgtgcaaaggtgtttaggttttatggctatatatttgaggttctacaccattggcaaagtgggtacatgcttgtttaaacatgataaccacattatttgaggagggaaatattagaagaggaacagatttagaaagaaacctacaaattaggtttaggatattttcagttggaggcaccaagtggaagtcggatttacaggtttagaactcaggagagaggtcttgcctgaagatataaatgtggcagtgttgatgttttgataaataaagccatgaaagtacaatgtgagtgtttaagatccaggactcagccttggatctctaaagatggaacagaagagtataaactgcttaaagagactaaggagaaaccagaaaaatgggagtaaagactgtttcaaaaacaggaattaaccagcaatgttgagtgctatcaagaagtcacataaatgagggctgaaaagtatccattagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatattttataaagacttaagcatattaaattgaaaacagcaagaagctagagaagaggggatgaaaggtgatgtatcttccctacgaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatacttatacacatacacacgcacatatacaatctctctaagactacactgaatatctgctgaggatgacttttttcctgagccaccacaggtttcccactttcaggctccgggggtgacattcactgatgtttgcatgagtgacacatcccaagaattgtacaggcaccatctgcacagatacactggatggtcagttacctctgtattccttaggtagagagagggtgaaaagtgactgttatgagggtcaggagaacttgcctcaattcttaactctgtcactctcatttgggtgacatctgtttctacaaagtcctcatgtatatacagtagcaacagataggtaaataagtagatatacagatatatagatagatttgagggaaaagggagatgacctggcttttcaggaagcaggtacatagactcggttatgaaattgcttgtcatatttgaatgaatttcagtgtgtctgtggcagtgcctaccatgtcctgagcactttgtgctgaggctctacgtgaagtaccaagtatctcttaatgtggagttctgttagtatttatttatatataaaaataataatatgttacaacatatcctaaatttatgtagattttttctaatttaaatgaaattttaacatatatatgttgtttgttccacagcacacacttttaaggtaggtagtattcaaactcagccctaatatttgtagggcttaaagcaagagaacaaatggagactcccatatcatatgtttaatatttaaatttataaatcaaggtaactgtcaaatattggatatttagttctgctacttgaaaattatgttttcctaattcaaacagatctcctgggctcctcagatctgatctttcacaaaacaaagcaggactgagagaattcaccccccccagctcatagttcagacctcttctcttcccactctgggctccagccaactgacactgccagggacccatagggattcacatataaaccatagtttatatgtccaagcaacatccacctccgtctaacagccttggtgaaccttcaggccaggggcgaatactctctgccatgcaatttgcccttggaagtacagccaaggaagacgagcacacagctcctggaagcaacctcagtaatgtctgggtaggaacttctgggatgccagagtgtggtacagaatagggaagcccaggctccaggtaaacatgcccccttattcccgtggactccttgccaccacagacgtggacatgcctggaggaaggcctgagtagagtccaggacaaaggcccctacctaagaattaaagcaatcattagtattctcattaaactattttaacatgaaggtaactggggctcagaaaggttaagcaactgttacttagcccaattgctagaatatggtaagttttcaatatggggtgaataaacgaggaataaatgacacacatctaattagtgacattgtctccaacatgaacacagtcttctctttctctctccagagctaattccacagttccacgctgacttcaatacatactgctatgctagtttttcatggtcttgaactctcttcttgatagctcattcactcatacatttatatctatgttggtgtgtaattatacatgtgtatgcacacatacacacactgtatgctagctgcagcttatcttgggaacaaatcttaaatatggcttgcagaaattattaagtctcatttcattatttgatttcccctacacaaatttcatctgtcataagttctggctgatttatgactcaggaatgcaatacttataaacctcaccatccaaaacagcattcaaattccatcaaaaattacttttctcactttaaaaaaaagtattataatttaaagttctgtctcccagctggaatccagaagaataaatatgagtatgaaagttaaaggaaggctctgataaaataattagagtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaaggcaattgggagaggtaacctctggtaatataaagaacactggaattagagtcaaaagctggggaggcaaaaaagaaactaaaattcattgaacacttacaatgtttcaggtacagggctagtgcctttatatactttattgttaaaagtgtcaaaccttcgataaggttgacattcacctgtctgttgcttccttacctagaatatgaatatctctatacattgtacaatataaataacagtaatatgaacaaaaaaaggggcaattgctagcatggctgtgcactgtatttgagaaagaatatagagaaataaccatggtattcctgtctcactgcactgcaaatcctgggatcgtaatcagatcccgttactatcagtgaatcacaatgttccctggcatgcctgcatctgggaacaccctactgaggagctggttaatattctattatatctcacaggaagaattcaaatgacacctccttgttggcccttttatgatttcacagaatagatgtgacaaggggctattcggaagctcaaaattttaaggtttagataaaccaaaagtatatctagccatctagttatagaatagacatccaaacctgtcttctattttttaagttgggagaaagaaaatagcgtattaataaaataactcaaaaagccaggtatgcttcaataatttttagtaaatgtctaaaaatgatttctttttattactaatttcattctttcaataaagtagtatagttattttcagtaaaacaataacaaaacagtttggatgcggtggctaaggcctgtaatcccagcactttaggaggctgaggccagaagatgcttgagcccaggagttgaagatcagcctgggcaatatggcaaaaccccatctctacaaaaaaaatacaaaaaaaaaatacacacacacacaatatatatatatatataaattatctggttgtggtggtgtgtgcctgtggtcccagctactcagaagactgatgtgggagcatcacctgagccaaggaggttgacgctgcggtgaggtgtgatcatgccactgcactccagcctgggtgacacagtgagacactgtctccaaaaaataaaaagtaacaagatagaaatgtcatgactttgaagtttgattatagccactcttagttattttatataattgaacatacataaggccggaggggtgtctcacacctgaatcccaacactctgggaggtcaaggtaggaggattgctagagaccaagagttcaagaccagtataggcaacataaagacacccccatctgtacagaaaattaaaccaaatagccaggcatggtggcatgtgcctgtagtcccagatacttgggaggttgaggcaggaggatcacttgagccctggaggtcaaggctgaagtgagctgcgatcggactgttgttgcacaccagcctgggcaacaaagcaagaccctatctaaaaaaataacaataatacataaaacataagtgtctataaaaataagcaaagacaaagacaatccaaatcgttataatacaatgtaatatcagctacagtaaatgagtcattatattgaaggtatcataatttatattgcattttatttaaaatttctgaagttatagaggttgacatatgttaggtgctttttatttattttttgtctacagaaatataattatttgctagatattttctcagatgttgtagagatcacaattagaaatcatatatgtatcatgccctaaaagaattcagactattaagaaagatatataacttataatcacataaattcaatacagtaatacatggaataaaagttgaagatagaatatagaaggtaaaattaaaatttaaaaattaatgtcattttcttaaaattaaagtcatcataaattatattttaaaaacatttcacatttttgaaagcaacttgctatatgatgccagactgtggaattctataaataagtattcaagtttgaaaaatatattttaaaacatattcaattttaaaaaaaaatgaaacatatggaaaagaagaataacaaaataagcaaaaactttcactatgtcttatgaaatataaagtggtgccaaaattttgtcacttatttcctgatactgatgcctgtgataccaaattactgaaaaaaagaagccaaaaaataaaaaggaaactaaggtaaccaagaaaaaataaaaggatactcttacaacgaaacataattaatggctaaccaatgtgaaaagacttaaattaatacatggccgggcgcggtggctcacgcctgtaatcccagcactttgggaggccgaggcaggcggatcaccagatgtcaggagttccagaccagcctgggcaacatggcgaaaccccatctctactaaaaatacaaaaattagccaggcatggtggcacatgcctatagtcccagctactcaggagtctgaggcaggagaatcacacgaacctaggagttggaggttgcagtgagcagagaagatggcaccaccacactccagcctggctacagagtgagactccatctcaaacaacgacaatacatattccgcaatcttcccctgaggtctgggacaatctagatcaaacacttcctcaaggggaaagttgggaacagcatacgtgcattttaacgctatcctttcagcatgagcatttccatttgtctattccagattttaaaacagaaactaaacattcctaatctttaatgtttgatctagcaaaataaaaagaagcaaaaagcaaacaaaaatttagatcaactcaactttattttgattctacttaaaattattttaaaatctttatttgatacaaaacgctaataaaaaggcattctcttatgagttattaagtattagacccacttttcaaaatgtataatttctacaagagttgattaatcagaagtgtccaatataaactacagttagactagatgatggcacaaaaagtcaattcgaggaacaaatggtgaaataaatattatatgtctgactaagaccatcatccataatatctggacaacaaaaagaacttcctttacttaactatcatgctctaagtttctcttttcaattttaaaatgtttaatctaaaccaagaatggcactatggtaacccaggtatataaagaaaaagctgtcctgtaggctgactcatagtcgctgacttagttcacttagtttatgaaaaacattcaaatgtccatgggttttccttccttagaacatacaaaatggctgcttagattctagcacactatgtgaaaaatatcaaaatggagggatgtgggaaagcccttttgtgtcatatatttctgagtttcagtaactgctgagacatgcagccatacagtttcccatctctattcatttatttgttgatgtgtttaccgcctacacttactgcctattgaaattcttctcatcttctccggcctggctcaaatgccatactcagagtgtgggggctgtggatacagctaagagagaggatggagagattgaaagagataagatctcaccaaagtacagtcattttaaagccatttaaaggtgctcttgtaaggaactgggaacctttgcaaaggtttctataggaaagtaatgtgacattaaatatgttttgaaaaattatgtgtgaagaataatcagggattcaagaaaagggaggttgaaacaccaggtaggagattctacaacatttcaggttggaacaacaagccccttaattatggcagaagggatgaagaaaaggttatatgaaacagaagctgatagctatgtgatgaccatgaccatgctaattcatcttactgtcccttatagttcccagaaagtcctcagttagtacctgatgaataaacaatagagtaaaacgttacagagatacagtcaacgaggcgtgtgactgatatgaagagatgagtcaaagataagtggggtccccaacgtggcaaacaagatggtcagtatcagaaaactaccaatatttgctaagtgtctactaggtatcattagtagtgctgttgactaaaggggaaactcaagacacaaagcagattgggttctggaggaagataatacattcaaattaaggcaaattgcatttgcgttcccagtggaacaactaccaggaggtatctagcacgtagttgaaaatttggatgaggagctcagatgttaatctgtggctcaaaaatatagaggagacaagtgaagtcaataaaaatgagtttatccaaggagaaaccatagccgagcaaagagaaaagcatgagccgaaggaggacaaaaagatgcaccgcttggggattagcaaaatgtatatctcttcattatgatagttttcagactgtaacagtgaaattgtggacaacaatatgctcagaactcttaaaattaaacacaggaatgcctttgagcatatagtttacatgctgtgaaatctacctgcaaaagtgcctgaatcagttcagatgacgtctagaccaactggtgatttaatttagaatgcaagcaaaaatctcttatgaaaatcctaagagtttggttaacgttaaaaaataataaaatccctactgtgaaattatgaagttcttttctcaaagcacattataaacagcagttgcaaggattattaaccaaatattactgtgcagagggataaagtgatctcgtaaaggcctcacagaaattctaatctggactgaaggtattttactctgggtttatcagaccaaatctggattattatatttgattccaagcaacaccctctacaatgatattgataaactggaggtgaacaaatctcctatatgaaatacagtttcataataggtgctgtaaatccttcatctcaaataaattctttccatatttaggataggtaagtttggtgtcctgattttcagataagaaaagtgaggattagaaaaattcaatacctgaccatgtttctctgacatgtcagtttttcaatattacttctatagatgagcttaaagccaccttgtatcaggaagaactaagaaactaagtgagacttagattggagacggtaagacacagattgaggagtgggagagaggctgtattgcataagcaaagatttatgtttactaaagccttgctactcaatgtgtggtcaccaggccagcagcaatggtatcacctgggagagaattccaaagccactcccgacttgctgaatcagaatctgcatttcacaagtttgagaagtgctgatctgaggaactattatagagagaagggattacagattttttcctatgtttctatttttgtttctcagaagacttgaattaagaagcttccaaaagacagactttgaattaatattggggaaacatcattttataatcagagttgacaacatatgtcatccactgaagatcataagattcaagtagaaagctgaactaaggctgtgagcagtggctcacgcctgtaatcccagcactttgggaggccaaggtgggctgatccctgaggtcgggagttcgagaccagcctgaccaacatggagaaaccccgtctctactaaaaataaaaaataaataaataaataaataaataaataaataaagctgggcatggtggcgcatgcctgtaatcccagctactggggaggctgaggcaggagaatcgtttgaactcaggaggtggaggttgcagtgaaccaagattgcgccattgcactccagcctgggcaacaaaagtgaaactccgagagagagagagagagagagagagagagagagagagagagaggaagggagggagggagggagggaagaaaggaagaaaggaagatgaactacacatgtaatttttggtgttctgtatctcctctaacccacgacctttttaagataaaggcctttgtttttttctctattgacccatacttcagttctagacagattataagtagacaatggatgtctgtcaaataattgaagatgtaaatgaatgtacagtggtgttggagtcagtgggttcaaatatgaaggtaaatgacctttaaagttttctacaatatgaagactctgtgattacaatgttaatggggtataggtttgctttttaattctacctatatgcaggatagagcagaatcaaaaactttcacccaacaaactcaaatttcccgaaggttcatagtgtatgtgaagatggctctatttatgagtattcatagaacattgctgaggtctttcactctccctctccaccaggagtaataatttgcattcaccttgttttgttaggcctatgtcattggtaaggtgactcatccaacaaatatattttatgtgacatctacgtgtcaagcaatatgctaggctttgttctttaccgtgttctacgtaagggactaacctcaagaaatgactttattagcaccctgttctaatcaaacagtaaactagccagtgattcagtagaatcctacattgactctcaactcacttgtaaatagggagaaataatcctataggagccctccaaattgtttttgtaaaagtttcctcatgtttgacacacaccatgaggtggcctctaactgactgttatgacattttcctcaaaaagaaaaagcccttctcatggttaaaactgattttgtattatacttcaaattcagggagtaggccaagcttatttttggtgaagtaacatgaccaatggcacaaaagataaaactgaattttcctgtgtatactgtaatcatactgcacagataaagaaaatgggaaaaaaaagaaaaaggtcaaataccaatcacacctatggaaatagataatgtggataatatacatgaataaaattcacagaaactcttaagatatcattttaggatatattttaatcatatccttccttaccaagtcttctactattatcactaatgagcataaattaatttcacaaactgtccataatattaaacgtgatgattctaagagaatgtcaaggctgatatttagtaaacattgttttaaaaaaaaatttcataattgatgaagtcctggtggaaaacatatctaaaaggtatatcccaagtctgggaaatctaaaaacttgataattaaggcatgacttgcctctccacatccattccaatcagttcctatggcatcctatactttactacatttctattgcttaaaactgtcctgcagtatgacattacacattaacctacccagaaataagtctccagctttcactcaaaatcatgtggttcctttcctgtctgttttttaaaaattgttttattatcttcgagactacactagtaaataaacgtattttctattaaaacaaatactagttccactatattattaagttcttccggggctgaggtccaaacttatgtaatggtctaccttgaaggcctgtcaaaatgctagaaacaaggaaaatttagaaatacagtcaatttgtgtccagttgaatgaatctaagaacaaataaagaatatacaacagagaagctaataaaaatatatttgttaaatttgtgatattccatttaatatacatgtcaaaccttctagaacttcatatcaaacatatcattaagccattttcttatatctgacatacagatatcttggaatacatacacctgtcctccatgagtattagcaccataaatatacatcaagaataataaagctgaaaggaatttcggaaatcattgatagtaaccctttcatgctgaaaataaggaaactaagctgaagagaagaaaaatgacttccccaaggtcaccaggactctgactcctagtccagtattttttctatcacatcattttaccttagactgaatcaaaaacctcttttatttatatcttccttttaaaaaggttgggtttcaaaccaagcaaaagaataaatacagagaactgtagcatacacagaagacttatttaatgctgctatcaataactttaaaagtaagagaaaagaagaaaaacaaatgaggtaatcaagagttgacagaaagaaccttttccattaaacccaatcgatactgtatttccccatcacttagcgcttcaccagagaaagtgaacccagagtgaatatgttccctcaagggtatttaacactaagatgacttgttggtctcagctgtaaatataaggaccagacatgactaaatctgaaatcaatggcaaaggttattcctcattaacctaacgttaagaaacctaaaccagtcaaaatagaaatgggcccttttccatattggctgcaccacccactccctctaggtttctggggcaaagacataaatgaatataaagatgctccttctttcagcattcccatagaaactgccccctgcatcagtgggtgctctgataagaaagaggtaaagtttgaaggtgttaggcaaagtaaatactaagtataagaagggatggccattaggagttgggttggggaataagtaaagacatgaagttctaagtatttatcaaacaactacatatcaaattaaactggagtaacaatatttttggaatttaatatcaaatgaagagatatttgtattagccaaaaatactgatttattttctttcccaacattttcatatatatgcagaaattccctcagagcctgactatactgatgccataagcacattagtcaccaatggaattaatttcgttttgatgaattatttctgatcacctagtatgtagaaagcattgaaatgacagggcgcttgccctccaggaactcactctccagcggcagagacaaacaggtacttatagagtaattataagacaagacagactaaccgcagacaacagtgcagggtataaagcctggggcaggcagtgattcattctacctggaaggatctgagaagatctggcagaagagatgggagttgagctgggctttgaataatgggcaggactgcagcagagtggataaatgaagggttgtctctgggtaagtgaaggataggtgtggaggttaatggcatccctcgtggagaaataaaaacatctataaactaaaagaactgaaatggatagatgcagtaaatgttctatgaatgtcaagaaggtttgggtcggctagagtagtatgtggggaagggtggagaaagaaccttgattgtggagcctattcatattgatgatacaataataaactgtctgctcttaaccacgtattgagcccacacgtgtatttttaaaagacagattgtggctaagttttttaaattaagaaattactgtttttcttgaaatatagacattaaaggagaaacagtccaaaataatacagcaaaactataacttggaacacagtaacacaaatccagcaagagttaataaatcttaattatatactgccttacacaaaagaaggcaaggattttctcagtatttctatattccattcccaagcacatgatatacaaatactcaatgggtgtctagcaatataacttgactgtagatatttaaacgcatctacccaacatttatattgctccagacacagaacaggcagatagctcttgctaccagcattgggcaatgggccctaaaaggaggcagctgtggtgtagcagtaaggcataggcttatcgcaaatttcagtccttgctctgcctttcatagttgtatgacctaacacccactatgagtcttatttctttcttccatgaggtgggcaggtgtattgtaatgagctctgttttccaattcaaacccaccaacacttttcatatataccttaccaggtggacatctcaaggctaatgtcacagttagtcaaccccaagtgcaagatatataatggcctgggacgaaagtcttaatcaaggtgccagttcaaccagactttgaattcaaataatgaacccagctgcataaagcttgctgctcttcagccctaacaggtgtctgcataatcacaaagaaaaccagcttcagactgaatgtaattgctgagcatgaaaaagacaacaggcaggccagcagtttcagtgaaaataacaagagtcaggaccaaggaacctccatcttcaccagatcaaaacttaccctgaaggggcaggctcccaaccaagatggtagttccattagcaaaattataatgaatggaactctaaatcataaagccatgtggtaacccagaaaatgcactcgggaacatttcaaagaagggagttttgtggcaataccaggaaaagcataatttcaaagcaagtttccttcttggtcctgcttttctcatgacctgtaggtggagagggaggagtagatagaatgcctgggaaaccagagctgcagaatgtggaggcggcctggccacaatgctgccaactcctttcctgagcaaagctgcagaggataatggcccagggattgtcagggaaagacaggtgaggcaaggaggcaatgaggaatcctctctactttcccgaaaagaaaatagatctccagtttctcagagaaatatcctataagaagactacagaggatgtctgggtttctatcattgtgacttcctttcctagaattctgagcttctgaactatcacctcatatgccatctcttcttctcctagctagagtcgagttgcaaaaacccactgcaatatcctttgaagcaacaaagcatgacagcaacacatacatgactcgctcctcagtgagaaacttgggtttccatagaatttgagatcctctatatgttccatcattttctattaattactcagatatgaatgaaccttttctgttgcggcctctgtgggtgactctgggtgactttcctttctcaaatgtaatattgtatgtagaaggtatattgtgtagacagctagagctatttggctgaaaacagaacctgacacctattctaaccagaaaatttgaatatagatccctactttgggcacttatttaaattctgcccctgtttcttaatgatttttaatgcattatctgattctaggacactgtgaaggtgatctgggtcatcttttgagttcccaaattaatatacaacatttaaatcaccagtgcaatttaaaaaaaaactctttatgaactttttagtctattttatctttataataacttatacaacttatccgggtttatagttcttctttcatgaatttcactcttcccttcaaaccccctttaaaaaaaaatctaaaacactgcacacagcacactgatttaatttctaatccttgaagagacaaaataagcctaaattggtgtcaagagaaagactgacattttagacagatttctttattagtgccttgcaagtaattaaaccatgggatgcagttaggaacatccaaaacagcacactaagaaaatagttttgtccttcaagtaagaagcagggaaaagatctgtgtttcatgttcccagtcacaaatgtttttcctggggtgaggggagctacagttaatagcttttcaggctaaagaggcccttatattttcttttttctttttttttttttttctgagacagagtcttgctttgtcacccagactggagtgcagtggtgtgatcttggcacactgcaacctacacctcccaggtaggtgattttcctgccccagcctcccaagtagctgggattacaggcatgcaccaccacgcccgactaattttgtattttagtaaagacagggtttcaccatgttgaccagactggtctcgaactcctaacctcaagtgatctgcccgcctcagcttcccaaagtgctggaattacaggtgtgagccagctcttatatattcttatatatagctcccttgtttttcaaagacagaaactgaggtccatttccaggactggcagagtagaaagaaaagtagattaggaaaaacaaacctgagtctaaatccagaatctaaccagtcctgtgaaactgagaagccccaggctttgcaggacctcagcatccttaggtgggaaggagagatgctaccttcagaatccttcttcctctgaggcttgctcagtgagtcaggatgtcatttcctcattgatttaacagcaactgaagaactgcagtgacacaggcagtatactaagttctgagaaatctagtgctgaccaggtcctgtgcttaggaactgaagttttcatcaagaagacgaggcatgcaagcattccatatgatgatgcagctcagttttgggatatcattaaacacaggaaagattcaaatataagcaaaaaaaaaaaaagtggtgccttggacagaacgtttatgtgtccctccccctgcccaatgttgaaatcctaacctccaagatgatgttaggaagtggaagactttgagaagtgattaggtcatgaagcctctctcctcatgaatgggattagtggtcttacaaaagagaccccagggagctcccttgccccttctgccatttgaaaaagcagcaaagactgccatctatgacttaggaagcaggccctcacagacaccgaatcttccggcaccttgatcttgggaatgccagcctctcgaactgtgaaaaatacatttctgttgtttaagccacctgtgcatggtattttatcataacaaccagaatgggctgagacagaagagatcatcattataaattatattagtgtataaaatttctaggcataatggatgtgttcctaaagacattaacaaaatcattaattttgtttaagggccacaatttatgaaataaaggaattggaacaggttggggactctcaatatatgatgcatattagcatagactttctaggtgtttggcattagtacgtttaaaaactctcaggtgatttcattttgcagctagggctgagaaccagtggcttatataagctctaagtgctaacattttgtgattcagcatacagatcctatttgacccatgtcattctttacttctagggaaccaagtttggtcttaggccttagggccctctctactgactcctgaaaagtaacgaagaaaagactctatagagtacagtcatccctccctatgttcagggtgaggagtggtggttacaagaccgccaccctcaggatacccaaccggaggatcctcaagtcctttacataaaatggcatagtatttgcatagcatggttgtactatggttttcttcttgaatatttccatccatggttggtgaatcttcaaatgcaaaaccatcagtccaagtttcaattatgaggcattaacataagtgtggttacaagcatggagtctgggaggcctataaatactacaaacgaatcaaataactaacaataggcagaaaaatagaactttataaaatttgtgtttgtaaaatcacttgacgattcgaaggccaatgagtgtttcttgagagttcaagaataaagtaaacagccttatatatatgggtattgtaaaaccattaaacaataaataaaacccaatcttccaccttcacattcttttctttttttttttttttttgagactgagtctcgccatgtggcccgggctggagtgcaatgacacgaccttggctcattgcaacttccgcctcccgggttcaaatgattctcctgcctcagcctcctaagtagctgggattacaggcacccaccaccacactgagctaatttttgtatttttaatagagatggggtttcaccatgttggccaggctggtctcgaactcctgacgttgtgatccacctgcctcagccttccaaaatgctgggattatgggtgtgaaccaccgcaccccgtccccaccttcacattctatagtgttttgtagttgggtaattacattatttgacctctatcaaccctgctccttcaccagcattcctccatctccacaaacatgcaattcactatggaatagttcagccagggattatccaggcaccttcgactctccactcatagtctacctcttatgaagttctgctcattctacctttacccactctttttatatccatggccatcaacttcatttcaacatcatctatagcctagaccagtggttctcaaactttttgttttcaggatcctttacactcctagaaagtattgagtaccccgaagagctttgtgcttatgtagtttatatctctcaatatttactgtatttagaagttacaatgaaatttttcaaataattatttgtttattaaaacaataataagccccactgtgttaacataaatagcatgatttaataaaacttatctttattttccaaaacaaacaaaaaggaattaatgaaaagactggtttgtaaatctttttaatgtctagcttaatagaagtcagcttgttctcaagtctgcttctgcattcaatctcttttgatatcttattgtggatgaagtacatgaggataacctggcctcacaaagaaacgtggttgaaaagggaggaaatttttagtaccttttacagatgattgtggatatatcacacagtctctggaaaattccactggacacttgtgacagaatgagtgaaaatggcaaataactagtggtattaggaaatattttttatgaaaatcgttttgaccttctggatccactaaaagattttcaggaagcttctagggcctctgtactgtatggtactttgagaactgctggtccagactgatgccctagcctccttactgttcccttgcttctactctgcttccattgctatccattctcttctccaaaggcaaagtgcccaattaaaaatacaagtcgcatgatatcaccccatactgctgatctttctttggaccctagattaaaatacaaaattcatcttaggcttctcaaggccctgcggttcttgccaaactttccaacatcatctgtacccctctccccttgttcttattgcttcagctatacttcaatttcttcagaagcaccgagctccctctcacatcaatcttcatgcaagttgttctcttctgccttgaaggttcttccattcctgtctgcctgtttcatcttttggagctcagcttaaatgatttttcctcaaagaagcatttcttgaccaaaagctagaggtaatatcttcattttacaaatcagcaaactgaggtgcaaagatattaagaaacttgcctaatgttcttacaaataataagaccataatttgaattcacatcccactccgaagtccaggtacttaatcattctgctatgctatcacttaagttaaacaaacaaacaaaaagattaaatcttacagagctctctttaacttggtgttaacctctttactatccaaaacatctgaagcaatcatttatgtttatggttaagagagtctggccctctgggcccaagtctcccagtgggtccttaggtatcccatgtggcaccccttcatatcatcaaggctcccggcattcaggcaggaacatccgagccaggagcctaagcccagcacataacaacatagccatgggactgcttcttcagtcctgccctgaagatctccatcagctttccacttctctcctccactctggggactctagaccacacacacagcaaaacaaaccatgtaatcacgttccacatttcttgaacttttcatcagattccctccaacaatagtttcccagcttcctaaccctcagtgtggtgggagataaaagcagattatctgcagtgtggaactgggagccatgtgacacttactcatcttctgattccatgaatctgaacaagtctcattgccacttgaggcttagttttcttttttctaagatggggctatctcagcagactgctataaaaagtaaaagaagcaaaaattataaagaaattctataaatcctgaagtcaagttattattattaaaatttattattatagatgattaatttataggcattttgcatctaagccttctcccactcacagatgcttaggaggtagtcttggaatcacagccctttagatgtggtgcacctttctttagaaaataggaaaagttctgtaattccatgagtaagccagaagataaaattgaaaatatagcatatcaagcgtgtcctctatgtctaacaaggctgttttgtggaatcatcatacaatctataataattctatacatcaaaagcaaatatacatgatgatcatgcattcaaagaagagacaagaaaaaattgatcactattaacatatttccaaagcaaatctacaaaatttccagagcaaatttattctctcaccaagaataaaagcaatgagtttccatatgagtaagcccaggactttttaaaatacaattttatgagacaaagcttacatttctaaagatcttccaaaatattcctattgcttcctcaaatgcagagactgcctcacttcctataaattgtttttctacttctgttcaagaaaaacaaattcattaaaactttaaagacttaatctcgagttacgtcttgatgagatctctgtgggatgaaagaaatcaagagatcacaataactgctattttaaaatgttcctacaatggaaacataatttgttgttgagaatgcactgctgtagagagaaccgaattttaaaaacatgttcaaaatatcagtttaaaccctaaggtgggtttctgaaaagttaggggtcttactgtttttttttttttaacaaaaatcaagccaaatatcatttaattaggctgactttgtagttcagatatgagtcatactttcaaaagagaaaatgtaatcaaagtacttcctataaatgtaaaatatcacctgtcatataaatctattcttgacccatatattggccaaaactatttcaatttataaaaatctaactcatattccataaatcacatgattaaacattatttcacctttactgtcaactttcttcttgaagtttctatttcctacgatattttcttcctctatgcaaaaggatacgttttataataaaaatgttgaatgagtatactgttaaacactgtgcatctaccgaaacaatgtaaaagaatactgaaatattttgaataaccataatttttataacagcagaaacagggactcagaaagataaggtaaatgaaaatcaacaaaatcgggtaaattacaattactactttgatttattttaccatgtagtgtaattctactccattactttttaaagggatcggcgtatgaaatcaaatctttaaattgtaaaaaaattctgaagatctttaggttttaagatagatttttcctgattgattattcttttcatgttctggtttgaggtaagaaactaagttatatagaaatataataaaaacacccacatcacttaaaatacctagatttaggcttaatcaattgctttgctctttccagagagggtctcatttgaaaaatgaaagagtaatattgatgacctccaaggttcgtggccactcagacattcagagattctacaaacacctttccctccttgattatgagtgttaccctttgtctgtaataacttccgagtcaaaacatacatcattttgtagtcaatcatttgtactattgtttctactcaaaataaagctaaaggttggacatgaataagcgtgtaattcatacggatgtactaatagtctagatacaacaaattaagtggcatcaacatttaggcaaatattctagtgtgcctgactaatacagccttttcacacataaataatgactcaaataatgactataagtacactcttttctcattagaaagtgcacaaacagaaatgttctaaaggctttttcatggttcaatgacctcatccaactttccagttcagggtctccaatatttcattttcaaagatctacagtccacacagtgtctaaggggcccattaaccctagctgcctataggtcttcaataatgctatacggtggtcattgctgaagtccaatggcctccttagcctatgccttcttctacaagttacctcttctactctaccctatctctgttctaattataaaataacgatcacaatgataataataataccaatggttaaaactttgacagaagacatccagttatttacactagttgatgttactttctgctgtgttgcaaggaaggtaggaaaaaaagtcaactgaatctagttctagtctcaattttgacaaaacctagttgtgtaaccttagataaattacaaacttgcaatggctccaggatttctcatctacaaagacagagattttgctgcacaaaaaggatccaatgtgcaccctggccctgaaactgtgtgatgtgaggccatacctagtcatttcccatgttttcattctgtgttactgtcattttaaatctgagccctttgccatgataatttcaggatccccactgtatttatacagcttcaatactacacatatcagaacttggttagctaagaaaaaagagaaggagagatactcaatgtgtcagccctgaaatcagaaatacaaccgtggcctttcccatcaaacacttgccttagattcacttcctaagcctcactcccctagaaagtctggtcaatggaacatgtgtctcagtgacagaaattcagagtggaaattctttatcaggacaaattattccacttcaccactttaccatttgtgagttactttgttagttcacaatgatatggcttaggaaggctagtggtttcaagaatcagtcaaatattaagtgaatacaacatcaaagtgattataaaacagattcgaatagtttttctttttggtgtttagcaacttcctcccaatccaactaaagattcttctctggaactgatatgtggaaggtgctatctctctataaatagacttattccatgctatgtgaatcatggctgctgacagcaaatcaacagattaattatttggctttgttagtgaagataatagcacactatcatcttcccaaaatgtttttacacacaccacatgcccattcttctaagctaagcttcagaacaaactgaaatggtatacaaatacacgcaggttgcccttgcactgggaatgtcttaataggtcctgccatctctctgccagattgttattttgacactttagctaaaggaagtcaccagtcaggatcctctctgataagatgaacactgtgtagaacaaaaagggaggcaaattaaacgaacactgaagaaaacaataaactcagaaactgcctcaaatctctgttttctaatgagatgctaaggaagagcccacaggaagcagcaaatacagtccttccttcccatgcaaaatgaagccatgcaaaagtaacccattgatcatctccaagtcaactccagagatcaggatcagtttatgttacccgttcacatatatccacctatcattcttattatcttgttttttagaagaggctgactaggatcaactcaaaaacgtcatataattttcccaactagagtgcaagcacgtacttcagagattgagatataaaagtcacattgagttcagaaccttgaagtcctctgtagaccacataagccctaagaaaagaaggcctccaaattatccctccacaacagaacaggttattttattttccactaggtgagttactttgtagaggtaattcaaactattgcataaatcttcactttataaaatgaacatgctatactaattggacataaaataatagagactaatagctcctgtcttgggatcataattatttttgtatactcctgaaatttaccactttatcatcatcacaaaataagaaaatgagcctagtatggagtggacaatgtcatgaaaacccaacggaaaatgaaacagggtcgcttcttcacaaggcttaaccccaaatttctgagctaattctgagcccgacttgtccagacttcccaagtgtcgcccttcatccaatggacccaaccatgtacttcattgctggaaaccaacagcacgccacagtcagagttgcaaagagacaaactagccaacagattacagggcaggctccctttccagacagtatttccttccagttgtccacaataggggtagagtatctgcagaatgcaaatggctctgcagccacaacccagaaaaccaacagtctgatggaagcacagatctctccgcaattctgcttccattctctcaagctgggtacactggcctggcttgacctggaaatcatcatgtcaaaactttgggtatccaatttccctttgcaagtagagacacatccaaaagcaatcatctgcggtcggggctgcagaagagaattagcttcagaaagcccacgccatgaaaatctctgatcaagctgaagttttctttacactccttgaggccaaactgtgtatactgtcttgttccctcaatgtctcaaaagtgtgagtgtgctaagtatggtaataggacagaaacgttaatgagcagagtccttggaaacaatgagaggggttggaagaaaataataggaaaatgaagactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaattaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaagagggcgtcccctctggggagcccactctccgggcttctactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctcagctggagtgctagctccgcaggaaactcggggcccgggcgagagccaccgagatggcaggtgggacgcagagcccgcggcagccagagttcctcccgcacggcccgccgacccacggaagagcgaaagagcgcccaggtggggccgagctgggggccgggcccctggagcgctgggaagcacagcgcgctctagtcaggttccctttcctggagccctccgcttccagactcccttctttcctccctccctcccgccacccctctccctcctctctgtgtcttctgtctctccccttttctcctctctacgcaatcctacgtgattgaggtttggatgagaaattctcagaggcagagcgagggaactgcagcttgggtctgctccgtccggtccctcccacaagagaaacacaaccacagtgggagttaaaggaccctaggtgcgcaaagaagaggtgggatgggggagctgagaaaatgcagtccacactctctccaataagcttgagcacgtagaattctctgtttagttaggaagaaagtgaacactggagaaagtaaaaatgacctcttggaccttatcgtgggccccacctatggctcattttggaacaggaaaaagtgtttcccttcttcttggaacccagatttcttggttctgtctggaaagctgcaaagcaggctcagtccctaaaaagagagcccaaataagcagcctgcacagaggatgactccaggtgcggcgagggagtgatgtggacaaggacagtcaacaacaagctgtggaatgcaatcaggtctccagacgtgaatgtgacgacatctgatgttggagacactgggcagaggagttctccaagttaaaatgcagcatgaagcattaatcaccctccatttatgctaaagtctgggagcggctattggtttctacttacaatttctcttcatatatccctaatctctctccttcagacacttcacgaagcatctaggatagtgcgaaaggattaaatgtatgatttccaagcacagacaggtgtatgttggcaacatcctaatagaaggcaaggaaaatgcaggccctgaagctactgaaaatggatgtgggacccagagggaacccaggagctttctagatatgagcacaaacctatgggcctagccaagattcacttgggcaataagaaggattgagatctgtgacgttgttcagatcaagcaggagtctaacaccctaccatgcccgggggcctggaccttccaggctgccagctgggcaaagcagaggctggcagatagaggctcatgggacaaacagctgggaggaggattaaataggcaagacatcctgaggaaagggagaatcccagctgtcatttgggaagcacacatcccctgcagcagttcaatgtggctgaatgaagacagtggatatatccttggaattctagcaatacagaacaagacacgtgaaaaagacacacgcacacacacacctcaggtccaaaagcaaggctgaatgcatttccatatgtgcatctggatggggtgaggggcattacttaacatcaactggtaattctatcaattaggaaaatattcacattccacagataaaattattttccttccttggctactagaagacttgtctcattcttgagcaaggcagacacagatagtacagtgggctttgggggctccctgtccttgctattaaacacccacacagacaaaggtcagctaaggggagtagccagagaaataggcaagagggggtgtataatgaggacttgaggaaattattgctaaatttggagtctcttttatattctcaaaatggggataatcattctcatctacctcgcagaagtgaatatgcatgtgtaagcattctgaaaactggaaaatgccaaatgaatgaataaaatatggccggttttttttttccaaagaaaatgcatgagattcacctgaaatgcttgttaacatgctgattcctgatggtctctcaaaacacgaagtggaagtctgtatgggtagagcctgggaatctgaattcttcacaatttctccaggtgtcaaagtgtcagagtttaatgtatgtttgcaacataaataatactagaagacaaaagtaaaatatagtacatttctccagaactgcagtcctgtgcaccgccaccctgcgccccctataaaaggcctggaaagaggatgtgtattctttagtctttgtgttgctgatttttttctgtaggtttatgagatatgagggtgtgctggtgcagaaggtaacgaatacagaggcacaggagagaaggaagttatgaggaaagatgaaaaggcaggtagctgttgctgtttgaagttctcctctctgtcttaacctgacaacatcaagttaggcatttaaagaacagaacaaaaacaatgtcagctttctgggagcaacattctttctgtgtttagatctctattaaaagaatgtagtgttttggattcaatcggacaacaaagactactttttccctcgcactcctgcagctattgtcagagagctttttggctttttaagtcatcatcagcataatttactccatttccccagtgagaagaggtgagtataaagaaatttaagaagttagctaagacctaaatatatggatattgagctcagaagcaatgcttaaatcaatttattttatatatagaaattcgtaggtttcctacctgggccactaaatctcataagtctttctccacagttactcgtacatttccaatatctttgcattttgggatcaggaatgaaattaagccaacctactgatgatttaggttaaactaacaaccaggtatttaaagggttatgtcccagggataccaatactttgatttttatgctttctttgaacaacttaagaatttcttattcctattctgaagacattatgagtggaagaagttttaattactttgaagaaaattgtcaaatgcacatcaaaatgataattatgtagttatatttagttatatatatatagtctatgtttttgggctctagtcaaacaaataaaaacatgggcagtcttaattatctccacattttaaaaggaaaaacagaggctttttggtcttttgcttattcataggccaagtctttcaacttccaaatctactattagggctagtttacacattcattttaaacattgcattgtccacagattacatccagggctctgtcagttaccgtgaaattccagacacttccacattctctctgccctcaacaagcttccagttcatgacattatgaactttcttggctcttgttttaatcgcccactagctgtatgctgttggacacgttattcaacctctctaaactacatctgcaaaatagatacataataatactagcagtacctaactaggctcttgaaagactcaaagaagatgtgataataacgtaaagtatgagaatgaccatgctgttattaaaatctccatttaaattaagtccctgccataaaatacagatttcctaaaacaggaaaacacaccttatgattcatacacatcatcattcactcttggaatgtatttaacaaaggctgaaaatttacttgaaatgaatgattaaccttgacattgtcatggcaaacagaatttcattagtggaatattgtcagtgtccttgtcttgagaacacaaagaagtctagctctgctcatacatcatcttgctctgagatcaggcccctgactcaaagtcgggtgaatatgagctcactgggctctgccacagcaaatggaagaagaccttttctccatgaattttattatataaagtagctgtatttccacttgcttttttctgacatattgtcagttacagtaggctgacaaaagcaatataaagaactactttctaataatttgtaaattcctttatatagcaaatttattcatggtgctttattcaacaattcgacaactgaattactacatgttatatgtccatctggttttgatcatcttccaaaacagaaaagagaacagatttaattcctctttatgacatagatgaagggtggtatcattgcccaaaaagggaaattttcaatgttctggagaataggtattttgataagaaacatagatgtaattaatgtgagccaatgagaagtgccctacacacttataagtgcattacaattattgacacattgaatccttacaacaactctatgaggtaagttctgtcatatcgccattttataaatgaagaaaccaggacagagaggttaagttgtttaaccaaggtcacccagctaagaattgccagagttcagattcacacccatataatttatttccagagtttcccttttacctctgtgctatacgcatgtcaacaaaaacaaaacaccatgaataattacaatcatgtaataaagtcaataaaataagaatgtgcagatcacatacatttatgtaactctttactaattacaaatcatcttctcatgtattatctcactgagactcttcaacaatcttatgatggaagctaaagggaaaataataattcagtttcacaagctgagactccaataagtaatgtgatcgcccaaggtcatacaatcaatgagtgaagatctatgagtttaatccaggccttttaacctcaatgtgactactgccctaactaaagtaacctggaggggaaaaatgagaatgccaaatgtacttccattcactagcttctaacatggtttcacatcttgtgaatgaccttgaagagatcattttgtgttggaagggagaggaaacaagtatccccaattctctccccgtgaagctctttcctttttctagatgaggaagctactcctggttttactattgttggccaagatagggtactatgttttctttggttctaggagggtggtcttgaaacactctccttcttagtttagtaattcaagtcgagctcaataagaaaatcaaagggaaactaagttaaaacagaaagtaaagaagcttataaggggaaaaatataaatttcctccattttcattccttaaaaatgtacattggtttggcttataccacctaggagatggttgatacttggttattttccttcatagctgggttaaggatgctgaaagacctgtcacaacagaccgcccatcattttagccctactctaagtcccactgtcactaacccagtggcaccttttccttttcaaagagaaactcggctagaagatccctatttgaatgtaatacccataaggacagggccattgtctattttgtttactttcttatctctagtgcttaaaataatctttgcacatagccagatactcaaaaaatactcaaataaatgaattaattcatcaatccatccacccagatttttgagccaaatagatgcatgggtcatcccaaagtgaagaatggggtatcaactctttgtatcaggaaataagctcaggtaactcaagggtagcctccacatttccaaagttgattgttttgttttatcaacactccctaaaattctctgcctaaatattaaatctgatatcctcagagggtacatggtacctaggtttctgctctgatcacccccatccccatatctaggcctatattttcagttctgatacttctcttctctctctctctcacacacacacacacacacacacacacacacacacacacacacactcatgttcacagaagaaaaggaatataataaggcaaacagagagccacagacatcaggtaaaatgagtaggcaactttaaaatctcagaatatgactaaaatgaccttaaaatggtttaataatcttcacattcatactgtcacccatgttcactgagattctttctccatgggccattcctagttgctctcatttctaaatttagattccaaattttcagggaatggatcttgttgaaatagcagtctcttacagcacccagcacatgactgacactcaaaatatactattaaaaccacaataaattcatatttttgtcctctgcatgcacacagcaccagacactgtgaaagtaagagacaattaatgagagatctcactgatcctgcattcacaggtatctgatgttgagtaagattttactggagataactgaaatatactaactgattagaaaaaatctgtcagaggatcaaatggaagtttggacaaggtgaccaataggacatttcttgtcctaattttgtagaattctctaagagtaaaatgttaagtacaaagagtatgcaatttagagtagataagttgtccttacataaagctacttcgtctgcctgagttgaagtttatttgcctgtgaaacaactacattataggacctaaattggtgaaaataataggttgaaattatggcactgatttgtgaaatgagaaaaagtgtgaatgaataaatgaatgaacagatcagcagatgagtggacagatgtttgtatggaggaaatacagcatatttcatttaaatatccctaaattagcattgttaggctaagcgaaattgctcccaataaaaatttaacaagatgtggagagcttgttagcagattaaaaacattgaagaattctaggatagtacatgaaagcatgtaataaaaatccgtcactcacttaaaagtaatttttacataaaacaatattcccctgtgcctagtattagccactaatccaacctgcaacatgacatcaaggaggcattgatgtagatgtctgtgtgtctgcgaagtctacagccaaaacagacagacagatagatatagataggtatgcattttggtgctcagctatccagaaaagcaggtataagataatgtataagaatatttctttaaacagtatttgcagcaggaagaaacaatatttttccaatgttttggacaggataatcatatttaaacttgcagtgttaactgcaagggatctcatgaggtcatcagcctactctaggtaatgtatacacattgtagtaagctagcaacagtttaagagaggagatttatttaaaagtaggctggaaattgtctcctggttggttgagtatgctaatggcatggcaatggaaaaacagcatgatcctcattgcattttgacagttctttctctcatttctttaaaaggccatgaccaggaaatagccgtaactggcctttaaaagataagtaaccaaaagcgtttattattttgtaaggacaaaaggcagggaaagaatgttgacttcatgccaagagaagtagaattcattaccaaaaaaaaaaaaaaatgctaaaaatgatctgtgtataagagtagacacagaatttaagggtaagaatctgacttagaatttttgttcctcctgtaagaacgtagtatagtgtttggaatataagatagacactgtaagcatgtgttgatttttaactttgacttaaaaataataaatgttcaggatgaataagaataatctcaatgtcaccttaagcaaaaccctaggcatgcttttattaatagtggaatcacctttgatctctgatagcatcagttaagtagtggctattaaaacaagaaataaatgtttgataaatatggtaaaaaacaaatggttttaatctaggagagtttcccttatctcctttgtacatctagcagatactgaacccttgataaaaccctgctgcaaccctgataaaaccctaaggtaaacccacaccactctagggaagggaaaggttatgccctaagtgagggaaacatcatagtttcaggcaacagctaagagatctgagccttggaaggtgcatttaaactcaaaaaagaggatgtgccttgttcttttgtgcctggattttgaataatttgcccatgtttatggttgtgctgacagacaaaggaagaaatcctctaccaagcagaattaagccaggaactgcacaggaaaacaatctcatagggattattttaagatattagtctggagttgtggactccaaagagtgaactatatcaagttatgtagatgttagatgcaaattactctccacattgtaattttctttgttacacactggctttcaataaagtcttatgttaatgttcctattcagtctctcttttgctgccggtaattaataaaaaagttaatatgtcaatgcttaggccaggagctacatactacgcagcaccatagaaataacaaacataattaattagagtctccaagctgtatctctggggtgagttagtcctcactacaagacactcgttcaacacagactatggagaattaacagtatgatgtcagtcaagaagttgttgggttttccttaccaagtccttatataatttcaggcaaatcctttgaaccacagaaaaatatcaaaaaactctgcgttccaattataggttaaaagtgtttgagggacacgaaggatagggtagggaatagaagggacattgatctggtttgaatctgtgtccgtgcccaaatctcatgttgaattgtaatcccagtgtttgaggaggcgccaggttggaggtgattggatcatgggggcagacttccctcttgctgttcttgtgacagtgagttctcatgagatctgactgtttaaaagtatatggcacatcccccctcactctcttgctcttgctccagccatgtaagatgtgactccttcctctttgccttacaccatgatcttaagtttccagaggtctcccaagctacgcttcctgtacagtctgcagaaccgtgagccaattaaacctcttttctctacaaattatccagtctcaggcagttctttatagcaaggcaagaacagactaatatggacattaagatttattagacaccttctacataccatgcacagtcctgggccctacacaggttattttacctaatcctcacaataaccctggcaaggccaacactgttattcacatgttacagtgggaaagctaaaagtcatagaaagttgattaattgtctgaaatatggggtcaggtccagaattcaaatctagtttagctcactccaaatccaaagctctcttcatgactttttttaggatgatgaatccacaaaatgaacttatgaggacaattcatattcttgaagtgttaaaaacaggtaagataacatcatttagggccacccacagtctaagtcaggggcatccctgctgtttgttccttgttgatcatgaccccatttgaaatactagttaacaaatagagctggggaaagagaaactgaggaaagtgaggcctatgttcaagtgtttgaagaacttgagtattgtgtgtgtgcaagagattcacactaagaacaagatatcctgtgtgtgtagaggcaaacttggatgcctctcttccacccatggaatagattacatcgcaaaatgaggaagtggttttcccaccatcagagactttccactcaagatcaggagcaataccatgggaagtgggtttcaagaaatcagacaggtattctataaaatgattaaggtcagcattgctgggggtggagagtgaatcaaaatcattataggctgcatccaaggcaatacttgggaaaacttttgttcattttaaaggacataaaaaagggaaaataaggaatcatgaatcaacaatgaaactgattgctggggatgtgggagaaatgacagaaggatggaagattcaaggagatagtcacggaaagcacatctttactaacccggaaagaaagcacagagctaaacacttctatatggcatcaaatgtgtattgtaaaggctggcataattgattaaataagtagatttttaacacatggttgaaaacctaaatgataatgttcctctgagttgtggtatttgagaataagaaaaagaaaacatattaacctattaagttgtatgtgaggaaagctcccctggaaaggccagggtaaaaagctactaggttgttcgtcaaaactacagtggattctatggaagatggtcattgactcttttggattcttgtgtaggaaagatcccagtttggggtaaggcacctcaaaataaccaaaagccgatgagcttaaaggtgagcacagaaccaaaggaaaatggtcgggggtggaaatcgtgctattaggagctctgctatggttccctcacatcaggccttctgcaggttaagtgttaggctcatattagagagtgtgaaaaggaaatacttactttaagttgcagtcatggttatttcccacgagatctaccaattccactaaaagtaatcacagagaaatctggagactcaatgatgtagttcagatgttaatcccctccaactcttatgttgaaatatgatcaccaatgttggaggtgggacctggtgggaggtgtttgggtcatgggagcagattcctcataaatggcttggtgccctctccacggtaatgagtgagttctcactctgttagttcatgtgagagttaattgttaaaaacagtctggggtgtaccccctctctctcttgctccctctctagccatgtggcactagctgttcccccttcgccttctgctgtgagtgaaagcttcttgaagctctcaccagagacagatgctggtgccatgcttcttatacaatctacagaatcacaagccaaataaacctcttttctttataaatgcccaacctcaggtatttgtttttagcaacatcaaatgggctgctacacttaattattggcaaaaagaaagaaatacgtaaatctcagtacacactcacagctcatcatatagtatctttgatttcatttgtcaggaagaaaaacaagaatcacaatttggaaaaactcaaaaccaattggagaaaactgactacaaattggaaaaaaaaagtcttacaaaatgttttatcaataaaatgctacaaaacacaatgaagggggtggagagatattcgacgagaatcgacagtggccactacatgcatgaagttaggagctttaaaaggcaaccatcccatttcctgcttgacaatgtttaactgactccatgcacagtattatctttaaaattagaaagtaagcatgtgttccaccagtaggtgagaaagttgtgtgaccatagaaaggtcacttaacctctgtacatcaatttactcatccataaaatgagaaattgttaaaagaataactgatgatctttatgatttaagtcctttaatgaagattacttttggaagggttctggaaccatgtgtgacactcagttttagagagtctaaacaataagaaaaaaaagtatatagtctagagtacccaaatattttcaatgtgactgcttacttgaaaaaaaaaaaatggctttagtagctgtagcaaagattgtcagcatggaacactatgcagccataaaaaaggatgagttcatgtcctttggagggacatggatgaagctggaaagcatcattctcagcaaactatcacaagaacagaaaaccaaacaccacatgttctcacttatgagtgggagttgaacaataagaaaacatggacatagagaggggaacatcacacatcaggacctgtcaggggatggagggccaggggaaggatagcatcaggagaaatacctaatgtaggtgacgggttgatgggtgcagcaaaccaccatggcatgtgtatacctatgtaacaaacctgcacattctgcacatgtaccccagaacttaaagtataataaaaaaaaaaagagtaaatgactcatctcaacgaaactctcttgaagctgctaagttctcccaattttagttcaaactgaattcctctatctctgaataagtggtggtggtggtgaaggaaagaaatatgaagatgtctattaactggggagatggcccaaaacaacataaagctgtccctgtcatagttggacttcaaaggtttttgctttagtttatttttttttggcttttggtatttttttttcctgtgtacaatttctatatagataagaaatcttagataactgttggtgaacagttttgtaataatttggataaaagacagagataattctatagtgaggagagtcaacagaggaaatacattctaatggatttgtttctagcctgagctgaatttttattctgatgttacttactcagtacggaactttgaacaaattattcctcttttttggtctctatttccttattcttaaaatgagattaaccagatgattgctaaggtctctttctactctaaaattctatgactctaaatatagtgctcaccgacatcatattacttaaacaaaacaaagtaggaagcattttctgtcatcttccaaagtaacttcagagtagttaactaaagtgaaaagagcattggttatccttctttccccaggccattggctagattccctcagtccccagaagaactaaacctgactcattaatcttgtgccacaaagcccttctctataactctggataaaggcaatattatttaaagctaacatttttcaagtgcttatcatttaccaggaactggtctaagcactttatatgtatcaacttattatcacaaccaccctattaaatgggtattattgtcaacacgtaaacagaggaacaaaaaaaagtaacttggctaaggttatacagctgtcaaagggaatgaccatgatttgaactcagcaagtttgggttcagcctcttagtaattgatgaatcacatttcagttatgtggtcccagtgtagtaggagaggaagggtgctagttctggtgctagtgatggctatgatagctcttcttttttgttctatatgcaaagaaaacatgtggctgggcagggtgggaaaacctgatgtgaagaatgctctcagctataagagttgggagcaagcccatgctttccccttccaaataccggaaaatcttctaagtaagccttgatatgacagctccgtgagtttataatcctaactgagccctgtaatagcatagcatctcacttctacttccttgaaaattgtgggtaagacttaatcctgcttctgaagcagaatcaggcctaaatgtgtggctcactaattttcttttttgttagagagccccctgttgcataatttgtgtaattaaagtatgtatagctttgctaagcaattctcctagagccactaaaatgtgtgagtgttttagaaattatattggcataaaataccaacctctgattttctttttggagtgttccatcttagggagccattttataagtatgtatctagaagagcgacttaacacagcattaagtcgctaaattctcgggtttttcattctaatgtataactgctgttagcttattgagagagcctgggcaaacagcttaaactttttgtttcttaagatcatttccaaaatgaatacaacagactctcatgacaaagatttacgtgcaaagatttagatatggaatcaccacatacaatacttggaatggaaagaactttaagaattattcaggcttatgccctcattttaaagattatgaaattgaagaccaagaaaggtgcaacatgctttaggtcacacagttcttggtagcttaagcagaaacacagcctaggcctcctgattctacgatcagtggtttctctggtataaggtttaatttttctattaaagactatattttaggctttttaaaaaagttctaacaaaagctagtaggtacaaaatgacacagtttatagaagcttcccattcaagcctcacaaccactcagtaagacagttactagttattatcaacactcactatatgcctaatttatagatgcataaagagaagctcaggctgctgaggaagtggtccaaggtcacactagcattctagctctgatctccgaaatttgaaatttattttcttcttcggaccttttcttcaccccgccctctttaaatttgtttcacgtcagatcaaatgaattataaagtcttcaaaaaaaaaaagactattaatgctttccccaaaacgtccccagttagcatataagctaagcatttcttcactggccacttccccagatcctgttcatctgacatctattttcaaataaaacaggattccttagaacagtaggaatttctcacactggtttattgcataggaaaagagagtcataattctttttgtaaccatagaagtatcatcaaaatacagaattatttgtaatgctaatgagaattttcttcaccaggtagtgctgtttgcaaaacatctggtgcaccatgccaaaaatacataggagctgaaaggcaggatgcaaactttgcctcaggatcttctccaccaggtaatttcaagacaggcattgcctttaatatatgtgttagatgttgcagcatctgatagtcacataactaatttctttaattagttcaccccttgtgcatcttggcttcaaggattcaattaaacacaaaacttgcaactcagtgctagagtattcattaacctgcaagttatcttttaaaacaactatagtctagggaaaatttcatgaagatatgaatttgcccttgtcctgaatatatataatttgaatcacatgccacaggaggagagtctataaacaacgtttattcttagcaatgattcaccgtacacacagagagacacacacacaaacacacacacgtatctttacatcttaccaatttctttgtttacctataataaaactttgcaataggccatgttttttatcccttcaccagtcttcttgcctcagcattttataattttatgcatatacaatatacatatgtttataaaatatgatacatcctacatacaagatgcatacaaggtgagttgtcatgcatacacatatttgttgttttatatgtatactgcatatatgtgtgtataaaattttaaaatgctaaggtaagaactggtgaaggagaggaagaaaagcggtctcctgccaactttttctaccaaagcatttatgtgcttttccttttacatccatccctcagtcattgggcacttaccacatgccaaactgcttatcacatgggagacataaagaaataaaacataatttctctccttagaacgtactgtctagtggatggacctgatattttatgtaatagcagaatgaagcaaacacaaatgaaaggtgggctctgtgctgggatgttcaggagagaaggacactcttctcaattacaagggtccttacaaggtttcaccatggagtgacatgagaactgcccacttaaggaaaagtgggatgcagtctcccaggaataagtctgagaaaggccttctaaacagacaggaaaggaaaagcacaaaggtgtcaaacatcaaggttatgtcaggctgtggaagtcctccagggcagcgatcctatgtgtctactatcatttctcatatgtcaaactcatgattaataaaattaaatcaatcaaacaaaacaataaatgaatgaacagtgtttggagagtgttaccagcttattgggtcaagaaaataagatatatggagatatatgatagaaatcataataaatcactagcgaatagaatgcattgctgtggaatttgtgcctcatcctaaaggcaacagagagctattgaaagttttttaagagaactgtgatagaatttaatctataaagtcatgtactattgtagcttttaatgaaaataattggtttaaatgtggtacaacagagtagtaatcagattcattcattacattaaaattaaatagtattaaactaaatttcaatacattaaaattacatggggatggaactgtcttactacaactttcttaaatggatataaatagcacttgagacaaagctccaagagatcaagttcataggtgttacacttactctcaccaagtttatagctctttacaaatgttattgaaaagttatctgttttcataagtagaaaaacacatataaatatccacaaactctcccacggctatacataacacacagcatggactagtagtgtaagacctggatttggtgttgttattaccattaacttggtctaagatcctgggcttttcctccccttgctaggctccagttccctaatctataaaaggaggggggaaatggtgccctccatggtctgctttagctctgatagtctgtgattccaatgtggtctctggaatggcctctgttagtttccacacttagcacagcagagggctagggagtgatgagcctcatagtattgtcagagggaaaaatatcacatccttttctttactcacctaaaattgaacaaatacaggtataaagtgaaaaatgaggcaggaagctacaagggaacattgcattatgtttaatgctacttttgaaaatatattaggcttcaaatttggaaatctgtgtagctcttcaaacagatgttatattttaccccagagatgaccccattttagatgatggcaatccagtatgtataataatattcttcatcaacttcctaaattacttgagagttgtaggagataaaaagtgtaatacaaaagaaagatggtgacatcccagtaactatattaagagctagagagactgtgagcacatttacttttatccttagctatgtttgaaagagagacacttacataagtagtatcaggatttaaaagaaccaaatgtctcaagagtagaagagtatttgacttgtaaccaaaatcttgattttaaattttaattatttaagtaaataacggtagaaacgtaggttaattactaatttactgtctcttagtttggtagtcatctttgaaacggaaataaaaatacttactgatacgattattttgaggtatacaaaaatacattatagtaattacttggcatggtttatggcacgcagtatgtgctgaataaatgctagctttttttcctgggacttttcaataacgtttgtagagcactataagagtagaagagtgtaggctgggcatggtggctcacacctgtaatcccagcactttgggaggcagaggcgggtagatcacgaggtcaggagttcgagaccagcctgaccaacatggtgaaaccccgtctctactaaaaatacaaaaattagccggatgtggtggcaagcgcccataatcccagctactcaggaggctgaggcaagagaatcgcttgaacccaggaggcagaggttgcagtgagctgagactgccattgcacttcagcctgggcgacagagcaggactccgtctctgaaaaaaaaaaaaaaagagtagaagtagaagagtgtaagttgtttaacactttctcatgatgtacgtagtagtgccaaacatactctaggttctcaatgaacataaaacacagatgaatttttaaattagcatgaacactttgacatgtgatttgcattatctggataggacaatctgacgttaattctaatcaatatggtaggcatttatttcatttagtaaataaatacaaatagcagtagagtggttctcacatcatttcatttagtgcccagtagtatgtgtttctggaaagatgtgtaaagagacaattttttcaagagcagatactgagaggctcttgaagtgcattccctggtaccattctgagagagcatcaatgtcactaagacttggcagcagggagcagcactcatctgtgtgacttccaagaaacacagagacagccacttactgcagccaccagcagagaagtaggtatgggggacacagcctcttctcatgcctgctggcatctgaaacaatatccctcttgattttgtgtttgcttagatcagagtgcagactcaaggcactcacataacctgccactgagaatgtcttagaacttcaactgtgctttgccaaccaaagccaaaggatgttaatattgtgtagcaagttgggtcaggtagaaaatgcttttcttattcaagcccttcaagatctttctcaattgcaactttcttgtggtctcctaacaggatccccctccgccacccaagtctgaatgtcaaaagcactttctggttttgccaaaggaaaggcagcttcctaccttgcattacattgatttgtgtctcaattgtgtctatctcctctactcgaccatgatttcctagaaggcagggagtctaaattcctccttttagaaacagtcagtttaattaaaggtgtgttagagggaagaatcaggagaggaagaagggaagggggaaacagttcacatgtatgaaaataagggaaataaattactatgtctgaaagcagccactctaataatgatgttgatttttatactcctgacttgtcaaacagataattatgagaaggttccatctgaaaaataaattagagtatctgggtcttaaaaaagaaaaaagaaaaaacactgcttggaatgttattaatatataaatgatctaaaacttgacagtgactcttctcttgggttctcataattgggcaatgcttcggaagatggtagaaggaagtccaaatctgggcataatcccgtacttccccagactggggacaatgtcagactttgaaacagtaaaatatgagagaaaaaaaacctgtatattttacaaactaacagaaagaaggagggattttatgaatcaattattccagcaccttagctttagatgaaggatatgaggttgttcctttaagtatttcataggctttgaaagctctgtgagtctgcatatggcaatccttctgtctggaattacttctgctgtgtttgacccacctccattgccgtcttttccttgaaaccttctctcattcctccagtcagtttattcatccttcttaaagacccatggatcacttttaaatacttttatttatacactgatatatgttggctttctcaattagatcatgaatttattttgggcaaaaactatgtttaccctactcaccccaaacacctagcacaatgcctgaaaaaaagagtacttcacaaattaatattgagttgaaatatttaagttcactggaagagatgagggaagaggacagcatcaacttacctcttcacgaagcttaagacatctgactcttgtttataacagccctcgcagattaataattttaaactgtaaagcacactggcaccacttaaagactggcttgtgaaggatcactcaaagaacaggccatattttgatggaatggaaggaggagcttgtcctctatactgcagtattttggaaaaagaagtggactgagaaaaatgcagtcctttctttcttttcctaacttccccctccaacatttttctcttatttctccttgtcttcctttatgtgctcctcctctttctcctttgcataaagtattgatagtcatatccttaaaatactacaaaatctctctgctttctacatgcattactccttctctagaactatgtgcctacactttacccaaaaggccaagtgtacttcgtgatggctgccatgaaaaataagaaaaaagaaagctggttagatattaatgcacttgtgtttaaaccacaatgtatgttactttttgtgggggttgtactatacattggtgcttgtttatcttggcaaatgaggtaaggtaggtaacaatatttatagatttgagaagatatctcttaacgccattctggaaaaaaaatgcagctggtgtattttgctagaaaatactctcaaggaaaaacaataaggtaaaaggcccttaagatatttttttgcaacaaacaaatacacttctgtatagatataccagatgctttcttcaaagccacacagagtagattttcaatggtaataaaatgcttgtctctgttgccactattctattttagttaaatagcattagcaattttaagataatctcattttggaagtattataattaccttaagaatttggccttctctttgcttgcatatgttcatagcagcatattcacaatagctaaaaagtggaagcaactcaatgtccattgatggaaaaatcaataaaccaaatgtggtatgtaccaacaatggaatattattcagccttaaaaaaaaaagggaattctgtcactatggatgaacttgagggcattatgccacatgaaatcaaccagccacaaaaaggcaaacactgtattattcttcttgtatgaggtatttaaagtatcatatccacagaagaataaagtagggtggtggtttccaggagctggataaggggaaaatggggaatagctgttcggtgggtatagtttcggttctgcaagatgaaaaagttttggagatccattgcacagcggtgtacttaatattactaaactgtacacttaaaaatagtaaagatggtaaagtttatctgttttatctcaatgaaaaataaagaactggatcttctttgaaacaaaatgcctgcaattatttcaacctcacccctgccatttaggttttgattaccactctctaaatagttaccacacaatgtacaaatatttctcaaagtaataatcaagttggctagaagacattcaattcatttattggggtcctattatgcctgaagtaatgagtttggccctagggtgaaagggggaatgagggaaggcatttcgccaccatgaagagggtagtcttgggtgggtcttagtgaccacaggtaaggaaagacatgactcctgttgatacggaatacaacaacctgcttctgtactataaccagtgtattgggagcataattgttattggaatttctcaacctttgagtttttcaaacaattgggtctatgctcaatatcaacagtttttaaattccactgaacacttctctatttcaagagatacctgaggttttcatgttaacctcaagtcacaatggagtccacccactttctccaagcaccagatattattttgaagatatcctgtaagccaaaggaatgaaggaacagatgatatgagttatcttgagaactccaacataaatgagatctgaatggagaaattacttggatcactctaacaaaggcaaaaacggcctttaccacccacaatgaatcccagagataagctcgccctacttacacaggagctgggttctgaaaagagaaacttcagcggtacctgtaagcagttgtaggtgaaacctttccatttaaagtttgtatcaggttgattttcttggaaatcaaaatagaaaggagctgattagatcttagctaaaggggagaaacaaaatagctggagtccctgatggtaaagctgtattaaaaagaaaacgtgtgaaggagaatttaaaaagcatatagcactttattcttgtatttctattgccaatgtgactagaaaactaaagaaaaccaagagactctttttatactgttattctacttcctgtaatgaaaaatgacagggagaagtggaaaatcagttcaaaatacaaaacctgctcaacagaaaacaattctgatagaatcacagaatcctagggttggaaggtcaagttgcccaactcaagtaccaagcgtttctccaatgatgacttgtattatcataaagtgtataatagacttgtatctagacttagacttatgtaagctttctattatctagaaatgttgttgaaatactaaactcaacatgtcaaatcagcctaacttgtcccattgcttatcagataacagctgggataacagcattaaccttcaccaggtcatttaataggaagcacagggcatcctctctgactacagcctctccttcatgtaccccaagcacagcacacacatatcaatacacatgtacactatgctgtttccacaatgtctctttgttgtcttttttctgttcccactggcagccctttatccaggcattccatcaccgttcacctcggcagcaccacatagatcaggtctgcttacctgtggcatctccctcttaattcccattcttcaagggacttatttcaaccaccatctttcaatgtttactgacaccagttatgtcccaggagctgtcctaagtactaacaaagatgcaaaaatgaatgatgacttttgcctttaagtagctgagagtctaatggaggtaacacaacctaataaataagtgtactacaggtcagaataaaccaaatacaatcttgttcaaagtgttgtgggagtattgattcatatgatggaaggaatgacggtaaggccagaccttaaagaataagagacattccaaaaacacaacaagattctcgtcccctaaaatgcataccctatataatccactccccttcgacataagtaggagaccatgaatatgatgagatatcactctctggattgtgttgtgtaagacccctccttagcagatcagagagagagtcctaatggccttaaaggagaaattgtcatgttgtgaaccgcctgtgggaagggccatggggcaaggtcctgtaggaactgagagagcattgctgacatctggcaaaaaaaaaaaaaaaaaaaaaagaaagaaagaaagaaagaaaagaaaagaaaggatgtcagtcttgcaaacacaaggaattgaattctgccagcagcccgaaagaacttgcaagaggatctgagctccatgtgagaaccaacagcacggcaaacacttggcagttttgtgagaacctgagtagaggacccagtgaagctgtgtccggtttactgacccaccgaaactgagatatgagcatgtgttgttttgagtaataatttgttatgcagcatgagagaactattacaccttccctaaatgaagtgagtcggggtggtctgtagcattggtgaactccctgagggtaccatatcatctgatttcccacacaatttctagggaatggtacccttcagatcgtcaaacgtgagaatccagctgtcatcaatctcctcccaccccctcgctccaacgcacacatatgttctatccagggaattcctagaaagggcattgattcatcatttttagattcattgtctttgagggcacccccagggaccctggcaccccagtcattgtgctgagaaaacagaatcacagtactttagatatagaatgatccttaaagatatttgggagtaatcttctcctgatcctcattttagatgaaaacaggcccaaagtgtcttctttcacctcctacaaatagtcaactgcagaaggacaaacaagttttgtgtggcctgaagcttatataacttgggaaactctccttaaagaaaataatacaaatttacaaatatcaaattacttaccaagcaaatatttactaaatataagaaaaagaatttagaccaaattgcgcatttgaaaaattaacatcacaaaattcagacacagctttaataccttttctttataatttttgtctgtaaatgttttcatcctgtaacataaatgttaacaatattttctgtaaaacagatgatcagtctcacctccaatgtgactaacttatttttaattgtgaaagttaagaattgttaaattcagctttaccactcattattgctaacgtcatgtaaatatttagactagtatcaaatttgattttaaaacaaactcagtttccttgatttctcaaatatttcacatatgagctaagaaacgtgggagaatttcccacgattaattcctgtacacttcacctccccatggggtatgttcacaacacaattcaatctcttgccatgcacttttgtgccatgccccacactgagtcagcacagtgggcagtttcagtatttctggccatttcgacatcaggagggctggcaatgatttactagtaagtgactgtaaacataaatgataatcctaccaaaaccaagctaaatgtatccccagttcaacttctccttagccagagccaaaactggcaatgacgaatccaccacccttaaacagagaaaaactgataaagcaaatggccgagtggaaaaagatagcaaccttaaccaattgtggaaaaaaaattctcacttttgcaaataaaaaaacccagaaaacaaaacacatgtgaacaccctccgggagcccctcccagaacttggaaggggctgtgcaagtgaggaaagtgaggaactgatgaagctgtggtttgattagcctctgttcagcggaagtgaaggacatcagcttttccttgaaaaactgagacagatcaagctctttgtggaataagaaaaacaaggcatggaaaggttacataacttcccagtctcatagccagtaaagtgtacaggtaaagttgaactcaggaagcctgaatgctgccttcacactttttaccagtgtgctacacagactgccataggagtaagcttgagattgtgcatgtgtgtgtgcaggcatatgtgtacatgtgcaggtatacatgtatgtgtgtgtgtgcatgtgtatgtacctggcagagaggaaaggaaagaagtgttctgtgatcaatcttcatatggagttgacttttttgagttcttgtttgttctccttgattacagttagagtctttaggaataaaattgggtcatagagttgattttaaagtaccataaggagcagttgtgctactcgaaatacagtttgactctgtcgtggttgcaaagccaatctcaaagcatttcccccagaatgctgtttattagtttaaaacccctatgatcaggatattaaaaaaaaaacaagaaagataatctaactcatgatggcttctctatccatttaattgcggttagcagtacatttatccaaccgcttttcaggtctatgcgcatgtttctcagtggtgctgtcttagccattgaagggtttaaagagcactgaagaaaaagtcaggagaactggccttaggtcccattttcacaattattccatctttgacactttggacaactccagctcctatccccgtcttggtctcattttcctcaacagggtaagtgattttacagctgttccaatgttctatgatctataaagcataaagtctctattttctactttaaaccacaaatcagaaagctttagaagaacattccaggctgtgaagttgggggaatattctgggtttatctcagatctttttcatttagtgcaacactagttttttttaaaaaaacttcatttctttgactgctaaatgaagaatgaatttgtaattactgctaaaggaaatacagtgaaaattttaattctgaaattgaaaactacttaaaagagacaggagagcttagcaaaagcctctaaaagagcctggccatctggcttcttactcccaggactgctcactgtgataatccccaggcttggtgatgtcctgaacttgcaagtttcgggaagttggcgatccattttgaccatgtggtatcacagataatgtactggaaacccaatttctggtcccagaacagcattgttcggccagcaggctatacatgagcctcctgggccttacttttctcctctgtacctagtaacttccttaggtctttctctctcagaaattctgttttctaaaaggcaagttactctgaaggatgaaacagctttgcttttctgataaagtatatcaagcctaaatcaaaataagcatttcttctcctgttcttctgtttgggctctgaggatacaatctgcttctgtcgttttcccagtgcagagtaattttcaatgtgttaccatgctaagccttgttatcacattttcagaagcataaatgataaataacatttgcttaaccagcttttacaattccctggcatttttaaaaagaatatttattttgaagaatattttttgaaacaacacaatttgaggaaaccaacacaccacagcgaatacgtctacttctctcagttagcccaagcaattctcaaagttttctcctcgtctttattgaacactcacttcacgccaggcctcgtgctaggggttggagctctgaaggaaacagaagaacgtgacctcaggacaatactgtcatagtccatgtctacaagaagctcactcccattgtagatggtgatcccacttaaattaataaagatgagaagcctcctgggccaaaaattagatactttgttgtagagcagtaccataccagagaggaacattcaccttcctttgcgcctagctttgcctctgggatacagtggtactgagaatcagagcttactgctgtaaattaggggttctcaaatagtcatacacagcagaatcaagtggagggcttagtaaaacacggatcgctgggccttacttccagatttccaattcaaaaggagtcaagagattttagtactagtgagctcctgggtgctgccgatgctgctgatgtggggcccacaattggaaaacctccgttgtaaacgagcaatcatgaataagctaatttgtctggagcaaggctttgacttcggtagttttacaaagctctccaggtgtttctaaggtgtatccaggctggacagccactgggttagattgcacaatgtcagtttcccaaaataactgcatgttcaagatacttttaagattatacatgtttctgagtagcctgtctgatcaacaatttcttgccctgtagattgaaattctaggtgaagttatgcttaaggtggcattcccagaaaaaactagaacgcatcccccttttttgggtagctgactatacgcaaactgctgtctcccaacacagactgtgttccagtgctggagaacacaaaggtgggaagatatgaaaggacacaaagattaatgtatgaaattatctacgtaaaaaatttcttgagtgctcactctatgctgtgccaagaaactcaggcttttctttctaaaaattagaggctatggaggtgtttaaggacgagagtgatatagtctgaattgcatcttatgaatgaatagtgtataattccttaaaaggtcttgcagcaagagaagccgggtagaaggggcatagttaagtaagcacaggggagcagggagaactctgggaaaatggaggaaataaaaggctagcgactagaggaagtgcctgtgataggattgcagactacaaaaaaatactaacaataccactctcaaaatcattaggaaaatagaaatactatcatctttgttaaagaagttcatcaaatacaaggagctaacaaaaaatgctatttgtgtagagaactagttgagaggtagcatcgccttttagccagaaggtttaaggaagtcagtggaatgtgtaagagtgagcaaactggccaggcgccgtggctcacgcctgtaatcccagcactttgggaggtcaaggtgggtggatcacaaggtcaggagttcaaaaccagcctgaccaagatggtgaaaccccatctctactaaaaatacaaaccattagccgggtgtggtggtgggtgcctgtaatcccacctactcaggaagctgaggcagagaactgcttgaacccaggaggcggaggttgcagtgagccaagatcacaccactgcactccagcctgggcgacaaagcaagactccatctcaaaaaacaacaacaacaaaacaaacaaacaaaaaaaaaaacagtgagcaaattacttgctagtaacccccagttccaaatctattccttcagtctctttgtaatctggaagctttattggagaatccctctcacttaaagtctccagcttccttgggcatcagggcctgcctcctactctttgcccactcccttgtatagcttcatttcctgcctctccttccttcttttgtccctgaataaacgtgttctctgaattctgttcttctttggcagtcatatcccctcaactgactaaaaaagtcctttctatagtgatgaatccaacttttttcctcgaacatctgcaaatatactgagcttgagtctctcattttcaattgccttttgtacatattttacaagttaccaaccacatagacacctgaaactgaaggatatgattttactcattttcacccgttgatgagatcctattgtcctttaaaaaatctcacatgtgctataaaagcatctctgattctaactgagtattattcccacctttggttcttcttccttcctctaactttacaacgatagctcatgaccctctactcttacctctcatccagatgttaaaatcattaagaacaaagagtatgcagtgtttgcatgtgtgagacttaaggcttgcacttatcatcttttaaattaattggagaaggtataaatggatacaaaagtctgatgttaagccttctggaaacttatagccaatctagaagaagccatcttcagggatgcaggaaaatagatttggctcctcttatccagtccagaggcagaactaaggattcctgctcttcgtatttcctggtgccagtgcagtgaaatcactaattaataagcctctttctgcttcagcctctgaagggtaaaagccagggaagggtacccagacaggagaccaggtttgctgctgtaatcaggcagactccactaaggaaggaaacattcatgtcaaagattgatgatttgtgagtattccaataacaacgtttgtgcttgaccagtaggagtggagtcttttggtgtgaccaagaaagtcagtttgcatgcgcttcaacatgtcaaagcctcttagtctctcaggctctctggctttacaaagccccccggtttcaaaagaactgaaacagaacaggttggcttgagagaagcacctctacagggctgaatgtaaaacaagagtttctatgtgggagtcatgaagtgtgggtaagcccccaccttgtcctgaactgcaacgctaactctatggacctagttgcatatactggtttgcagtttgcagcgggtctctgaaaattacccaagacattgtatcaccaacatgagatcgactgcctttttcacattcttatggaatattacaaaaggcaatcagattcagatttaagtcaaagactcaagcaggaatttaaaattgcctaaagcttttattaaaatagtaactttgtttactacaatggccccttcagaaattcactgacctagcctttattctctcctgtcaacctacattctgacactatcagtattctttatatagattttagagcatctactggtaattcatcccaatatttctttatgtccaacacaatgcagagctcttttacccatcctcaggggagctgaaaagaacatcaaacttttctccatgtaatgcaactcctataaaggtccttttaaagccacaccttaatcttcccttcctagaatcagaatcgtcccatttttcttggatcaatcattcaacaaatacttagcagtttccttctatgtgctgagcatttcactggcttggggatacaatggtgagcaaaagcagacctggttcttgcctcaactgagcttacaatctagtggtgggagagacaggtgggaataaatcatgtaagttaaatgggaaattgcatctgtgagccagagaggtacatgttgtataaaagcataacatggccaggcgtggtggctcacgcctgtaatcccagcactttgggaggccaaggtgggtgaatcacaaggtcaggagttcaagaccagcctggcaaagatggtgaaaccccgtctctactaaaaatacaaaaaatttagccgggtgtggtggtgggcgcctgtaatcccagctacttgggaggctgaggcagagaactgcttgaacccgggaggcagaggctgcagtgagctgagatcgcgccactgcattccagcctaggtgacagagcaagactccatatggaaaaaaaaaaaaaaaagcataatataaggagaggaaagtcaggggagctttatggaagaagtaaatgttgaattgaggtccaggggctgagtggaggtacccaggtgaatactttttcaggtattgggaacagcatgtaggaagactgccatgtgaaagagtgtaaaggataagaggaagttatttttcaaagactggaaaaaaatggtctttgtagaccattaaaaacaatttttatttgttataagagcaacaggaaatctattgaatggttttgcagaattagtgagataaatgaaaaacactgcattttgaaaacgtcactctgactgtggtctgggaaattttcaagcaaagggagcatttagcacagaagggtggacgggagtattttccagcagctcaggtgaaagacacaagacaacagcggtggcagtggggcaatcagtgattagtcagatgggatttgggggagagcaacaatgtgtcaacgtttctggaataaatgtatagtgtgataccatccacggaatgtagcgatactgccaacagacacactgtgagcaataaaatcatacatttgaattttgatgtgttgagcttcacgattttccttcactaaccctccgctttttcctagctacaaggatatcaggcgacatctcttaaaatcttgttttgcagatggtaagaggttttcacacatctgccacatttgaaaacctaactctctttactcttctaagacatattaatcactcaacaaattgaaagtaaaacaattgatgccctatgtgtcagccacacaatctaactcttcagtccctgtaagcatcccatgaggctggtaacttttctctgtcccatcatatataccaatctggtgatgacacttaacttgcagttttacttacattttaaaggatatagaatttctctccaagttgagtgcaagctcaatgacagcaggaaccccatcttacattgtagaaaatgctctaggataaaggacttcaatctgataaattaaatactgttcatttcccaatccctaacactgttttgggcaccggcaatggtttatggcataataaaaagagacttattttgtggagttgagtcctaatgccagtattgccacttaactagctacgtaaaactgggcaaattatttcactttcttgggcttcaactgcctccattataaatattgaagattcagtgaaatgagatagtatactttaaagcaacagcattcatcacagaaattaggacagctttccttatctttttctgagtaaatgttggataaataaaggcatgagcaaatgaatctttgactgggggaatctgagggaggatttagccagtagaaaaagtattagttaggtagtcatgaaaccagggttctagccccagttcagccactgactctctgatctggggtcagcctcttctccttctgtgcctcagtttccttccctgtaacgcctctcccagtgatgttgcacgtttttttctgacatcctattgtcacagcctagacccagggagccacagaaagaacctctttactcaattatttgaggatgaagaaagaagcaataaactgaaagcactgttcatttccagtatgaaaagactccttcaaatgagaaacgtcagcacttagtttcacccctaagattgtctggattattttcttcttgtccaagagatagcaagagaaattccactttaggaaacacaattgtttaacaagtgagtccttagcaattctaaggccagaatcttgtgagcagatacggaaaggtaccaattacctctcaaagactggcctggtttcccagtgaacaatttcatccattacagaattttcctgtttgtaatcccaaggtccatacttgtaccagaattttactctctaggttagatgaactcattatagcttaagtttcccttagaacgacaataataaaactgctattgctgctgactcactttaatgccaacaattgtacatacattttagaagcctaattttgatttacagtaactatatagatcaaaattagagcattgttgagtgagactttcttttgcccacaggacgaccaactagagacagaggacagaggacctgtagtgcaaaataaactgccagaggtgaatgattcaaagaagtctgtgacatgacccttgtattcaagctcagtgggcagggaacacatgtctcttgttcacctctgtatgtctgtgcattcattgggctgatatatatccagtgtttactacactgcattgcgcactgactatatagtgaaaaacaatggtttgtggatgaaagctgcttccagtatagcactgggcttggcacagtatggacatctactgattattaattgaataaatgcatgagacaattaagtgaaatcagcaatattataaaagaaaagataatagactcaagacagactaagatgttggtgagtctagttggattctataagttttaggtgccagagggaaaagaatctgaagatgcccaaacaagttacagatgtactgtctatctgggacagagaaaagaagtcaagattacacacatgtttttctttggagagaagatgataaagaaatgtgaatatcatcacactggtgtatgtaatcaattctgaattaaccttcagtaaacccaaaatctcagtatttacatgaattcttttattcagatggtaccaaaataatgctgcctggtaactgagatgagccctagctaaagaacctgttattgttttcagatagagaaatgggagccacatgtattctatctttttttttttttttttgagacagagtctcattctgtcacccaggatggagtgcagtggcgcagtctcggctcactgcaacctccgccctccgagttcaagcgattctcctgcctcagcctccctagtagctgggattacaggtgcctgccaccatgcccggctaattttttgtatttttagtagagacggggtttcaccatcttggccaggctggtcttgaactcctgacctcatgatccactttgcctcaacctcctaaagtgctgagattacaggcgtgagtcaccgtgcccggccgtgtcttccatctttattaacaagatctttgattaagctgaaagaaggagttttatttgggaagactggatttcagttgatacaacacagagaaattcagacattttcaagcatatccatcctctttggaaaatacgtaaacatcatagtattcagagataaccttaagtgaggttttcactgctttgtacaattgtgtcactgtagctcctatatccacaactgagttgtgatagaatggaatattcttttctgctcttacatacagattttaaatgtggataataatatagaagatagatattttataaaaatataaataacttaagtattgcaggacagtagtaataagtagggctggaaaggttgttggagagctttgaatacctaggttagtatttaactgtatctttcaggccattgaagattttgaaaagcagttgcaacataatcagcattctgcttcaaaacttacagctaataattttgttttggctcaatatttaaaataacatttcggttaagacctgagttcaaaatgtctctcaatataccttataagttatgaaaacaagcaaaaaaatttaaagatgatttccagctcagcaaaatctgcattttcatttggactttgctttacccttttcacaattatttatttgcttcacacaaaataagccaggatggaaattccccatcatggtcaagttctgctccatgatgcacacacaaggttctgtagcttatgggaaccaggagaatagcaggtggggcaggtagcaacaagagagctcaaacagagtggctgagaagcactggcgctgcaaggtgcaatgctggcccaatgtcaggcactgggcttatccaggacttacagacctcctctcaactcaggaccatggattctcagagttccggaagtccctatagtgccataataaagtaataattcttcaccaaaccacagacatttgcatggactttaacgagttgattgtgaggaagaaataggaaaatgaccatcagtctggccgccttgagttccgtagccaagccctaaaaccaacgcccagcctgccacagtgtgtgacatcacccatatcccctccagttctctccggtctgaccttgacagctgaccttgaaaaaaggagaagaaagatttgagctcactttttttcaaacctgaattcatcatccgccacaatttccttctctcttcacaccttccaacatttcccattcagtaggtttattagaaggattccatgcttttgactcagccctctttgtttgttccttttgtctttttttttatcttgcctttctgtgaaactgtctttgtttcttctagttagccaattgatcctaacattgcttctggaacaagataatgtgaccttcagcattagacaagactggaaccagtggggaaaaaagcagagtatattgtcattctatgttctaagaataattcaaacaagcctatgccataatgctgacaggatctccccagattctctcagcttctagacaccatcacagccctgcttgctacgcacaggaggccaggagtggtgggcgagcgccacctcgtggacatgagggaaattgcttccctctgcgaattagactgtgtttcggcttagctctcaaaacacgtttaagagaattgtatttttaaatggcttgaacaccttccagtcagtgaagcgaagcctgaattcatgaattctctatcttagggattctctgagtagcaggagaaatatctgtacggtgaatccgtcctcaggtaaaatttaaggtgaaggacaacagtagcttcgcttctttaaataaaagatttgtaacagaaatttaaagaaagaaaaaagagcactaattatgcagattgcattcaagttaaaatttacatagtatctgggcagtaaattccaccatgctttaaagcagagcactaattactactcttccattaaatctttcctgaagaatctcttctatctttgaaactaccatccattttgcaaaaacaagttaccttttcatatttaacaccagcaattcacagaggagtgtgatttatagacatttgcattgaaataacctatacttttttgttgtaagtgcagcttcttaggccctacccaacatcaactgaattagaatttctggggctgaatcccaggaaggggcatttgaggttagcatctagttgattctcttgcacactgtgcgctccagttagagaccccactgctttcttcattgaatccaggaattaagcaatttaggaatagaattgccattgttcttgcaaattacactattactagttttttatagcccagcttcctagagcatctcatctagaaagctttcccaatttattctagaaaattcaaacagatgccttttcctgagtccttcaccccaagaacatccttatccaggggtcgttttactccaccttcctattttagctcatcagagatccatatcttcacctagaaattctgaaaggtgggggtctctcacgcttctctttccatgggctttcagaatacatgcagcagcgttttgcacgtggcaaggtttaaagagttcatcccaaactcttatgagtttgctcttggaatcctatggattcaaataattagccaagcaaaaagattggcagcacggccaccagaaaacaaacctcccaccttccctaaagtggcagaacagctgccaccagtagaacagagttgttcctctcctctgccactcaggcaccgtgactgcagagttatccagacacaccaatcattttgcaactgcttggctctctgcagtgccccaggaattctaagcaacaaaggagacagtcatctgttccacagcctagcaattgtgtcattaaacaaattgctccataacgtcaaaagaggcattctttgtgacagccaagtgatataatttgtcttgattccagacatgggagacatctgtctcgaattcatgcctgtcatttgaagttgcaagtttatctacagaaaagtgagactatacccagacactgaacagaaatataaacattaagtgactacttaaaaagctatagttttacccttttagcacaaatacagggaaattctttctaaactatatggctgtataccaagtgaaaaacatagattggtattctctcaacaaaactgctttcagaatcggcaattcagtttgcctgaactgttggaacataacaatagatgcaggttaaacacacagttcatttagctcaacacatccgtttctaacagtgatgtatcacggaagcattaaattaagcaaatgctcgttgagcaccaagttatgcaatgaaccattagatgctatggaattaaaagaatgacaacatgtatcaaattgggcaattcacagatggcctcgtagaagttctgcttcccgtgggtctttaaagatgcatagtctgacagtagtcagcaaacagagatggtctttcctttctactcctctccattgtctttccagtgaggtcagcatctacatgtgtaacgcatccagcaccagccgtcagaccaccggcatcctcaccttgaataatattttcctccatcctgcctcacaactcgcatccaaggcaaacatggacatacaccacctctgaaatcttcatctgaaacatccaactctgactcacctccctcctgtcctacagtattttcttccaccacttcccaacaattcctcagtcttcctgagatccctaatccttcgttctcactcccgtccaccatcacgtgtcctgtccttttacatttggcagatttctattcatctttttagtctttgcttaaacaaaactttagcagcaataatactgcacctttagattggatgtgatctcccttgtagataaactttcctaatactcttaattttttcccatcttcaacctaatcagtctttaagacaatcgcttatttattgtcttccccagtagaggaaatagtaatcaagggaaaggaaatcacagccactcatttgttgctgtgttcctagagtgcttggctgataaccgatgcttgaaaactgtttaatgaattaacaacaacaaaagagaaaacccaatttgctcaaggcacagggaatatttgtagaaggagggagaatccaggatacagactcagattggtgccattttctagagtacttgagcattaggtaatgggaaacattggggtctttaaagatgaagacgctctccaaatactcattttttttcaataattagtacagctgattattaaaagtgtttatacgtttattgcaggaaatctgaaaaaacttagtgaagtaaaaagaaaaatcacccatttctgtagtactgctaacatttgatgcatttttttctacaaattttctagacatttggtttacatagtggcaataatacagtgcattcagacttggactctaatctgtttcctctcaacgctgtaacctaagcactcttttctcatcacgtaaaattttttagtaaacttacgtaatgactacttaacattaaatcattttaccattacacagtatacttatcattttcccatttttaaaaacttaagttttacccataaatgttttattgaaaatattacatagatcaagcacacaaatcttttctctatgaaactgacaaatgtctactcttacatagctaccacgcagatcaagtatttgacacagcagcatcccaaagtctcctatatgtcccttctcaggcaatacccccaaaggtaattatcattctgacttttagcaccataaattcgtttcgccagtttctgaacttcacagccctttttgcctgacttctttcgcccaatgttatgtctttgaaattcatccaagcttttgtataagtagtttattcattttcatttcttcaaagtattttcatatatatatgtgtgtatacacatacacatataagcacacatttatatgtactacactccatccaagccacggaaggacacttgggttatttctaccttgcagctattaaattcagttcctgttattagccatgcttcagtctagtcatactgttagcataaaacacctcttaatgaaatgagctgcagaaatctaccaaggatgtggaaaactgttttcttttgaacatgccttagttgttctgcactctgcaaaaaattcattttctgatgttagagctagacaaccaactctaaatcaatttctgcttatctattatttactcctagtgtcaaatgtgtgagttattgaaaagcaactaaatataaaagaaaaacatccccctgaaaattgggagggaggggtaacaatataccagaactgtaagcaggacagagacatgaaaggtccaaagcaaatatgcattttgcccaagtgacggcactttgacagtatactaggcttgagtgatactatgcttcaattctaagttagaggcacaggttgtagaatctgaaaaacctggaactgattcctggattatttccttctgtatggtcttagaaaactactttacctcagctcctcattttaaaaacagggccagtaatataaatatcagcatgagtaaatgtattctggcatatcattagatttcaataaatattattttttatactgatgaatggccaccaatatgccatacagtttagcttagaagacccaaataagtttaaattcaggtgcaatatttcccaaatataatcttaaaataaattccctaaaaacaagaacagcagacttgctgcagcagaatcagtctgatccaactctggcactgtacatttatgtcagtatcatgtttaattacagtgaatcataactatagcaacagtatatttttgtattctgttttagtgtacacaaaggcttttaaaatcaaatctcattcagtccttccgatacctgcggggatctgtcccttcctctatgcaagttatcaatttattgtgtctcagttcaaatccatccttcattacctacttggcaacaatggccttgaaccctttaagtctctgttctttgcagcaaacacaatattaagctttgtcactagagggtgctggaggaagtggtttctctccctgcttccagtttacttctatattgattttcttgttatttgttttggatggccgtcagcagctaatttgtgaggggaatactcacaaattgtggtgctcacagacccagaatgtgaagccccttggtaagcttgcgtccccagtttcagctcagtgatcatcttgccatggatctcccaatgtggacaccatgcatcccaggttccacagcaccctgctgtcgggtaagctcctgtgcacctgccagggctcacttcctgcagggcttatgcattcttaagcattggacccctctagaatgcagtttctccaacgccccattcctacagacgaaggcttctctatcccttggttcttgtagcatctggtgaccaacagtgcccagcagaaaacggttgcacccagcactgactctggcaactctgcagcaaggcttgagggcaacacctccctatggattgcttttctgtaccccagaaggcaggtttccagcaagtctcagaagtgaggcactttgatgacttttcaataattcataatcagccatgggcatgccctctccaagggagtctggatctcagcctgaggtggggttagagggctcctccttgacactgtatctcagccttatgacagcagctgatatttatatatactattgctgcatcctatagaattctttgtacttcttactagccaattttctgttacttcaatccacattacaatgaataattcttatattaaactctcacttttcaaattactgtgaggtttctgtctcctgagttgaccacaattgatacaccatctttcaagatgatgaaatccaagagtagcagagacaaagccaagaccaaaaccaagaccttctaaatctaaaaatcccatttttcccactgcaccaagataccctttccaggaataaaaactactggagaagaagggaagaaacacctaatataataaaataacctcagtgtcattttatagcaatctccttccaactcattttcttagagactcaaagacaaaagcatcatatcatactatgtaccaaaccaggactacccattacacagaaataggtctgcagatccttttaaggagcaaaaagtggagactgacaatatatccaattttaatcatgtagcaaatttgggaagccaccagtaatactaaacatagatagaaccgaacataggataccaaataaaactcaacacaggatactgagtagattaacatcctaacttttgatgaaataaactatacaattacaatgaccacagtgttatcaggcattcatgttatgattcatccaaataaacaaaactgaacaaaaagatgctttactctttataatcatcaagagtcattcacttagtatagaaagagaagttggcacctaatattagaatctgaataaaaatgtaacagtttcatggattaagaatccacagtaccaatctggccaccatctttgatcaatttctgatagtgaagagatcatttagcctccgtatctaattgtcaaatttaaaatagagtggaaaataccaaactatgtgtcaatcctatacttatttcagttgccagaacccttttccaaagcatttccattggttacagcttcctgtatatgttcaacacacctcagcacctttgtgtgacactcatttccaatatcacctcagtcatgaagctttggctagtctccactaacaaaatgaaaagtgatttctccaacactggaagcctcatagaatgatctgtgcttctcttatcatgatctgtgctctactttgtatggtgactacatatgtatcttccttggtctcttggagctgtaagttactctgggacaagaattactttattgatatgatttttacccaaagtgtaaacacaatggtttctgcattgacagtgcccaatgatagatatttatcacttcataacaatttctcaggttaactcagtaggtataaagaatgatcaggagtagaatccaagtctcctgactttccaacactctctttgttctatgccattgtaagtatcaagagacaagatttaaagacagctgaaagaatgggagaactgtgagaattaccagtctgacagcataaaatacattgttcttgacaacaggaaaattgtaaaaggcttgctatggccaaaccatgagaactgaaaccagcctactgtaccaggaacttatttgatgtcattatgactattgagcaggaggttgccatattaaaagataagtttgtgatgattagtagacccttaggtatttaatggactaaagataagtcatgttgagggtttaggagatcactaaagttaaaaaactactaaaagtcccagacacaatgaatatgtcaagacctggtaaatatcacatatatttaggattttgcacttaacagttttcttcttaacaatttgtttctaagattcacctatgtagtaatgcatagctgtagttaatttatttcatggctgtataatagcccattgtgtgaatttgctaaaatttatttatgcattccgctactgacggaacctgggtaaagactggtgctaggctaaacattgctgctataaacattcttacatgtgtctcctggtgatgcgtaaagagttttagctagaatgtttgccttaaagtagaatagataattatggagtattcacattttcagcattaatagatttttttttcttttccttgcctgtttgctttggtaaggatcgccagtgcaatattgaatagaagtaatgaaaatggatatctttgccgtattcccaattatagcagaaaagcatcgatatttaaccattcactttgaggtaagctataggtttttttggtacatattttctatcaaattgagaaagatccttatatttctcagttgctaggagatttttttgtgaatgggtgtttaattttgttaaatgtttttattctgtatttgttgagttgaccatgtgaattttaacctttattctgttaatatgctgaattgcatagattggtgagtttttaatgataaaccaaacttcttttctaaggacaaactccacttagccataatttattctccttttgatacattaatggatttgatttgtcagtgttttattatggattttttgtggctctgtgttacgtgctatagtctctactaattttcttaagtatttttgtcaagttttagtaacagggttctattggtctcatgatatgaggctgaaattgcttcctcttctacttcctgaaaaattacaggtcatatttgaaagataattttgttgagttcaaaattctattttatgctgcattggccaactccagggaacactacacaaactaaatcctatgtgaatcacacccctctggagttgttcagtgcacagcctatgtggctccactcagcatccttgtccgtgattgtgtcaaaatgtggacagtattgctccggtctttcagcttccattttttagaagtcttctctttacctaattattgttcccttgcagatgatcagtcttttctctctagctgctcctaagatctctttttctttggtgttctaaaacttcactatactttctttgacattcaaatattttattgtatatacatgcatattttttattaacctacctaatgtgcctgtttctttgtgtatctatgatgcgtatctttccataattccagacaattttcagttacttgttttctcaactgcctttgtcctttcgttctgggactccagttggatctagcttagatatttattgtgtcctccatatcagttaacttttctttcatattttctaccttccttctctgcattattatgacctgggtaatcacttcatatatgtctcccttttcatttattctttcttttagctgtgtctgatatacttccaaaccatctattgggtttttaatttcaattatatctttcacttttaaaagttgtatttgattcttttgggaaactaatttgatcacatttgaaaatcttttgttccttctatatctaaacttataaattttacttttaaaatattttatacatagctctgtattattctgaaactgaccattctaatatatgaagttcttggttcttgaagggtcattaagaatgcccccccctttttaaaaaaaaaatttggagagtttggtcacatttaacttcaaggtcatatctgattctatctaatatctttacattctgaggatctatttgtctcctagggaactgaattccaaaatggaagtaaaaacactttaattctttaaggtattattagaaaatgattaactatgtttgctttccttcagagaatatttgcattttttttgtcaggatttagtactgatctgtgatcacttttgcttgttttattgggggatgaggggatgtctcttgcttggcttgggctcagctctcctagcatgaagacccatgggattagtctcccaatttcacgctcatattgatctttgccttgatcagttagttagcaaaatccatttgtttaaatcaaatttaactaatctgggtttaaactttatttctctataaacttgaagtatttttaataagtataatatctatgtaaataatacatatttaggaccaaagatatttctttctctccatgcaatacttttggtctattatttcctttctaatcaaaatttggcaaaaagttaaagatgtatatctacatttctctccttttttttttgttttgttttttgagatggagtctagctctgtcgcccaggctgcagtgcagtgacgcaatcttggctcactgcagcctccacctcccaggttcaagcgattctcctgcctcagcctcctgagtagctgggactataggtgcgtgccaccatgcctggttaatttttttgtattttagtagagatggggtctcaccgtgttagccagaatggtctcaatctcctgacctcgtgatccacccacctcggcctcccaaagtgctgggatttcaggcatgagccactgcgccagcctacatctctcttaacaagaaaggcctgcatgttctatttccacagtccttatcaaaaacacaaagattttcctgtttcgtcagcagaataaaatgaacatggggagtgtctggtacaaatacagtctagaaatgttatgcactcaaaaagagagatacttctaaaataaggaaaaataattgaaaagtacaaggagaaaaaaaaattcaggaataaaaggcttacttcataaacctaaaaagggcttaaaccttgtagtctgataaacatggtgcaaggagagaaacacagcaaggtgtcaaaggcatacttctcagactacatagttccagcccttttcacacggcaaagaaagttttagaaaatgacaaaggacacaaaaccattagcgataatttcaccaaaaatttaaaatgatactgattgttaattactacagatctgaggagaaaaaggtgtcacactagagaacaggccaggtgacacattcagaagatgtctggtacataaccagacaatcaattgtgagctcaacaataagacggacattacaaggctcaacatctattctggatgtctgtgggcttggacatctcagtttttacaatatttccactttctctaataattattttaattattaatttcaaatggggagaatacttttttaaaaaactcccccaattctcaatgtattttctcttactggtgagaaatttacttttactgaacttctaacatcaaagctaagccataagacttattgcttggaaaagagtgggcaattacttcctaaaattaaaagcctatagagttggaaagaagaataatatgatgtacagaaagtttccaccacataaaatgcagacatagaaactctttggaggagaaatactgtttcggagaggggacaagaagaggatcaaaagctctctgagcctcttaggtttctgatgactctgtcactctagttctcaactcagatggggtgatgacaagaagattgaaactcttgatcaggaagaaactgagagtacagaagcctttggacccaaatcttatgtggaattctgggaagagaaatagttgcaaggaaactctgcatcaacatggtgtacctacagcagaatagaaatgataacatcatatatttagacagagagatggtcagggctggccccttctgcacacaggatctctttaatctctacacagtttattgtgtttatgggattagatgcaatgataacattttataacttttttatttaacattatatgctaaatataaacatacgtgttgttataaactttttataacattatcaataactgaataatattccaatgatttgctctaatgcacttagtctttaccatgcttctgcatatttagatggctttaagtttctatcataaataattctaagattttctgcagaatattagtagatgtaactgagaatatgttcagaataaccacacgcctccatgataccaaatgtcaacagttccattggtccctcaaacacaattccacatacatgcattaaaaatcataaagatgaaaacatacttcacacagttcatgggatgctcaagacagaagcaaagtggttaataagtggggccttgcagaggtggtcccctaaagccagtaactggtcttttgggtccataatatgttatcaactcaacctgactcacattacctaaactctgaaaagatgattgatacattaggtatcactattctgggtatatgacaaaatatgagagatgataaaaacatggtaatgtctattacattttcacaatttatgaagaatacaagagaaaatatttgaaatgtaattatgctctaaaattcgaaatgtattgttatgttttagacctacacagttatcaaaaatttctttctactttcaggattatgtataaaagaaactggaaaaccaaatttgttatgccactgaccaaacttggaattaagaggcagaggtcatctgagacttagagatatcttagcccaaagcctgctgtcaagcaggctagagaatggagtttcattgcaattagatagttttgaatacctcattaaaaatactttccaaagattaatcttttttattataaatgtgatacaggcttattgtagaaaaaaattgatgaatacatttttaaaataagtgaaatgatctaatttgattctttaagttattttaaaatctcatttaccccataaatgtatactcctaatacgtatccacaaaaatttttaaaaataatttaaaagttaaaaaaatgaaatgacttaaataccaccacctagaacattttatgtatgaactctttgcagataaggactgcaaggtaagaattacaccctgcagggtttagctatatagatgtttagtaaatatcttggagactcagttcaaccatactgcagtgaatagaggtagtactatgagaatgtatgattcctatacactcaaaagctaggcactctcttctagattataacataaatccacacatgcagtgatatggtttggctgtgtccctacccaaatctcatcttgaattatactcccataattcccatgtgttgtgggagggacccagtgggaaataatttgaatcatgggggcagtttcccccatactgttcccgtggtagggaataagtctcatgagatctgttggttttatcaggggtttccgcttttgcatcttccccattttctcttgccactggcatgtaagaagtacctttcacctcccaccatgattctgaggcctccccagccatgtagaactgtaagtccaactaaacctcttttacttcccagtctcagctatgtctttatcagcagtgtgaaaatgtgctaatacagtaaattggtaccagtagagtggggtgttgctgaaaagatacccaaaatgtggaagtgactttggaactgggtaacaggcagaggctggaacactttgtagggttcagaagaagacaggaaaatgtggaaaagtttggaacctcctagagacttgttgaatggttttgactacaatgctgatagtgatatgaacaataaggtccaggctgagatggtctcagatggagatgaggaacttgttgggaactggaacaaaggtgactcttgctacattttagcaaagagactggtggcattttgcccccatcctagaaatttgtggaactttgaacttgagagagatgatttaggtatctggcggaagaaatttttaaacagcaaaagcgttcaaaaggtgacttgggcactgttaaaagcatttcgttttaaaagggaaacagcataaaagtcagaaaatttgcagctgacgatgcaatagaaaataaatacccatttttgaggagaaattcaagctggctgcagaaatttgaataagtagcaaggagcctaatgttaatccccaagaccatggggaaaatgtctccaggccacgtcacagatcttcactgcagcccctctcatcacaggcctggaggccaaggagaaaaaagtggttttgtgggctgggcccagggtccctgtgctgtgtgcagctagagacttggtgccctctgtcgcagccactccaactgtggctaaaagtggccaacataaagcttgggctgtggcttcagagggtggaatccccaagccttggcagcttccatgtggtgttgagcctgcaggtgcacagaagtcaagaactgaggtttgggaatctctgtctagatttcagaagatgtatggaaacgcctggatgcccaggcgaaagtttgctgcagaggtggggccctcatgaagaacctctgcttgggaagtgcagaagggaaatgtggggtcggagtccccacacagagtccctactggggcactgcctagtagagctgtgagaagagggccaccctactccagaccccagaatggcagatctaccgacagcttgcactgtgtgcctggaaaagctgcagacactcaatgccagcccatgaaagcagccaggaaggggactgtaccctgcaaagtcacaggggcagagctgcccaagaccatggaaacccacctcttgcatcagtgtgacctggatgtgagacctggagtcaaaggaaatcaatttggaactttaaaatttgcctgcctcacaggtttttggacttgaatggagcctgtaacccctttgttttagccaatttttcccatttggaatggctgtatttacccaataactgtacccccactgtatctaggaaggaactagcttgcttttgattttacaggctcataggcagaagggatttgccttgtctcagataagactttggactgtggacttttgggttaatgctgaaatgagttaagactttgagggactgttgggaaggcacaattggttttaaaatttgaggacatgagatttggaggggccaggggtggaatgatatggtttcgctgtgtccccacccaaatctcatcttgaattgtatccccacaattcccacgtgttgtgggagggatccagtgggagataatttgaatcatggggcagtttctcctatgctgttcttgcagtagtgaataagtctaacgagatctaatgggtttatcaggggtttctgcttttgcctcttcctcattttctcttgccaccaccatgtaagaagtgcctttcacctcccaccatgattctgaggcctccccagctatgtgtaactgtgagtccaattaaacctctttttcttcccagtctagagtatgtctttatcagcaatgtgaaaacaggctaatacatgcagagacttcatcttgtctatttttgtaacataattcctagaattccatagcaattcagaattaaattatcaaatactggagttgctcgatttcaccaacttagttaagttagcaaacttctcatcagatctaaaaattgagcttcaattcttgttgtgaatgctaaataaaacggcaacaaaatttggcatttcctacatctgattctctttcatttcaaaagaattgcctggtatttaggagacataagttggtcaacttaaattgtttaactcgcatttgttatgatgctacattcaaaatgaaaggatttggaaaatgctgtgcagtaacaacattacaaaactgtgaatcttatttgattgcttccatgtctatggctacattcccatgggaaccagacattttaatcttttttgtcttcaaaaacaaggcatcattctgcatgagccttgtctttgggcacattgcatacattgattcaaatattaaagtggattaataatagaatcaaatttagaatggttgcatggtttccagaaggaaaaataaaatagttttgaagatgtatgtgctttaatctgactggttaaaatatggcattgcttatacttgtacaaccttttaagaaaaattcttaataatctgaaaagaaatctttcctgcatgtatgtttagtgtgtgtgtgtgtgtgtgtttgtgtgtgtgcgtgtgtgtgtgagagggagagaaggagacagaaggtgattcaacatccttcaaaaaaccctcattgagtacctttcatgtactgagagacatgttagacttttaagctacaaagatgatctagatcaatctagtcttcgagtcatgcaggatgaacagacataagtacatttacgatatggggataatgcaaatacttacaaagaagagttggtgggtgagaagaaaggtaaccaactctaccttgtgggaggggggagttagggaacactctgttgactgttagggacctaatgagaaagacaagcacaagatctcagtcataataggcaaagaaaatgtaaagcatgctccaaccttttcttccttgcctgaacttcttccttttccaaaagactcagctgaactaaccacttggatcacacaaattttattcctactcatgcttaagttcgggtaggaagagggagttttttctaaattcagaaacctgcctgagttctctgtctgagctttgcccacagcctcagagcggagctagaggaatggcagcgaagttcaggatgtccactgaaaaacagtggaatataaggctcatgtatcaggtctctgagaatcaactctgaaacaaatgtcacataagtgcctttaaacccgcaagcagagtacacgtgctctgcaaccagcaagcacaggctacagacgctttccgaatctcccctctgtagctccacactcacccctttacaaaacaaaaacaaacaacaacagcaacaacaaatatatacatatacacacacacacacatatatttatatatatatatatatatatatccactttgcatttacttgcatttagatagtgccttacagttggaaacttttttcttatatattatttaatttgctactttcaagagcactctaagctggttagggcaagaatcatggggcttagagagttaaaatgaatttctcacaatcactttaactgaactggagcaaaaagttaagcatttttaattcctatgtatttcctgccatacggtactgctaagtgtttgcacctttcttttttatccagagtacatatattcattaagcatgtggtatggctcacagtttgtgctaagtgatatgggggccagttttaaaatctataatccatgatctgtttcaagtaatgtttactcaatgtgataacctatataacatacaggacacattttttcacaggctgaagcttattcagaaaatgcaatcatttaacaatgggatttttgtaaatgaacattgtaaaacatttatttttgaataacaaatataccttgaattacactgggaggaacatgcttaaagacatgccaaaaaaatgatccacatgcacacctccagctcaaaacattcaggcttgagatcatcaaaaagaaagttaaacagaatcttcatggaacacatttgcctaatttataatgacaattgaaaatattggcactgtgatatcaaaaatggtgagcactatagaacatacccaaattaggttaaataccctaaagtaagagaagagtacaaaattcctgtgaaggattaatagtgactggaattccatcatatttataaggtaaattataaactagtatctatcaaatcctaatcagtatttttatctgatgtggtttttatttcttaatttaaagaaattttatgttctcattcctacaagctatataactgagattataactgaattcacttttcagttatctgaccctaaacagaagtatgtgtgtaagcagaagtgtggggaagatgttttttaaaaatcattattacttggccaggcacggtggctcatacctgtaatcccagcactttgtgaggccaaggcagggggatcatctgaggtcaggagtttgagaccagtctggccaacatgttgaaaccccgtctctactaaaaatacaaaaaattagccaggcatggtggtgcgtgcctgtaattccagctactcgggaggctgaggcaggagaatcgcttgaacccgggaggtggaggttgcagtgagctgagatcgcaccacggcactccagcctgggcaacaagagcgaaactctgtcacaagaaaaaaaaaaacacacattattacttaatgattattggatgataagaaaatgaatcaaataaaatatatggcttgtttcattttgaaatttaaaacatgtttttaaaactcactagtaataaagaaatgtatattaaaataataaaattaacaaacactgaaactattaagaatttctaatgtcaataaaacagtgggagtataaattcttctggacggagattattatggtttgagtataccctccaaaactcatgttgaaacttaatcttcaatgtggcagtattgagaggtgaggtctttaaatggtgagtgggtcttgagggctctgactcatgaatggattaatccattcatgcatttaatgggttatcatgggaaggaactggtggctctacatgaagaggaagagagatctgagttagtatggcaggatgctcagccccctggccatgtgataccctttgccacctcaagactctgtagagagtccctaccagcaagaaggtcctcagcaaatatgccccctcaattttggacttctcaatctccataagtgtaagaaataaatttattttctttataaattacctggttttaggtattctgttataaacaacagaaaatagactgacacagagttattggcaagttaagaactctcagatagttaagaaggcattaccaaggttctttaatatgacagttcactgagaggacattaggtacaaatgcccctaacttttgatttaaaagcctacagtagacttaatacattttaaaaaggactttatgtataaagtttcatatgataatgatatatattaattatacaaataactgatttataatgtaagaaatttaaatatgcagccatataagagaagcactctgtagaagctacacaactgtaatggcttacgaaaagctttcagggatattaaaaatatgatgtacgaagagtttgtggggatatgaaaccatgctcatgctattgtgtcaagtgaaaagagcaagctggaaaactgtagttataataaatccccaggtatagaggagggaaaataatatcaaaggcattagaaaggaacagaccaagctgttcaaagttgttactttagggtgatagaagattttgttgttggcagggtgcggtggctcatgcctataatcccagcactttgtggggctgaggcaggtggatcacttgaggccagaagttcgagaccagcctggacaacgtggcaaaaccccatttctactaaaaatacaaaaaattagccaggtgtggtggcacatacctgtagtcccagctgcttgggaggctgaggcaggagaatctcttgaacctgggaggcagaggttgcagtgagctgaggttgcaccaatgcactccagcctgggtgacagagtgagactctgtctcaaaaaaaaagttgttgttgtcgttgttcaaaggaattatcaaaatattatataataaaagacataccttgtttccatcaactggttatggttttatcttttggggatgaactcttcaagcttacctggccattcccaaaagttaacatcacatatcctatgagctgccagttgcacttaacagtcgtgcgttttgattcccaaaaaccacccgacaccttcccagcccagcacagtggctggcacctagatgggtgctttcggaactctgcttccagaagctctaggcatgacagggaatcatgtgaaaggatgatggaagagtaagagcttgtgggtaggatttagtcccttaactcacttaaatcagagtagctggtattcatctgttttgttctttttttaggttagtttctgtttttgtttttttaaattaagaacaaagctacctgcaaaacaacatgctttattatcgtccatactatgactcctgccagtgttcccaacccaaacccggctcactggtgaagctctccaaccttgccatactaccctcttttttctactcctactcttagatcagtggttctactcttgactacaaattagaggcacgtgagaagtttttaaaacacacaatgcctgggtccacccttagagattccaattacactgctcagggtggggcccagggatgagttttgttgttgctgctgttgctgtttttagtttcagtaggtctggggggaacatgtggtgtttggttacatggataagttctttagtggtgattttgtgagaatttggtgcacccatcacccaagcggtgtatactgtacccagtgggtagtcttgtatccctcacccccctcccacccttccccttgagcctccaaagtccgctgtctcattcttatgcctttacatccgcatagcttagttcccacttctaagtgagaacataggatgtttggttttctattccggagttacctcacttagaatagcggtctccatctccatccaagttgctgtgaatgccattatttcattcctttttagggctgagtagtattccatggtgtgtgtgtgtgtgtgtgtgtgtgtgtgtgtgtgtgtgtgtgtgtatgacattttctttatgcactcattgattgatgggcatttgggctggttccatatttttgcaattgctaattgtaatgacatgcatgtgcaagtctctttttcacataatgacttcttttcctctgagtagatacctagtagcaggattgctggaccgaatggcagaagtttcctttgggagaaggggctctgctttacacaactggattacagctttttcctgtggactggggaagggtagtgcaagcctgcctgaatgtgttaaaaacaggtgtggcaatagagacagtaggtgcagacacacctctgagaggtctggctgttaagaagaaaaatgccctagagctgaatgagcaaagctaaagcatcaagtggaggagaagttcctatctcattgtgatctgattttaatgagaaaaggcccccaaatatcccgtgctttcttattacagatcatgtatgttttaattaatataacacagtacaacttcaatttaacattatataatgatatttctgtgggtgtataataatgtaaattcctcactggcatctaaattggggcagattaaatcccaattatttgttaaaaacttatagaagaatttttaccttgcagaactttttcttaagttaaatgcaaattagctggttaataaggcaatataaaacttctctatgtttgagtccactgaagacttaacttttcaaagaaatagcctggcaacagtgaaatatttaaatttcttccaaaaatcccaaattccgaaacaccgtctaaaaatatacaatcaggtaaaagttgagaattaacatatggatataaggtgaatacatgaatttttaaaaccatattgataaaaataaacccaagacttgccctacactcagaatctgtagaaattatcttgactgtgcagaaaaaagttaagaaagtggaactgaggctgctgtctctagagtgtctgtcttgaaaggttggccctgggctggcgtctggaaacttggtcgatggagagttccctccattctctctctgataaagatggtttgctgtgcacagactgtctatacaaacaatgcgatttatgctgaatagctacttttcttaaattttgatagctgctaggcagagggtgcctacgtgactgtcgccctccccgacccccactcccaagtcaggtaatttccttgcatgctctgtctctaatgagcttcctgggaagaaacattgtatacatgttactgcgtttttttgctgctgaagaaaagagcaccctcagtgctccctcagaggagacagaaaacatcagaagcctccgcatgaatctctacagtctctgagtatcttttcccctattgatcctgttatatttcctttccctgcaataaacttcagtggatagtgcaactatgcttatgcattgcttaatgactggaagatgcatcatcaggcgatcgctactgtgagcattgtgcgatcaccacggagcatacgtacacaaacctagatggtgcagcctcctacatacctaggctatgtggcatagcctactgcttctaggctaccaacctgtacggcatgctactgcacttaacaccacagctgattgtaacagcagtaagtattagtgtatctaaacatatctaaacacagaaaacatacggtaaaaataaggtattataacattataggattaccatcatacaggcaagtctcttgttgactgtaatgctgttatgtcattcacatgacgatatctactaaatcctgtgagtatttccagcaaatcacagaatgtatgcgtggtcttcgagatcctcaggaaagcacttaaacacacacacacgcactcagagacaaaattaaacatgtaataaattcacacatatgcagtggctggcaccgagcacaacaggtatatacctctcaaatgtatttgctgtttgcatttaccaaagggtccctcctcagcagaagacgaaaggggttcctgagagctctccatatcattaacaaatttctttgtctcatctcaatttactccataattataaaaaagtaataagcatacttattgtgcttgcaggttaccaccaattttaccttaattttcttagttaatgttggcaaatttcctgtgaggaagctattcactagcatagatgaggaaatgggggacaagagaaagaaggtcaggggtctgatcaaggttaaattacttcacactcacagggtatggaagagttgaaatcagacccagttattaaaatccagagcccctggcttctcctcattataactagttccctcaaatgtggtttgtagacagacatttataccagcaaagaagttgcattagccctcagcgaaatgagaaaaaaaagtaatataatatcgccacatatttttagctatgttctgcctttttttagggttaaaatatccattttgttggaagatgatacaaacaatagataatggctcttcttatttataatttttaggttttttcttaattgtttgtaacatctgcatagagtaaatttaaaagaagacgaatctagagaggccctgtgcaaaaggttttagaattttttcagttattcaaattttgtagtattcgaatctttttcctatcatcatatatgtcggaaaattaatttcaactgcatgggcctgggttctgctcctaattctcccactgatcagtaagtagcacaaggcagttcactctccctctatgggcatcagtttccttattaacaaagggatcggcttaggtgaattctgagggatctcccacctccttagaggtctatgattctgtaaattcctgaatctgtttactcttttgttagtttcccagccttacagtacctagaattggccagatgatggcagcagagttctactttagccagactgtgcgccgaacaggtgagcgggacgcctagagcactgtgctgaagaggaaaacgtggaaggttatatggaattaccataattaagaaagaaatattcacaggttggctgcctctgacatgctatgtcaagaaacacagctacacttacagagaggaaggtctctgtttgtcttttaaaagaggactacatgattgtgaattcctagcaatagaagattcaggcccgttttaaagataaaaatactaggcacatgaagaaccactgaatgcccaatgcctccctgctaggaaatggcagagctcaaacttaaagacaggtcttctgactcccaggtcaatgtcctacacttaacatgtagcaaagctgtctcagagaacacatttgctttgacatctagaagaggctctaaaagaagtcttcagcggcaggcaccgagcacaacaggccatatacatctcaaatgtctttgctatttgcatttactaaagttcccctcctcggcagaggatgaaagggcgtggaccttggaccagggttcaccaaggacaccaatttccatggtacactcccgacagtggggaagtcctgacacggaaattcaaacagcccccttttgcatgaatacataagagacatggagttctatgactaaagagtgggtttcctgtctgatggtttcaatgacaatctttttggaaaaattgaaagatgagtagcattcctgtatatccttaatctagctccccttaatgttaacagttcacacaatcacagtacaattatccaaaccagcaaattaacactggtaccatagtaactaaactataggccttattcatagtttaccagatttcccactgatgtccatttgttatttcagaatcctatccaggatccaaattgcatttgttgtcatttctccttcatctcttccagtgtatcacatacaacactttctcaatcttgtctttcataatcttgacacttctgcagtatactgatgggttattttgtagactgtctcacaatttagggttgtctgctgttttcacatgattagatggaggctacgcatttttttgaaaggatgccacaaaaatcatgctgtgtccttcttagacatcatatcaaggagctgatgttaatatgtctactactagtgatgattaactttgatcacttggttaaggtgacatcttccaggtttcttctccagaaagttactgtcttttcacttgtagttaatatatatcttgaggaggagactccgagcctctacaaatatctgttcttctcaaaaacttccccctgattttagcctccatcaggcacattatctgcattcattattaacgtggggtttgcggaacagtgatttttctatttccctttttccttctacatttattaatagaaattcttctgaaaagaagactgatcccttctcccccattcattcatttatttgattatttatttataccagtatagattcacggctatttcttttatcccgtggattaaaatctaatactaccattatgttcatgctcaaattgttccagatttggatatcgagagcctttaggtaggctcctgtgttcttttgacaagtcctcatacctgtttaagcacgtcctcattttttagtatcacaagatgctccaggctcatctgacattttcccttccccagcgctgcaatctagcacttctctaaggtgtcctggctctttttatgaaagaatgcaatttagaaatgaaacttagatctggttgctaagtgtgttcattataaacagagtgcctctgtttctacaccctctcagccaatagatctaggaaataaatgtacatttgctaacacctgcatgtacacacctgtatttctctctgtatgtctatctattaaatactatgaattcctactaatacctgtaaatccaatcaaataccagagggctcatgatagccttccttctttacctgtaactttttctcaaaagatgagaaacctggctcccagaggacaatcaatagcagagcttgtcctccacaataacctactcagccaacacaaaagtgtgtatgtttaccaaactaagtagaattgtgtaagatctaaattaggctaagtgaaattaagtagctctatgttttatgacccagagaatctgttctgtgctatttacccaaggtctataaaggaatgtgtgtaataaccgtccccacaatgtttgtagttgtggaaactgaaggcaacctaggtgtccatcactgggggatggaaacataaaaggtaatggatataaaaagtgggcactgtgcaataaactgaacctggatagacttcaaaaacagtgttgaatgaagagtcaggagatcaataataataccacttatgtaaatttaaaacacacgcctacataaaaattatctgttttacaaagctatgtgtgtatatttggcacatatcagattctgcatatcatgatgggaaggggaatggaactggatataaagggaaagagtatgacaaaataagagaaatgcattttcactgaaccaagataatgatgtgtgatgcgctggagagtgtaactaattccaatgtcctctctggaggtaaaaatcaaagtaggcaatgtgtaagaagtcaatgaaatcatcaaaggccaataataagatcagtctttaacttaaaaacaatttttttactcatattaaatttattgtcattcaaggcctccagaagctaaagggtaagaggtttttttaaaaaattcagcactgaagatattttaattcaaaacgacatgcgagaacaatctaaatgcattacaatgctttgaaaatccaacattggctctattaaatatcttgttttagtaatggaactttgttgttgttgttgttgttgttgtagttgttgagacaggttctcactctgtctgcctaggctgtagtgcaatggcacaatcttggctcaccgcaacctctgcctcccaggttcaagtgattctcctgcctcggccccccgaatatctgggattaaagttgaccgccaccacacctagctaatttttgtatttttagtagagatggggtttcatcacgttggccaggctggtctcgaactcctgacctcaagtgatcctcctgcctcggcctcctgaagtgctggtatcacaggcatgagcccccacacccggcctagtaacggagtttgataactgtcgtgaacattcatcattatcagggtacgtcagttattccttgggctttttctcccacaagggaaaactaatctcttcattctccatgttcattttacgccagtcactgtagccctttctccatcttctggacaaatgaagcatgacctccttgggcttgtgctgcggctgacccttctgtcttcactcttcctcctccacagtttcacacctccggcttctcatcaaatggcacttccccagacatcttgcctgaccacctattgaaattacctctcctccaccctttattatccccagtgcagttttatttcattggttgtttcatttaaagtattttactttacatgatgactttcactctctccccactagaatgtatggctcttcaaggcctgttcattgtgatgttaccagtactaggaacggtgcctggcaaggattagatgctccataaacatcatactcgctcaggttgcagacatgtacttcttgggaatgttttattcagatgcagttttcagcccgggaacagagctttctctgagtccctatttctattcttagctttaggagccaagcagtggtataattactacatatgacaccagaaaaaaattactttttaacatttctctcctatatgcaacaaaattatttgtaatcataatactaatagagaaatttgcaaacagtgaaaaagtgtttattcaattctatatataatgaaaccagcagtaaaataaaaataatgtaatgagaagaaataaaacaattacattcatatactttttagaaaagggaaaaattgtataccatggttcatattttatttcactgatttaaatgctaggcacaaaagctcttcaagtggtcacagaattgaagtaactcaaattacttcttcatcttcacaaactgtgttattattgttgatttcaaatctactatttaaatccaggaattgatagatataagctgctctcaaagtgagctgggatattctgagccatggctaatttatgctcaaaatgaacatgtgtagctgagtttgcatgtattgaggaccgactgtggaactgggaagtctctaaattagctttcatatagatagaatacagtgtgttcaaggatacatgattttaaaatgtgagaatttcaagcttacatatttattctaaaaactcaactgtaagcaactgcaacagaagatttttaaggggaagagtatgttatcaagtacctgcacatgctgattaaaacaaaaaaagcctatagattgtatttcactttattaattttgtttttgttgttgtttgtgttttgagatggagtctcgctctgtcaccagactggagtgcagcggtgtgatctcggctcactgcaacctctgcctctcgggttcaagcaattctcctgcctcagcctcctgagtagctgggactacaggcgcctgccaccacgcccggctaattttatgcatttttagtagagacggggtttcaccatgttggccaggatggtcttgatctcctgacctcgggatctgcccgccgcggcctcccaaagtactgggattacaggcataagccaccgcacccagcctaatatttttaaatctgtagacaccacactcccttattgtccgtattgggtcaggcctctccggtcatccagtccagctacaccagtgtaggttcagatacttggaatgaaacttaacatttcctttcctaacactgtcacttccacatggtacctggatgacactccatactgtcacctggctttttctccctctgatttctgtcttctgctagagtccaaaggttcccccaaagcccacattccagggcctccaaagactcacaacaccctggaaattcccaaaaggctaataagctaaaactcatgaacagcatccagctattccacagaggaatgaagagtaggaagggagagagtcattcacactctgctccaggaagagggatgtctcattttctctaattctcttgctctccctgctgggctcctcagccctgtctcctcacctcctcccactacttgcccttcgttcctaccaggggtgttaaagacaaaaacacaaagcctgtgtctccatgatttcgagtttgtacttgctattctctttacttggtattgagaagtacaaatgtaatttctacctaaataattcctatcccattattcaaaattctgttcaagtatcacctgttctgagaagtctctccctatgtctctctccttcatggcaggctccagaaagatttagccattttctctttaatgccgtttctgtacttgaaaaaacttctacaattgacatgtttttactcactgtgatttctttcagttcagagcctatgagtttactcatctttgtaattctaactcttaggttgtgttcaatttatggaaaaatgtttgattgaaacaggaaatacaagatacaaggtatgttttggagccaattgtaacttaaaattatcaaccacacctcacccctcaagctgcagaagtttgacctaaccttcagaatggctgacacactgatttccttgtgctttcactaatttattcccatgcctacttccaacaagttttctagaccagatgacattacttgccatcccttatcatgagttgatggttattatggggtaactaaaggcatagtggtcattaaaggctgtatacatggctggtgaatccaggaaatgaaatacagaaatattatttagctggttacactctatctaatttctatctacgtgaaagaaaactcatggtaattattacttatataccaatatgtcatttctgaaacacttaagaaatgaattagtgaaaattcaatattactttgtaagtgtagtattttgggttactgtcctgaatcatgtttcctctctaaaacaggattatacatctctatttattgtcaaatgacttgtcatacattctctgggaaagaaccacattcccacctcattgattctgcgcttggccaccatgtgatatgcactggccgtgtgaccaaaagaacggtgagcagacatttgccatgattaaacagaagcctttagtgtaactgtgtggatggctgaagcttttctgttcttgccctccaccatgagaatatcatgtctccagacaggggttgttgctctttcagtaaaggttccacaatgcaaagaaacatagagcagaactacactcacctagactcatgccctgaagcgctcatggtgtgtgagcatgaattaaatatttattgtaagccactcagctttatagttggtcttcacacagaacacagaagaaaaccttatgcatagggcaaattattgaagactgattttattttaatttaaggataagaatgatatcatattgcctttttatagtttggcacattaaaaggttctaaataaatattttgaattaatataattgcaataaagtaaaacaggttgtgtttaacgatgtagaaattaaaactttaaaaattagttctcctttgtgtattggacatctgttgtttttgtcagttcagaatttcttcctctacttccaggaacaacactcatctcattttaggggcaagtaattcttctaaggcttttaatcataggacactggcttcccagaccacaagtttaagcacataacccagatttggccaattatagcacctcattttctctgtcacagtgattggtgcttggataggaacataatctaggatgatagagtccttccttgaatttccatatactgaagtggttggagaaaactgctaccttttttgttgggttcacagatgtagtaaactgcagccatgcccaaaaggtataaagaaaaaggaaggccaggtacggtggctcaggcctgtaatctcaacactttgggaggccaaggtgggtggatcacctgaggtcaggagttcgagaccagcctggccaacatggtgaaaccctgtctctactaaaaacacaaaattagccaggtgtggtgatgtgtccctgtagtcccaggtatttgggaggctgaagcaggagaattgcttgaacccgggaggtagaggttgcagtaagctgagatcgtgccattgtactctagactgggaaacaagagtgaaacttcatctcaaaaaaaaaaaaaaagaaagaaaggaaaaagaaaaacaaaacaaagcccacaaagagagtaggagaattaacagaatgttctgtgggctcttgagtcttttgcctagttcttgaaatcccatatctacctcattaatgtagctcttctttctgtgagcaatcctggtatccttctaacaattccttctttgcttaagtaaattaaaattgagtttctgtatctcaagtactattgaatataatttgaattaaagtagctttcaaccattagtttataaatcaaaacagaacaaatattacattgatccaattcagcaagttgggttgtaaagaatgatgatgctcttgaaagcacgccaggtaaccctaatcagtggtccattctagctctaaattagtaaggattaaggataggttgttcctgagcctttccagagcttccgcccatatccaaggaagacctttcccccttaatctataaacggaatgactgggacacagaaaagtgacatgcacacaaaacatacaactaatgtaggtgccagtgaagggcatgagagagcatgatgcacaaggttgcaagccttagatgactggaaataccagcttggtccaagaattatttttccagaaatactgaaataaatacagaaaatacaaggaaagcacaaattcaaagatgtttctacccactgatgggaaagttgtaaagctaagccaaacagaaaaagccagagtgctttaagtgattatggattccagtatttcaggagaggcccatgttttctagaccaaatcttctcatatcataatttttaaatgacaaagaaatgaaaggattacacgtcagtgcaaaagctgttctcgtgatagggaaattcacagggaccgaacacaacttctatgtgtctgaaatacgattccgacctaatagtcagaaaatttccttccagaagtccaccacttgaagcctaaaatcattatagatcagatagatgatagatagataatagatagatggtagatatagatgatagatgatatagatagatgatagatagatagatagataatgataggcagatatataaaatatttctgaaaaatagcctagcccactcagcaaagaatgtaacaatctatgaacttcccaaaccatcatcaaacagcataaaatagaataacgtgatccccaagagatcacctgcagctccaggtgagatgacacccgaaagactttccatacatggcctaaacattggcttcagagatcacatgtgagctctatattttaaagggcaggacaacataaaaataatcatagctacaatcttgaaacttttttctgcatccatttacctaaatgattctgcccagtgactaccatttagttcttacctatgaggaaaatattgttatttttgtttacagatgaaaaaaaaatgaagcccagaggtctctaacaaaaaagtggcagaatctaaatgtgaatcccaattgtttgagtctaaagcctgactcccaccaccactctacattaaccctgatgaattactcatcattttaccacaacatatgggaagtacttgataaataattaatgaatgaattgatcaatggcattaagtccaacagcctcacagccatctgtaatatgccccctgtttattttgttggtattaatccccactgtgacttttcatggaattacctccacaaatacaacataatgcaaaattgcaggaaagaagctcaaactttgggatctgagaacaaagaagcaaaatggcttccctgaagtcagacactgaggatcagagaagtacctagcagtctagttttgctagaagaaaggttgtctggaggacactagtgggagtaaagaaagactgattatagccaaattgtaaatgagtttggatgatctttactctgaaggcaatagagagccattgaatggctcctaagaggaggagtaacaagattggagccatatacaagcaagtatctgataaatgctttcggatgattaagttgatatcagactagatcccaaaaggatatggcattcttaagtttggataatttgaggaatatttacttacaaaagaagtgattacagaaggaagaatgaggtgtagagaaactacagggagcaggtaggaacccagggctagtagcagcagagctgtactagcttaacggaaaaagaagagagaggggctacccaaatccaggggagaaagctgtacagtgtaaactacccagaaggcagcggtgacattctgccatggccagccagaggtcacttcacagggaagaaactagaggaataaagactgactttgctttctctcttcactctatctcctgccagcgcttcccactggacaaacccaacaagcagcagagtacactcatgcccctcaaagagttcacataggggagacccccaggaagaaagcagaggtgggagagtggaggggatctggaggcccaaaccaacgatatctggctcaaagtcttcccaataacaagaaaaattctattgcagtatagtttatagacaatttttagttacctgtattaagataaatgaagaataagtagaaacaatggtacgatattattaccagtataaagatactttattcccaatgattgtataactatatttatttttaaacactagactcatttatattgtagttccagtttctgtaagtatagcagctattgaaatggagaatgggagtggagagaggggaagagtcaagtctggccccaaaatacacacttttgattggtaatttgatctggcatgaaaaattagctataaattattagtagcagaaaattgcatatggttgatttaaaaatgacttcactcgaaaccacatatttataatgatagtttaatatgctgtttgatcaattattctttcaggttcatgacacaatagaaaactgtcatcaacaagaacgttggtgtttcctaatcaggagctaagtggttgtactttacatcacttaaaaatacaacttgtttcaattctggagataattgctttcccacatgggcatccataggttacctctttgtgtgactgataagcacactggcttatgaaaaatgtaagccagaatttcactttgctaagaatcgttaaattcaaaatatccttggtaggcattaggcctaaaatctcattgcattttagctctgtaaccctgggcaagtcttttgacctttttaagcaaatatcttgccctacctaacctctcatagaacatatatactgagcaattaccgttttccaaccaccaggttggtacttatcaccacaacccaagaagcaggtacaacagttatctccattttactgataagaaaagtgagtcttattaatgtgggttaagtaatttacttatagtcttacagctaataaatgataaagtaggattagaatccagcccctggcccaactccaaactatatactatatatcctcctactccataattagtagatagtatatactgtactatcttcctaccccataatagtcatttagggtttgaatgaaataacatgttaaaatattatgtaaaggtaaagaattatacaaatgtataatttttgttttataatatctaagattcttgatcattccctaagtataacttttcaaagagtctactgtattcattcttcatgtaaatattttgatcatctattaatcattttcagttttcttgtgactaagataaaattttcaaatactagactgtggaaaagcatacttgaagtagttaaaggtgaacaccggctgaaagaaaaatgaagtttagaaaattcttttaaaaactatcatagtatttaattggtcttcagaattggattactgtttcagtgtaactgttgacttgcataaactcaaaagaaacagtttctcatattccagtaagcatgaaacatactgttggtgttgtcctgatgttatgttatatattttaattcttactaaaagttttctctggttagaacctgctcagtccacttttctgcagaacagacatcactaaggcaaaataaatctccggttgtacatattgatcaaaatatggaagcctaaaagaggcatgctgtttgaaaaacactgtgaaacatcatgcagatgagtgttcttatccaaagccaaattcttcccttcttttagttcttctttttctggatacaggaaatatattcccttttgaagaggcaatatgcctgggcctccctccttctcctcaccagtgtctaaaaggaattattccacttccaaggccacaggagactatatcagtgccatctatgtttagagtctaacaccatcatcctttcagaaggcagcagtagcagctatctcaaaagacagagcagtaggatgggtccctgagcagatgcccacctgtccaaagtcccaggctccatctgagtcaggtgtcattgaaacatatcacccagtgaaagtcacatggagtcttaataatgcagatttagtcaacttctttatttcagatgtccaactaaaaacacctgggagaccttaagcattatctattttctctttcaccaaacaaaatgataaatggaaaaaaaaagtctgcagactctcctatcttccttagcaaaccaaaataaagagagattccttactcttgaatggtaggtgtgagtaaggtgggggagaaaaatagcagcatgagtctactaacctagtctggttaaacaaaatcctgttttacactctcatgacaatgctacccagttcatttggtccattttaactgaatgcctccactgtgcccagtttctggagtttgcacaatttaagttgcatttcccatcccctagaatattaagaagtaagaatattttaaaaattattacggtaacatgagttaggctaaagaataagattacaggtaatgaagaccctataaacactatagagcatatacaatcaggaatttttacagactcgagaactggggaagggtttgtggcacagatatgggccagcctgggtttgaaagacaaaattgggattgagaaagagaagaaagaaggatttgggggctggaggaggggggaaatgccatgcagatgatgaaaagataatagcaaagaggacatcagtgctctgggaatatttggctggcaccaacaagtagaattattttctgtggggatggagacaaagaaagggaattacagaatctaacgacaactgaaacaatttcagtgctaagcattgattattatagagacagaataaagaggaaaaaacttaatcgtaagacttcgcaaaggaaccttaccattcttctcacccttgccaacaaaacctatttttctcccacaaaacctggactatgagattctagcatttcacttggcacaatcacctttaagtatcaacattaacttccttcacttctcctctaaatacaagattttgaatatcagtacgagagcccatggctaattctaggaagtcactcattgtagaaatggcatataattgctgtgctggccagtgcaaagaggatatgcttattactagagaagatagtcctctttccaagaggaatctgagacaaatgatgcttccatgtatagaaacaataaaagagcgaaggtattttgcaaataaagttgtccattgagtagactcattgctaaatgcagaaagcatgtatctcactatggggaaacactgagacctctttcaactctccctacactgaagcaacataaaaagtttctgtccaaagtcccaatcaccagcaatatggaacacagcaaaagtcatttacagtcttattccatacatgatatattctacattaagaataaaataactcattacattgtgaaacctagaatggaatccaaaccagcttaactgcattatcttgtgacattcacccattactattgattgatcaaagtgttttctttgtctgcatgctgagctaacacagattaattactccatgatccgtttaaaattaaatcaaagaaggctccattataattggtcagacataacatgaaggcagggaaaggagtagcagtggttaatgccctgtatgcttaatttatttttctaaaaaaacatgctgaatttaacctcccctcaaaatcaagtaactataatgctgaaagatgacatttttttatttgctgtatgtcttgttcagaatactgcatataagagaaatttcatttctaagatctctagggcttgctgaggaatgacttttatcagcattcttcaaaatacatttcatgtaagggtacgttgatataaaatttttaaagaaaactctttgaaaatgaaaaagagcataaatagcttggatggtttaaaaaaatgcacttatcctctctgaggaaaaaaaaaatcatttgtcctgatgtatactggaccctagtctttcttttcagattccattgggtagcagtcatttcttttgataggatttaccagtatctccaactaggggaaggtcctaattaatccacatctataaaggtaatcctatgcatcttgtttgtttaagataaactaggtctataccaatcaattaataataattctctggccacagagatttcatgaatgttgttcagtggcatccacactatcctgctgagtagtgtaagtttgcttcaggcagcctcctatccatggccacaagagaaaccaatctaagaatgaagccagtaacactgtaaatggcagagcgaaaagtgaagaaaaatctagttcttgatgaaagagttgtaccactcgaccagcccaccctgaagttcggtctacgtctggattttccaataaaatgaatcacgttatcccctggtgtttaagccaggctgagtcatattttctgaaattctgcccaaaagtatcctaaccactatgcaacatgtattgctcaattgttcacagagcctatagtcagagaataataaactgaaccttaaagactgctgggtattcaagcatatttttatttgtctaaatatgaagaagtaaagaagagtcacatgaagaagataagatgatttttaggaatagtaactaatggggactcctgggcccaatgtttgctactatgtcattatcacaagccaaccttatcactgctgagaatggtaagaacattgcacctcattattgggatcactatgagtttccaagtttgagttttgaacctcaatcatagaagagattgcaaccttagtgttttagaatttgaaaagaactaagcaaaatgtgtatgagaaaaaatataaacatattcatatattatttaagattattttattaaatgataacctaagcttttactggaaaactaaaaagtcaacagagaagagaacaggtaccgtggtaaagaaaaacagtatgagccggacgtggtggctcatgcctgtaatcctagcactttgggaggccaaggcaggaagatcgcttgaggtcaggggttcgagaccagcctgaccaacatggagacaacctgtctgtaatataaatacaaaaattagctggacgtggtggtacatgcctgtaatcccagctactcaggaggctgaggcatgagaatgacttgaaactgggaggtggatgttgcaatgagccaagatcgcatcagtgcacgccagcctgggcaacaaaacgggattccgtctcaaaaaacaaaaaacaaaaaaagaacagcatggagtatgaatcttgagacatggttaaattcctctctgccttttagctgtgtgatcttgtgctgtttacttaaactttctgaggcactcccttcagcagtaaaacaaaataataataaaattttcaaaagctattaaaaggatgatattagataatataaaaaagcttaataaaatatttattattcacatatgatttccacaaaatgaatagtatttaacctagttggaaagataaaatgtgcatggtaaaacactgattcatttccttgttcgaggctgccaactttccattgtctgaagaataaagtccaaatattttagaatagaatttatagtcttctacaacttacaacctggcttcaatatatgtttccagcttcacctcctactactcatctttacaagttctgcatgccagtaaccctgccgtccagcattcctagacacctcattctcagcaccccttatgttagccacttacatatcttggctcttgttattcctccttgaagaatactccttctctgcctacctaacatctacctatgtcttttaatacattattactatttacaatttttttaatggactactatacctaaagcccagttcaaatgccccctctttcctggggattcatataccaccactagctgtcatccttcattctctaaacttccacagcccttgatttgtaacttgcttgctcttaaaagcgaaaccaaacaaaatgaaaacgtattatacaacagccacacgtaaaaaaaatgtctaatgtctcttactgaagtgtaaaggctttatgaacagaattatgcctgatacggttttatttcctcaagatgctaaaatgagataattcacaaatattatagtaaatatcagttcaataaataaacgaaaataatagaaggagaaaatatggtataggggaattcgtgttacaagctatttgtgtaaatgagagaagaattcaaagcagagaatgatcattccagcatgaattgccaagtagaagtgtagctgaggtggagtttgaaggaaggttactatttggatgcattaaaaggaagtggaaaggcgttccagctagaaaaaatatataagcagtaccctagaagaaaaaaaatgtattttatttgtggtaaaggtagagaagtaacccatctaacaatcacatgggctgtgccacacatcaatagaaaataaaaattgctgtaaggtttaacaggcgtattgctgtacatatgaaggagacattatgctcttgagaagtcacttgtggcataatatacattataaagaacaaatgttaattatatgtgactgatcaatataaaaaaaattgtaggatattaaaggtaaatccaagaatttgagcctgaaagattggggaactgattttatccctgatagcaatgaagactagccacagaggcccagttaagtagatgaaatagcaaactctattttggtcttgaatcaaagagaagggcactttggggacaggtgatactgttaaagccagtgtttttctgagagagtactctctattatcaccacttaggtgcaaagattctgatctctatgcaaaagaacactcaacaactggatgctcttttaatccaatagagatccttccattttcctaaaaaaaaaaaaaaaaaaaaaaagaacatcaatttgtattaatctagagcttgctctagaacctgatataaacatagactctgaaattccacacagacccttcagtcagtgcatgataaaatatgctgattacagctcgcatatccccacaaaaagcaaaatacagcctgttgttctaccttattattctattattgacatattcataatatacagcagttaacttttaggatgtgaatatttctgtaagagggaattatcatttaaactgttgccaaagtgaatgatcggctgtgagaggtagtataggagaagagcaggtttctctgggtgaaaagagaggacagttgccataaaggtgggcggaccttatgcactctcccaggctgaatcgacaggcccacattgcacaggcccaaagggcactatttccattgtatttatatgaaatgtaatttcttgaaacacaattccagaaagccatgtgaatggtgctcccggaactgtgcaacttgttggctattttctagaccagagctcagttcaaagacaacaatgcattttctaggagtttcatctctttatttgtatttttaatttaagtctacatgtttcaagattggtctacagccccaccctccataatcaatgcctggattttaaattttatatgtgtacacataaattttaaaattttaaattttatatgtgtacacataaattttaaaattttaaattttatatgtgtacacataaattttaaaattttaaattttatatgtatacacataaacatccatctatctgtatgtattatatctataaacaggtgtgcatgtgtgcataagtatgtttatctattatttagaagtagacatattctaaggcatctgagcaatgactttattgactttatggagactaattattgccacaaaattttgaaacgaatgtttctggtttgtattatatgtttcactccaataaagttaagattaaatcactgtgaattgaagaaataattgtttgaggtagttcaaattgagaaaatggagtaatcaccagacttttgaaaagttaaatattaatgcttcgacagtaagaagacattttacttagcaggcatacgtctttcagaaatcccagctctaggaataccattgttagaataattcattcatagtaagactaaatagcaaatattcaacaagaaatttatctgttcccaattccagcaattagttgataaaacattttaatgtagttttcagtaatgctgtcttattaactgtcttccaaaattttttttagtgatatcattacatttagcattttaggatttctagcaggcaaacatttagttaagtatgaagtctaattacccttaagtaaaaaaaccaagaaattagtaatataattttattcaacatacttatgtgaacagattctctgtataagtattattgaaataaaagcatagaaacattaaatatataactgcatctgaactgagataattttatgtcattaaacattaaattaatattgctaatttagattgaattgtctctgtatagacttgtttataatttaatttgtaaattatctagtttcatcattttgtacgcactataaacaagagaattttatgccatatacgtgcatatataatacgtagtaaaaataacctaagttgacagtggatggccattaatacggtttttcattataaaaagtgagtcctttacctaagttcgaggaacactgctccagaagatctaggtccaaagaatacagcaccaaaccaacacatccaggacataagcctttcaagtccttttatgcagtgatccatccattcatatttattgaatgcctcctgtgtgttagacactggagttatatatcaatgagcaagacagacgtttcttatcctcaagtagtttacactcaaatgagtgagacagataattaacatgaaagcaaatagttttttttttaattcaaattgcattcagtgtatgaatggtcctgtggcaaacagagtaactgggaggaccagttggtattaaataatcatccgtgggagcctcttggagagcatattgcttcagatgaggccttgatgaaagaatgagccatgtaaaaacaaagagtgaacacggatggcaaggggaaatgttgcagaagagggaacaaaaaattaaaagcctctagtgtcggaaaagtttggcatagcctaggaagtaaaagaagaatactgtggctcgaaaattgtgagcaggaggaagaagagcatgagacaaggtcacagaggtaagcaagacaccctgttcagggccttgaaggccatgttaaagtgttcttctttcattctgagtggaatgggaagacattgaggagtacaagcagtagacaaacatgatataatttatattttgagaacatcaggctacagtgggtaagatggctagatgtgtcatgaataaacactgaacactcatagatggacaaggatacgacctcttttattcagagccaaaactgtcttaaaaggaactagagccaagactgtgtttacaagtgtgttttatatgttttaatttgagttgccaaaattattaaaatcatgagatttcacttaaaatatctggatttcctcctgcatctttggatttgttttactattattattattattattttctggaagatccagtaacattgagcctgcagtcctgcctagaaccaactggctggagctgagtagtagctggttaatttccccatttggaaagtgctgtgatttcatatttgtcacatttcttccaaatcccctactgcctaagaactagcctacctcattcacttttcttacttgttggctacagctagatgcatttattattttctacttcctcatagcaaccatagtaactaataacaatcacagcccttgggagctgttcctagtgccgcttcgaaaccttggtaaagactatgccaacttgatcttttttttctaaacctgatcttaattcacttattagtcccagatgactttgtccgttgtttctccaagaccacacctaggcatgaaacatcaacttgtcctatctcattgctcatccaagcctagtgcttagcttcagttctgtgagccattatcccaggtctcaagctcgcctgttcgatcatgcttgtttctgaagacattcacacagggcctctgcactatttacatctactgttcatgtcattgctggaccctttgaggggcagggtattgtatacaaaattaagtgttttagttggcaaaatcgatgctgcctaacgtgctttgtttataatatgtttataatgtaaacgtaaagaatgtacaatcctaattgtattttatgtgtaacctcttgggttgagattaactgaagcctgtttctagttttatccctttactctcatctgcctggaaagtatgcaatttagtcaaatcatgaaaactaaatgtttctaaaagaatgtaagggtattaggtcgggaattttaacttgttcattactgtaactccagtacctagagtagtgggacctgggaagcttctcagtacatattttgttgagtaggaatgaatgccaggctatgagacatgcagcacaatattgtgctctggacatatgagatggctaaatggaaaaccatgctcatgcttgctgacaagatctctaaaataacagaagcatcgtctatatcactttcttctccaaacaacaccagttacttaactataagctatggcttctggctcatatgctgttttcctaagctatttatattatgaatctataatatccctcagaataataaaattcttcattaattacctcttgataaaagtaactattggttcaatacataatcttgaaacataccaatagatacaataattatgaaattatgaaatatctggggaatatttcctaatatggaaatataacgttcatcactaataaccacatacgaaaatagagttacctaaatattgcttaacccaggtctaaattgtatcttccaatcacagtcacatttctttcctcttcttcctcttcctgagcaaaacttcttggacggaaaagacattcatcagactcagcataaaatgaaaatctctcagtccattagctccacctttatcaataccacattggaaatgacatagttgtgattcttttctttctctttccttccattcaatacagaaaatgtcaactcttgccaaattaattctaccaccttatcaccaaactaaatattaacaaacgaccatcaaagacaaaagttatgttgtgtgagccttaattggatgagaacctcgtcttgctgcttgcagggagtcaactgtcaggaaacggaatttatagactaacctgattcctaagacttgtttaaaacaaaaagaacctcaagaacttcatatgaccatctttctctctgtagggcaatacatacttcggctttgaaacaacatctgaatcaatgtgctatctttctgtgcactaactcaactgatttcatgacaaattaatttgtcagaaatcaacaactgcaggttagagatagaaataaagtcacatgaaagaccaaattggggctattttggatctgttagccttatgataggatgctttaatttatgcatcatagaaatctctttacaccactgcctgtaattgcagcatctcacaatgcttgcctgcgctctggtttcactttattctggaaaagctggtaaaaagtcactttatgtaactgatgacttgctgggccaaagtaacttttagacatattatctaatcattttttaatctcgtgatatcattattatcacaataataaaaataacaataaaaagagcaaaaatactacacataaaaagacttagtgagtttcccatcatcaaatggaatacttaattttccctatacaaatttccattttttttaattctctatgtgaatataaaattgcacattacaaaaaacccatgcccctaattcattcttcactccaatgccgtcattgctatagaagacccatttaatggcctatctaaatccatttctttttcttctttgccaagagagtctcagttttcttcagaacaacaatgtgcttagtcccaggtaactaatcataatcaacgcaagccaaacttaataatactatgcctcacttctagccagaagtcacctactttcggtaattagacttgggaagaagcctttgcagggatgtttgggaaacttttactcccctgaggagaaagagagactagggtggcaggcatcactctgccacccttttgctgctttgaatttaggcttcatatctggaactgcaacaactatcttgagactaaaaaagcaagtcagagtataaatggcaacacactaaagataccacagaaagagctcctagacacagagacgggaatgacacacactgggacctatcagagggtggaggctgggaagagggagaggatcaggaaaaataactaatgggtaacaggcttaatacctgggcgatgaaataatctgtacaacaaacccccatgacacatgtttatctatttaacaaacctacacatgtacccctgaatttaaaataaaagttaaaaaaatactaagttctttgtgaaatccagcaaaatgcctactttcagacttagtatttgagaaaaatccatcctcatttgatgaagacactgaagtctgtaacttacagtggaatacttttctaagtgatacagtggtttttttagtagctcaggacttctaaagaaaagtctcaccttgtttcttgtgtttctctttaaatctgctttccactttagctctcaaatagccactcaaattgctcacgattctctgaattctctctgtggttcgctgcaggattttgtaaatggttctacctccatcactgaagtattttgccatctttatttttcttcatcaaaagttatgttagtacaggtgtatttcatgactcagtaagtctacccctagtaatgtttcaataagaaatgcatatatatgtttatattacacatatgtgtgtatggatattgtatacaaacatatataaacatataagtgtgtatgtatacatgtgtatgtatgtgtatacacacatatgtatacattcacaaatatacacatttatatacatatatacacatacgtacacatatacatatatatatatttaccaaaaagacagagattgatcatagaaaacactattcataaaaaccccaaactgaaaacaactcaaatggacatgagtggtaaaaaggataatgtgtggtatgtttatagcactgaaaatgaacaaattgcaactatagccacatgcaacaataaggatagatctcacaaacataacacaaagcaaagcacctaggattaaaagaagatgtactgtattatttcattgattcaagttttcaaacaggcacctaatcgatggtgtcatcgcaagataattgctgcccttggggagggcagtgactggaagaaggaacaagtagagctaccaggatgctgggaatgttctgttttctaatctacgtcatagtcacatggttgtgttcactctgtgaaattacaccacactgtatatctatgattcgtgcattcctctgtatgtgatatttaaagaaattgttttccaaagcaaaaaagtttactcaggccaaagaattatcattaacataaacacatttcttctacaacccttcctttggttccttcttcacttctatttaacctttttctctcttattcctccatagaattttgtctacacttaccatgtaacagatatcccaagatgctttgtattacaatgtttgtatatgtaaacacctcttctccccataagaccatgacctctctgatggcaaggatctcatctgtgctatgtcatactgcaatgcaccagatagatcagtaatcatctttgaagggagttttacttcaaaatagctttctataaaacataggtaccaaaaatcagctgttttgtgtgcttttgcatttttgagttttcataacctaatatcatgaagttttgcaattcttaaggcagctgtagtgtagaagactcattggatgaaaaatgtgatgaacttatttacaagccttcacttgacaccacctttagctgtggaaactaatacaggcaactttacctcttagatctgcaatatcttcatctaaattatggagataatcatgtctgcctcacaaaattgctatgtatctcaagagacttaatgtatatgatgttacataaactctgaaactgtatataaactacaagcattgttctccatcgtcttccagtagtatttcctagcctttttcatgtcatgtcacacctagaaaattataattattgtacaatacactagagtaaaataacaaggcttcttagagctggaggacaggtaattatgcacactggctagaaagcactagaaaaccatgaatttactaaaatgaaaaattctcgctcagataggatcaaggtattgtgtctctcaagcaacatgcattaagttgagctcaaacacaatggtaggtgtacaagacagattgctcccatcaccattgggatcaaaacaggagtgtcattcatcatgtaagagtattcatactacagacttaaatctcctaaactgaatttggaatgtttatctaggtttgtatggactttttggtggcatcgcaggaagaaaaactttataaaggacactttgtttgtatcttacatatctaatgagaataaatttgtaaacacctgatcaatacttaagaaggaatgaaataattattttgcacattttcttaatcactttttctagccaaaagattcatatcattagttaatatataattgtaacctgattcattcatgtttctaacaaattagtttccagttctttcctatttcctccacccttatggagaaagaaaaaaatatataaaaatgacatacacacacacacgcaaaggtagggattgatgtttttttctcttaaattactgagatattagtagtcagatggggagggtggagaagaagaaattattattacacattgcagagttttttgaaacagtctcatttcctcagcaattcccaaagcacggtatacaaaattatcttagttgacacacagatgaaactgttaaaaaaaagtatggttatattaaagtaattatttttatagtagaaaaaacagcatgctaaacttgtgattttacagacaccattactaggacaaagcttaattaatttttagatacgttgattaaaagagaaaggatcacaccgatataacacaattcttcaagaggtgcaagaatttctagttttgggctactgtgttagttgatatttgctcctcacatgtcactaggtgtgagaaaagcctccttaatggtgctttcctctgggtcagttccaaaatttttccaatttatacacaggatggtagagataagaagtgatgatgcctcccaagtagctgggaccacaggcatgtgctatcatgcctggttaatttttgtaatttttttttttttttttttttttagagacagggtttcaccatgttggccaggctcatcttgaactcctgggctcaagtaatccacccttatttttaggaaaacttagaaatagtcatctcaatgtgtaatcatgggaattacaaatttaggagacaaatggaaatataaagagtcagagtatgccttggccaatgacagcaggagtccagggtctcagtctaggtgctgagactgtgtgcctttagcagatttcttccttgaacctcagcttgctcatctgtgaaaggactaaattatctctaaagattctctctgcaacatcaatctgtgagtctacatataaaacattaactctgcattaggagcacagttagctgttaagtatgtcaaatggacttcttcttaactaagtggcccataaattaaattcttgcttcttccacccaatttatgcacttatccaagtctatgtgctaagggttttattattttatagcaaattttaccactcaaaggaagacataagaaggcctcaaagaatgtattcgtcaggacttgcacttctataaagaaatacctgagcctgggtaatttataaagaaaagtggtttaattggctcacagttctacagactgtacaggaagcacgatgctggcatttgctcggtttctggggaggcctcaggaaacttacaatcacggcagaaggtaaagggggagcaagtaattcacacggccagaccaggaggaagagagagaaaagggggaggtgccacacacttttaaataaccagatctcaggagaagtcactgttgcaagaacagcaccaagggggatggtgttcaatcaggaaaaaccacccccgtgatccaatcacctcccaccaggccccacctccagcactgggaattacattttaacctgagatttggatggggacacagatccaaaccctatcacaggatgatttttttctgttatttagaagagaactagctatataccaaggacacagttctgactccttggatcagaagagaatgacagaacagcacgtacctagagatttatctaaacacttcagaaatcaaatggcaagtttcatgtttctagatactttctgaaatactttctactatttagcataaccaagtatgtcttgcatctctgtcttcctctgtagcttcccctccagtctccattagagctcagaaaattcactagctcttcctctcgtaacatcttagatttgacacagaatatgggagctagaagacacttcataggtcatttatttctgcttcatatcagatgtttaactccctctgcaatatccctacagtcatctagcatctgtttgtacaataacagtcactgcaaagttgataagcagccaaaacatccattgtgttctctacaatagtacttcctgttggcacagagctgcttttcaaactaaatctgtcaaacctacttctacttcctcaaaatcatcagaccatcatatcctacttcaatctctcttctttaggttaaatatttttagtctttacctgttccttctgagtcatgattccaaatcctactaatatcctggtcattatcccctagatgcattctagtgtgataatattccttgaaaatcatgattcccaagaccagatataatctcctccttcccacctgcaaatgctttgtgatctgcatggaatacaatggtacaacctactgtatcatgcattctattccttctctcatttgtgatttatttaatatgtgggacacagattgaaacacagttgtagtacagagaaacactagtaaaactcaagggcttatctacatacttgaaagtgctgtgggaagaattggagggcctatgcatatatatatatatatataaaatacatttttctttttgagatggagtcttcctctgtcacccaggctagagtgcagtggcacgatctcagctcactgcaaactctgcctcccaagttcaagcaattctcctgcctcggcctcctgagtaactgagattacaggtgcccgccacctcgcccggccaatttttgtatttttagtagagacaagatttccccatcttggccaggctggtcttgaactcctgacctcgtgatccacccacctcagcctcccaaagtgctgggattacaggcgtgagccactgcacctggccactaacacattttctacagtctcattagccataatccagaaatcatcctaatctctgaagaaacctaataacaaagctatactgaacaaagctatacaacaacatacacatttatatctatgtatgcttatatatatgtatgtgaatatataaagtgtccgtacataaacattttaatcagtcttactttgcatcacaagtagtagaatatgaatgttttttcccaagatacttacatcatgcagtatataattgtttttatgaaagctgttttccacaattcacaacaatgatatatataaacctatattatatatgtgtgtgtaagtctttatcaatcataaagtgttttagacctacttgatctttacagaactccaggatgctgtaaactcaaggaaagaattagcacactcattttcaaataacacacaaagcttgtcaaaattcacatagtttttaaattacagagacaaaattgtaacctaggcctttgtattccaaatccaatagccctcacctttttgaaacagggtcttgctctgttgcccaggcttaagtgcagtggcgtaattatggctcactgaagccttgacctctcaagctcaagtgatcctctcaactcagcctcgagtagttgggaccataagcatgtgccaccacccccaactaatttatatatatatttatatacagggtttcccatgttggccaggctcatctcgaactcctgggctccagcaatccacccatcccggcctcccaaattgctgggattacaggcatgagatactgtgcccagcctaatcttcacttttaaaaacaggaaaccatttgttaaaatccatgattaaagtttttctaatcataaatagagctagactcttatgtaaatactccccaaagaaaccacatggactccaaaaaccattagcagcctctagtcacaaatgctatgatcattcttaataggagaaattcaaaaccaagaaaagccgaagcaagatgaaacatttataaaacgtctaactttccaccccaagctaatggattcttgccaccactgcaatatcttacattgcttaaaacaaatgttcccagatctaattgtacaatataatctcggggggagcttttctaaaatataaatacagaacctttctgatagaggaggtctggtgcaggacaaggcaatctgtttgacaagagtctgatgtgactctgatatactggtccaagcctgacatttgccagccataggaagacgcttttacacttgcaatatccgccgtctttttcctgcaacatcagctttccttcttctagtcaatctatctcatcagcatataaatatgctaataatatttttcataaaaacaatgttctcatcatctcacattcccttacttctccacacaacttcactgcaaaactcttagagaaagatttttccatactcactgtccccactacctcactttctagtttcctgagccctttcaaatcagactttgtcacccacttctccgtcgaaactgctcaccagggttaccaatgacctccacatttcccagtcaaaagatccattcccagtctgcgtattgtggataactctcatcaagctggtcattcctttctgccactttgttcacttaattcctgtgttatcacactctcctgaatttcctctacttctcaagctactccttctgggtttttggtaggatttagctcctgatggctaaatatagaacattgcaggcttagtccttatatctcttttcttccatattgacactaactccttacatgactaaatacagttctgtggtcctaaataccatcatctatatgctgatgaatcacacactcatgtctcagcccgagtctctcctaaattccagaattttatctttctattcaatgtctcttctctactccatgtgaaatttaacacattcaaacagaacactttattcctccgccctctgccgcctccaccccacaacacagatttactctatttcccaaatcagtaaaaggtgtcactcttcacctcgttgctcaggactgattacttgagtcctttttgaggactctctttctctcaaatcccgctgtcaatcaatagcaaatcttgacagttctaccttcaaaatatattccaagtcagactatgtgtcactactcaacacattatcaccctattccaaacctcccaccagaaatgctgaatagcctactaaatggtctccctgttagagtctgttttcatagtgcagacagagggatccgtttataaatgtaaatggctcatgccaccgttgtccaaaatccttccatgacttcccataatcctcattcccaaatatatgtcacagtgtaagacaccaaataatctcctttcttacaattcttcttccctttgctcttgccgcactgctcttcttgcccctctttaaatatgccaagttttttcctgcttcaggacttttccacctgctgttccttccagctgggatacaccttccccaggtatttgcaggcttgcttcctcacttccttggtctttactaaaaagcaattccctaggagaaaactgctctatccaaagagttcttcctttcactctctatcccctcaatgggtttattctctttatagcacctatcaccacctgacattctattatacacatgcaagttgtttatttattgttttacttctgcactagaaaataagctttcaaaatcaacattatttggctcaccactgaatctctagtaattaaaatagcacctggcaaacagtaggccatcaataaatgaatgaaggaataaatgaaagagcaaattcatcagcctgaagcacatgttctttcttggccccatgactcggtgcacattttcccttttacttaaagtgttctttctcatcaccttctatgccaagtgtatgcctatttatttttaaaactgcaacttgaatgataacttgctttcatctctgtttgctcctgtggataattattcttatctttagcacctatttttgaagatgtacttttgattatatatttgctccctggctacactatgaactccttggggcaggcgttgacttatctttgtatgcccaaagtccggcacctactagaaacaaaattatgtctaaatgtgtctaatcactagtgcttaagtgagcttttactatttccttctgcctgtgctgttatttttactaacagctgatgttcattaatgtggttgccacacctaaaagtagttcaactgttctctctgaattacagataaaaatgcatgtaggtcctaggaattaaaccctgattgggtatatatttgctcaccattgactggcctttaataatagaagtcagtctggatattggagtccattaccacacactttgtaagagtctagttactagttactctttgattacagataaaaatgcatgtaggtcctaggaattaaaccctgattgagtatatatttgctcaccattgactgagaactagagtgacacaagcctttaataatagaagtcagtctggatgttggagtccattaccacacactttgtaagagtctagttactggtaactggtgaaacccttaaaacaagtttaaatcaataaaatgcattaatctctatcatgttatcccagtccacaacacagactgaaaagtttctatttaactgataaggatagcatcttctgtaaacagcatcataacagaataggtcagaaaaatttgtgtgcaacaaaatagctattggaagatatacctcttacgccaaagaagctgtaagattcatgttggtataatttgcttctgcctttaaatctctctccaaggtgatataaaatgaagctttatttttatccctgatatagtctttgtgttatgaatgcatcaaatataacaacagtgatactaaataagttatatctgtgtcatgctttttatattttacgctttggacgtacactatttcatttaaacttcacaatgctttgatggaagcaaggatgatcataatcactttacagatgagaattttgagagtcaaagaggttaagaaacttgccgaaggtcatgcattgagtgaccaaaataactagatttcaacccaggtcacaagtctacaaatcccaagtgtactaagaggtaaaagttctggattcaaagatccagccactttatacagacttggggctttgaaaaaacatctcaagcttactggccctcaatttattaatctgccaactaaaagggtgcattcaatgcctccaattgttgctagcatccatatatatatatatatatatatatttttttttttttttttttttttttttttttttgagacagagtcttgctcggtcgcccaggctggagtgcagtggcgcaatcttggctcactgcaagctccacctttcaggttcatgccattctcctgcctcagcctcccaagtagctgggactacaggcacccaccacctcacacggctaattgtttgtatttttagtagagatggagtttctactaaaaatgttagttaaagtgttagccaggatggtctcaatctcctgaccttgtgatccgcccgcctcagcctcccaaagtgctgggattacaggtgtgagccaccgtgcccggcctgctaggatccaaatattaagattctgcatttaaagtcacttacgctctctgcacttaagctctgtaaccttcattagaaagttacaacccaggtattattttattcttcctaaaatctttgttgcaataataacagcaaggtgcattagaattagtgaaacttggtcatgcctaaaggattcatgaggtgagaagatcaatcaaaacaaagtcctgcctctgtcaatgtctgccttagaaatgcacttacacctttctgagacagctggctatttttggacataagaaacctgctaaggatgcccaggtggcttggaaagtagagctgacacagatctgaagtcactggacaatcccagctccacatactgtctttcagttatttttcctcttacacacctggaaggatttacttgagtctcaagtgctcactctagttccagctcaaccaagaaccatgccctttccatttaaaaggtgagatgacaagagtgcacctatttacaattgaaggtctagaaaatagaataggatttcagaccattctcagtttgtccctgtggtattgctgatataataaatccaacatccccccacccgccacacacacacagaatagtcaggcaatttctcagcagatgctacaaatttcgctctatgccagtccgctgtgcaacagcctaatctatcctgttcaggttactactctttctgcttcatttactgcccaattgcttctgagactaatccaactctgaacacagaatgtttttttctagttaacatgaatgtaagaaatcagagaatattagccaagcaagactgctcctcctactatgactgaatatgcattcccaagtgaaatacagataataaataactacattgtgcttaataagtgccaggcactatcctaagagctttgcatatattaactcattttactcctcactataatccccataaagtaggtgctattgttattgccattttatgaatggagaaattgaggcactgaggggttaaagaacaactctgaaggttgttcaagatcgcataagtggtacctctcagagccacgtaaaacccaggcaacgtggctccatagtccatactctcagccgctgtagtagactatttcacatcaggctacctctttctaaatttgataaatttcttttaacaggcatacatttcaaaaacacaaatttgagtgaaaaataagatgcagagagataagtaaagttagatataatttatataaatgtttaaaacactcaaaaccattacatatatgttaagaatgtaaacacatggactggagggacacacaccaaaatcattatagttgttacacctgagaaaaaaagaattggagaatagagctgggaagggttctaataattttaattgtatcactaatatttaacttcttcatttaaaaaaacttgaaataaatatgacataaagtcagcaaatttgttcattctaagttttaggtgtattggtgtttgttaccatattctctgcacatttctgtttcttaaccttaaaaacaaactacatatattttttcttctattccttcctgtgccttcccaattccaatgccatgaactctacttccagttgaagtcatggaatccataagtattgcattttggaaaacaaaatcatcatgatgactcatctagggctagttagcgtaatagtaactacaaatagaatatttccagctgagagtggtgaaaacaacacaacaaccataccactcaactagaataggaactgagcacacgcacacaatgacagcagccaaccgtaattgccagagaagataacctacaaacaaaaatatttgggagaatttatttctactctaaacatagcagtctctgctagaacaatgacaatgctgattaagaatggcacactttagacatcattaatatcttaattaggatcagttttgctcacatgttatctcccttatcaaactgtgagttcttttaaaatagggttcatgcaggctcattgcttggcacatgacatgggtcttagtaatgctagttgaagaaaacatataaatgaagcaatatttcataatgtcattctttcccaaacctaaaacattcaactcttcaagcagtagggtgaccaatgaggctggcctttaaaattcctatagctagatagataccagtctgggaagtgtttgtaattgttgctccctagggtagagatgagaattttcccttgtcctagaaattactttgttttgagagggactgccttgtgagtctttctaatcatacaaatctaagtccatttcccattctttgttcttggaaatacccctcccaccaccaccattgtaacagatgcttccaacgaggtgttaagtattttgtttagtaatttacattgggtatattttaagcagaaccaagtttaagcagacttaaaaatttttcctctgcatttggctgccctgtttgaaaatccttgtttatcattcttagaagaacgtcttatttttcctaaaagtctgtgagaacagatcatcccaagaagagcatgtcagactaatctctttgcaatctacgttgtataacagataatggaaaggtgtaatgctacttgggccagactcttagtgtttctcatccagtgtttaaaatgaaataacccaaacacatagaaatgtacagataactactgtgattactttttctggaccaggagtggccagactgtgtagataactactgtgattacttttctgtaccaggagtggccagaccatgccctgtggtacaagcgtttctcctaaaagacagagatgctctaccttcagtcatgtggcagtaagaaaagcaactaacgttggaatgggagcaggaattttctctatggaattgggagtagcgcctaattgctagaggaaacaaagaatatccattatgcatatctaggctagaagttaaagagagaagacgaagaggctcttctagggaagcacatggcctaagggctgtagaagcagtgatagctaatatctagcttaacatttccattttctgcactgtaatacacttttgttttctgtaggaattcagcaaattattccaaagacccacagtctgttttttcttaagactgaaagaggagagtggcaaagttcttgcgcctcagcggttctgagttttcgaggaaagttggtggatatgtcaaataaacaccaggataaatttgtggaatgtataaatacttacagtgtttcttagaaattacttggtgacagaaaaacagcaagaaaatgaaaaatcggcagtctactcaatgagcccagctgtcaggacttgagaaataaaagtgaatttactttttagtcacaggttaatgaggtcaaaaatttttgttatataatttataatgttaaattttaatatgactttggcttgcctcctgtcctgatcctctgaataatctaccaacataagagagggttgaaaatggatcaccatagactattcagtagtagtgttactatgccgaattccaaaaaatcagtgatccaaaatcacttaaaagactatcacccaagttatatgttacagccaaattactgcccaataccattttacattttttatccgtgaaaaaccaaattgaatttttttctgaattctatggatattatggtgattgttagtttttgttttggttttttttttttggtgtgtgtgtgtgtgttttttttttttttttttgagatggagtctctcactctgtcacccaggctggagtgcaatggcgcaatctcggctcactgcaagctctgcctcccaggttcatgccattctcctgcctcagcctccggagtagctgggactacaggcgcccgccaccacgcccggctaaattttttgtatttttagtagagacggggtttcactgtgttagccaggatggtcttgatctcctgacctcatgatacccaaaggaatataaatcattctaccataaagacatatgcatgtatatgttcattgcagcaccgttcactttgcaaagacatggaatcaacctaaatgtccatcagtggtagactggataaagaaaatgtggtacattcaccatggaatactatgcagtcataaaaaagaatgagattacgttctttgcagcaacatggatagatctagaggccgttatcctaagcgaactaacacaggaacagaaaaccagatactgcatgttctcacttataagtgggagacaaagaaagaggacatataaacactaagagaggaaccacggacgccagggcctacttgagagtggagggtgtggggagggtgaagaccagaaaactttctattgggtactatgcttagtacctgcgtgatgaaataacctgtaccccaaatccctacaacacacaatttacctgtgtaacaaacctgtacatgtacccctgaacctaaaagaaaagtgaaaataataaataaaagaatatctatgcctttgaaagttacacactgtaagagttaacatttgctctctcactttccacagttacttcctggcccacaaaagaggcacttctgcctttcccagagtattggaaataagagtctttacccttccatccattcttctcactcttttccagggaagagaaaacttttgtgtgtttggtgagatcggggggaaattgaacacgtgaagtgtagcctgttgtttctttctctgtggatcaggctggccacaggctggacacatcctgagctgctgagtaggcactaatgggtcaggacctcgacctgcctctacaggtagatgtggaacccaaatctctctcacactactattggggttcaacaaagatgaggcggggattctcagcagatgagtcctctctgtagacccagaccttccctctggtgagttcgacgtgtcaagatttagttttgggagaaaggtgctaagttccattttgatcttctccaatctagtattccagcaatcaactaagaaggtggatagccatctgtttgacaagtttctgtattttctcagttgtctggaactcagaatgaaggagggagttcaaaggaagaaaatgaaagaaaagttattactgatgtcctcccccaagcccacagcacacacaaaaatctaaatatcaaatggcattgagtagactggtacgtatggtacagacctgtaatgtcattccataacgtaatttaaaatcatgtttgggagaatcttttgtaaaatggcatatccattagtatttttaaatacagacaagcttaaaaaaaaagaaacaaaaatgattcactattctccacctagctacacccttacttatatttaaataaagtcaatatgtacacatcattagaaacagcacagaaatgcacaaagctaaaacgggaaagcctcattcccgctgcttcagaagtttctctcttcaagtaatcattactaatagctgcttgtaaatccttttggaaaaaatatatgttccaaatatttcaatatatgtacctctttccatatttagaataattgtttagtcccatagaaaggaaacaaaacatattaatgtttgtgtgataacttttgtttaaaaaattcacacgcatagaatagaagagattatattggggttatagatttataagagattttcttactctacagagattttacattttcaaagtcttgtgctatcatcagaaaactgcataatctgaatatatatataatcactagtttttaattataaaagaaacacatttttaataaaaatttaaataatataaacacatgtaaagtaaaaagctagtcttccttttcagctgtcaaattccctaaaggtaactgcggttaattgaaaaatcacagaattataaatctgggaaggagattttatttcttatcgagggtaacagcctgctaagtggccattcccacaggctgggaagtgtagctctggcgaagaccagacacacgaacttcgaaggaggagggttggggtgggagctttatgctaaacagggtggctaatataggaggagttacgaatattcatgaaagtagttctgatgcatgcatactgaacaaatatgcatgtaacatatgacctatgttcactttggggtggaggcttaatattaagtgtattacagttgggcccagtgggtcaaaaggtgaagcagggataggaaggcactcaagtgcatagcttctgtaagccagccagagccagtgcatggtcaatggtctcttatcaggagaaagttactgatatcaatctcttgtccaatcaaagctacagttatcacttgtggaagagaagttgggggtcagttagcatttggtggagctgtaattgtttcaacattgcttatctcaaagccagtgcctgtttagctgctacagaaaaacaaatatcctgtggcagttagaacatagtttattctttttttgttttttgttttgttcgttttgtttttttgttttgagacgaagtctccctttgcagcccaggctggagtgcagtggcatgatctcggctcaccgcaaccttcgcctcccaggttcaagcgattctcctgcctcagcctccagagtagctgggattatagctgcgcaacactgcaaccagctaattttttgtatttttagtagagatggggtttcaccacgttggccaggctggtcctgaactctcagcctcaagtaacctgcccacctcagtctcccaaagtccttggattacaggcgtgagccaccgagcccggctaacatagtttattctttaagtgtaggggtgcataacttaacccttgcctgggatggctttagattctatttataatttgctaatttttggccacaaagagtctgttctaacagccgtatgatctccattttaacaatgctggtcagttgtgtctaaactgcaaaacagagaggatataacggcgaatctgacctcccatctagtcatggccattaactcagtttttttttttttttttgagatggagtcttgcattgtcacccaggctggagtgtagtggtgtgatctcggctcactgaaagctccgcctcctgggttcacgccattctcctgcctcagcctcccaagtagctgggactacaggcgcctgccaccacgcccggctaatttttttgtatttttagtagagacggggtttcaccgtgttagccagcatggtcttgatctcctgacctcgtgatctgcccgcctcggcctcccagagtgctgggattacaggcgtgagccactgtgcccggccatgaactcagtttttacagcttttaaggctcttctggggtgagcctcttggttgagaggggggtccagtcagtcaattaaggggcttagcatttagttgtagtttatactgccattagcaatttttaatgcatttgaccaaatacacacacacacacacacacacacacacacacacacacacacacacatacaagcacacagacattttaaatagatataaatatatttaaaatttataaattttttcaggataaaataatgtacatagacctaaatcttcacctggggaagtctcggtttcctaatttgtcttctataactgtaaggaggaatgctatcttactttatctcacgataagatttgcaagcccaaaggtcaaaggtaatgattgatgttctccatattccgtaccatggcagttttagacaatgcaacaccaacttttcactctccttttcaccacttttaggtaatccccaggctgcttgtgaacagaagactgtcaccaggctgaaagggctattactgcccagaattcctgatctcaattaatcttctggcctcagccttttaggaactggaactacaggcacatctactatctctagtcaaagacttatttgcataatggtggaattagttggggtaaaaggatcatcatcatcatcattttgagaatggcttcataatgactgtaactctgctatccacccacaagttccttagagccaaggtcagatgctgaaccaacatggcgattcactggttctcaagttcctccaagttaagcaaataattagtgccttagaaaaatgatccagctagcaacaacccctctcccctcaaaaaaagagattcatcttgtgtcactaagttttatttaaagaccatgcaatcgcatcccagctggcttcattgaagtaacaacgtgggcaatcagtgacaccaactgcaatgctatcgtttctataaacagtaatgagtggagggggtaggtcggtactagaagcttatgtataaacaagaaagatcatttcagaaagagagattgtctcaaaaaaagtcacagtatctttctgattgtcaccctatgaaatgcaaatgccccacatttaatggcatcagaagaaatattcaaacatgacattcataatattgtccagtgaaaattacatggcataaggataacaattgcatacactaaattagacaaagaacaataattccattgttttaagatactccatagaaactgagataacagatctataagtactcgctggatgtctctttataactctggtaccacagaatagaacttgcacctttctaagaagctgatttctaatatatctggctgtaaataaatggatttatgttgaagcaagagcagagaaaaggtatcacatagataactttgcaggatatctgaatatgggcaaagctaagtagacttgaactgagttgtagagtaattgccttttgttaaaaattgcttctttttatatctttatcttagttgtattcaaacacatttttttccagtaaaatatacagagatactactcatttccattaaagctctcatctgtcataccccagcacttccttgtgaactcctaaatgcttttcaagctcagagagattatcatgaatcttagattgaattaattattccttccttgaggtgacttctaccattaaacattaaatcaagtaagggttgttgaactgaaacaaactgagactcctaattacttcattttggcactttggccttgtatgacaccttttgcttataggtatagagttccctgctgagtctctattgcctgaaacagaacctagatacaatcaatcctgaagggtttttttttttgctaaattggaaaatggcaatctctgaagcaagagacatatttctctaactttctaatctcagatggagagggaaagaaagaagggaggggtggcaatttggaaggttaattggcatggtgcaagtatcctaggcttcagaaaaagtctgggttcccttctctcttctgctgtgcttaacacagagtcgggcaaatggattgctggcccatgagccagatgggagcattgagcctatcctttcaccataaactacttccctgatattcttcccaatgcacacaactctttgtttataagttgagagaagaaaaggagcatttatttgcagtttccattgcctggcaaaactgcagcagtgatgaaagctaccacattgtcagtgctttccaggcaatggagataactcttcctctcctagatgtgatcgggagcctcaaaaggtaatttccacattttagagtaagtagaaaggaatgactgagtttttcagagtcttgcaattaaattacaactttgaaagaataatctcaaagttcttggaaaacatcagtggggattaattacatctttggaaaagagatcgatatcatttaaggaataatgcaccaactagcctcaggacacacactaactagaatggtaataacaaaacctcataatttggtatgctaagctaattatcaaaagactacaaacagaaatcaatacatctatttattatatactacacatgatatcacagagaaattagagcattttaactgaaaacaggcttcaacatagctcagtaactttccattaaatcttattatttaagctgcaccgccttattatatcaacaaaggcaagttagataatacactaacttaaaaattgaagttactcacaaaaagaagttttaactttttatttgcattaaatgtctatcataggtcatacggcggggctcttcatcacagatactcaggtacacaggctaagggagtaaccactgccttgaatgtcagctgcagcaaagaacctgaggtgagttgtgctcaggctatgaaagcttccagtgtgtcacttctgctcacatttcatttgtctgagcaagtcatacggccacacctaacttccagtgaatgggataatgccatccaacaatatgcccagcagaaggacccaaaatattgggtgaaaagtgctaatgacaactcaacaatgagaaatgaacaacctgatttaaaactggtcaaaagacattaagagacacctcaacaaagaaaatacacaggtggcaagcaaggatatgaaaagatattcaatatcatatgtcatcagggaattgtaaattgcatcaataatgagaaattactccacacctattagaatgcccaaaatccaaaacattgacaacactgacaaaaatgtggagcaccaggaacctgcattcattgctggtgggacagccatatgctacagcaactttgaaagacagtttgacactgtcttaccaaactaaacactgttgctatacaatccaatagctgtgctccttgatatttacccaaacaggctgaaaacttatgttcacagaaaaacatgcacaaggatgtttatagcaacattattcttcataatttccaagtctcgaagcagccaagatgttctttagtgggtgaatggataaataaattgtggtacatccacgcaatggaatattatgcagtgctaaaaagaaatgagctattacaccatgaaaagacctggaggaaacttaaattcatattactaagtgaaagaagtcaatataaaaaggctacacactatattattccaaccatatggcattctagaaaatgctaaactatagagatagtaaaaaggccataggttttcagggattaggaaagatggagtttgaggtatgtgttttttataggatcgttgaggttttttttgcctacagtgtttcaattccacatcaaggccacttgatgtgattgtttagctcagtctctaggcatctgataatccttcaggctaccagcctgagaagcccctgagtaaataacgcagaagagtcataactatacacagaaggaggttgattttctggggcagcccaagtgataacacaggcaagcaaggaagcaattgtgtgtacacacacacacacacacacacacacacacacctgctactattactactactgtagggacctactgccaaaaatgctgcccttctgtttcagattgagacttaacccagctttctcaggagcctgatcattaggacaggaattcctcttctacaacattttaatggtctttcctgctgaagtgatgaggaacctgcaattttaacaccactctgatggattgcttccacatttcccctgactacattttgagaggaatgggaataggcattagctattgttttaatcactactcttctgtgagtctttttctttgtaaagtttctatctctagagaaaaatgaacttgctttacttcccctttaaactaaaaacttaatatattatcagattaatacaagtgccatttaaccttagcaatattgtttagcatcttaaacttgaaatctttcatttaatggatgggttttacatgcttaaaaaaattcattttgagaaatggaaaaaaaagaatcataagagacccagaatttagccttaaacaatccactcaaccttgtctgagattgtcctccatttgatagcttatacccatcctactgcagtacaaaggactcagaaactaatatgatggataaactagacaagacattcatatctgataatgtagaggaaagaccggagcaataatatattttaatgatactaaaaagctcaaaataaatgattagtttatattttcttagtactattcatttaataaaacttaaataaaatatcaaaatgcttataattccaactattcagcaatctgttaggagaatctcttaacctactgtaacaaattatgttatttcctttctgtggacctcacctccctcaactgtaaaataatggagaagaagcagctggcataaaactttgttatacatgcttacattgtttaaaatattacttaatttctccttaagttagttttaaaaattagagtggttcatctgagctgtttttatacatttgctctgtgaaaaaaaatgtttgatatcattacctcaatttgcatatgcacactgggcatggcaatattacatgaaaaattgctgtgaggtcatactaatggcacagaccacatgaaaaaaatatcgctttaaaatagaacacaatgataaaaggacctaaaatatactaagcacatggtgtatagtaggcttaaagttcttataacagtgcctggcatactatgagagctcaactaaatctttagctgctattaatccatttaatgcttacaacaatctattaggtaggtaccattattatagtaatttacatttatgcactaattaggaaacagcaaggccatgttagttacactagatcataagtttaaaagagtcacaattttcgtaaaggtagtttagttcccagaaacagtcttctgatacaaaaccgtatattacctctgtctgtggaaagggtgggaaggaaacttcactacttggaactaaataccattttacaagaattcctctaccccactaagtaaaaatgcatatataaataaaacacaagttttcacagactcactgttaaacctagagtatactcaaataaatatatatatatatatatatatataacaggctatgtctatcatttccactgttgtcagataaaaataatgagtttcaaagatgggtagtgacttattgagaatgtgttacaactaaatcagtcccatacttgcaacaaactatgctgtccaatcacataagttaacccttctatttggatctatcgctatttaggaaactgactctgcaggtaaactgaatatctttcctaatttgacatgagagactgccctgtcttcattacataccctacacagttttaaaattttcacctctaagagacatatacccaagttatgatctattcacattatatttactgtggaccaggaaaaaatgaaataataacacatatctctactggcttcttgaaatatgtatatcaaaacacgaaactttaacataaagccacttcgtttagaatatagtggtatgatgcgttttagtacttacaaatataatggcaaaaaataatgtacaaataatcttccgaactgcatggaagtaaaaatgagatctcgttgctgattccattttgaaagtgtgttctgcaatttcataaatcagttctttttagtagttttctatttaattctaattaggtctttttaagtagttttatatttcatttagactgatgagtaaccacaaagtcaaagatctataagaatgaatgaaacctacatatattataatctttccaaatataattttcatagctcaagaacagagtgaaaataggtgccataaccaaatgaatcagactctccaaaataacatatggagttttaaacacgaaatcttgtataatgttgttaaatttttgaaaagtaaaattatttggaattcatggaccaaaaacgtatatttcttggcaaaaagacacttgtctagatgtattagggtgtcattgttctcttcccacaccccactcccagtttgtaaaaggaaaatcaagacacagaaactgaattagcccttgcaagattaatagacacaccactttaaagataacttatacaaaccttttaaagaactttataaacaattagagatagacaatggaggaaacgtggtgaaacagcacaccattttgcaagacttcagcataaaagaatcacacttatttgatattagtttggtggggtttttttcattcaatttttaatggcctttctcaatatctcagttcattcaaaggttctgattttctttcttttcctccgtgtagtctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcacgagcaacttttcggagacactgaacaactccaagtcgcgcgccgccctcgcaaatcgcagagagggccgcgagaaggtgcgaacgcaggtcacggccagcgccgcttggagagagacccgcaggtttcagcccaggcgcgcccggcgaaagccaacgcgctctccctacaaagcgtcgatgacttcagggatttaaaagaaaaaatacccacagacagaaccagcggaggggccctgacctcgccccagtcgggaaacgccttccctccgccacaggcagcgctgaatgaagcagaggagggcggcggagagggccccggaagaagggaagggggcattctgcagtgtttgggggctggggaaagaacattttctcaccacttgggctgtcgctggacctcaggctccttccacagagacactgcagcatatgcactcctttcttcagagaaagctcaagaatcttcatggagaagcgcgtgtgtggggttggtcaactccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggaggcggtggctggtctgaggacgacgcggaggacgtcactgcgggtcggtgcttccttacaggtgccttctggaccggggtccttggcacctcccctgctcctgccctcggtgccggaccctgtgccctgggagcccgactacctcggtgtcccagccgtcccgggcttgaggcgctgagagggctgcgcggcttccagcccggaaggcagcggtcccgcgggctgcgcgcggccaagggcgactccggtgtgggaatccggcggaagggaagcacccgcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggcaggctttgcctctgccagcccgccccgatgaccaaacagcttctccatgagtttaaagatctcgatttttttttcccagcagcccccttgactctttttttttttcttttcctgatgccaacaatgcccttttggaagtgcaatgagtaagcatgggaagaatgctgtcgaagtgacaggacgtaaccctatgtggaatctcagggcaagaggggactttaggggacacttagcaatacaagtgattaagagcacagacactagagacaagcagcgttaagttcaaattcctactaggtgtgtgaccttgaacaaattacttaaccgctctgtccctcaattttctcatctttaaaagaaagttaaagatagcatctgtctcacacaccccctgagagttaagaaaacacttgttttaaagtaagtgctaaaatagtgtttgcaattattattatttagaccccacctgtagggttgtgaatcattttcactttccgatgaatgccagtgttcataccagtgaatttctgcttgaataatccaggtgacagtgaactcagcagctccctaggtaattcattgcacgaaaactgttaggttttccctgaggttgagccaacaactgacctcacctttgttccatccattgtctcaaggctgcctagcactaactggttagctcttccctgcaagggagtaaaaatggtttgcatcacacctgttctctttctcttatataggctaaacattcgcggttccactggctccctaacacttgaaatgatgtttgaagttgcctggaagaagtctcttccttttttctctcagaggtgatggaagaaaaaccagaacatctggagggccgcttgagtttacagccaccacctgggttcacaccctcttagctcctttcaaagctgaagctccaggaaaggtcatttggggtgattccaagattcaagaagatatgcccaggcctttctttctagtcgcctcttagtcctgttgttcagtggtatcacaagctctttaagctccaaggtccttgaagatcttcctaaaaccactgcagtgacatcaccgaagaagttatgcagccccagggcaacctgagccatggtcttcatctttcctgtctctttgagaattagtgagaaaattggctcatctgggattctacccatagaaattccccacagagggagagacaattagcaaaaggaaaacatctaaaaatagtcctttgtgctgcagcggaacacggttttccggtagggctctcctattctggaacccaatacctagagctatttccttactttgagggaagtgctactcctggaaaaatagcaaatgaacaggacaatgctgtggttccctcgacggcacttgagcagagtgaacaggtccgtgtgtgattttaaaacacatatgacctcctgagcatcagtttttatatttatcacaaccctctctgcctcctggcaaggttgtggcaagagttcaattaggtaaaacatgtgaaagtgctttgaagattttaattatctttgcaacataaggtgttattaccaacttccctgggttctgggtgttagactattgacgtctaatacagtggctctgttatttgattataggaagcatttatgtgtgagtcttcttactccacaacaggattgtaaacttttaggatgcaaagcaggaaagacaactcagtacaattaatattcaaatagtgtactgtattgtttaaatggctatcacagtgattcttatgaccagagaggaaatggatcatcacagtacttataaaaacaaactgaagtattacatttatagattgttttgttggtattgagctttcaggtgagttcagagggcacgtaacattttaatgcaaaatattttcttactgtatagtatggacatttgataatagtaagctcgtactttgtaagtatatatcaacataagtttctactttgtaagtaagtatgaaagggacttgatcagtagaattgtattacttagacagttttttattttttaaaaaaggctcttacacttatcaggatttcaatgttcatgctttttaaagcaactcctcatgtgattgtcacccacttccacaattaggcacacagagtacagtctttctgaagtatcttgagcaatatatcagaattcatttttacatgtatcataacatcccaaaaaagacaaaacaaaacaaaaaaaatagccaggagcacatgaagggtaagaaagtgatgtattttagtttgaacaagaacattcatcttttctcctttctgtgtattatcccataagccaaactcaaaattttactggcaataatatttttaattttatattcagatatattattgttttaatacccaaattttaaattatgttatctgtctgtagttgggattttttaaagttagccattctttctgttttctaattgacttagacatcttggacaaattatagcaagtgactcaccagtgtggcttcaaaataaaataagttagcactttttgagaaggattaggaattctggtatataatgatggatgaatgtgtttgaattcctagtacctaaattttttctttttaaaaataattactaagagtttgtagaaattaataattgtgtaagggagttttgagatatttaaattgtgacttatctaagatatttttctattaagactaaacataggcatctgttcactcttggcatcagctgtgcaattaatcagtatatttatctgtttggaagagaatgttgaattggtaataacatataaagaatcatgccaggttgcaaaacttttattgaatatatcaatggcaaaatgtctgttgaattgatattaaatttattttcacaaagaaaccaacatataaactaaaagatgaaaatcagtacgatatctaacatggcatttttgttccatgttatgcatatagcccattgactctgaaagggcacaaaaccatgcctgtagctctcatcttagcaataccttcaaatacaatcttgatactgtttttaaaaaagcaaacatgttattttaaaatttctcttcttccttttgttcttttttatttctttttccttcccctccctgactcctgttcctcttcttcctccttctccttctcttcatcttcttcatcttcgttatctccttctattattttccaaacttttttatcataagtttccacttatgcaaatgttataaaataagactgagagttcatacataccatttacccaatttccctaatgttaatgactttcatgaccagtgtacaaatatcaaacccagagcatttacactagtaccttgtgattaactaaactacaaactttattcagctctcaccagctatgcagctctcaccagctcttccccaccctcatgtcctttttctgtaccagatccaactacgacccatattgcatttgattgtcatgtcacttgaatctccttcaatctgtgatggtccctcagtctccctgtctttcagtaccttggcatttctaataggtattggtcaaatattttgcggaatgtctttcaatttggatttgtccaatgtcttctaatgattagtctaaggttattcatttggcaagaatgccatagaagtgatgttgtatccttcttagtatatcattatggcaggggggagggtacatgatgtcagttagtggtattaaccttgattgcctggttaaagttatgtctactagatttccatattgtaaagttacatttttttcatttataattgataaatatattgaggaaaaaactttgatgctgtgctaatgtcctatttttcctcaaacttttatccactgattttagcatccattgacagatcttgcttgcaacaattattaatgtgcagtttgcccggcagtgacttttgtatttcctttattctgtctaaagtaataggaattctgtaagagctgttccttctcctacatttatttatgtattcagttatttatttatatcagtatggcctcaaggatatttattctaaggattataatccaatactatcattatttattttgtggctaaaattgttctggctttagccattgggagatccttctgatttgctattgtgtccttttgacataccccaattgttttttagcagttccttaattgtttggcatcacataatgttccaagtttattttgtcccctctaccctagccctggattcaaatgattgccaaatgagtctgggttctttctttggagaacaatagcaaccaacatctgagcgctaagtgtcctcattcttactggggtgttattgctctcaggtcctctcagcagagagagctaggaaatctatatacacatacacgtacatcatatttatttctacatttctatcggtatatctttttagatagattctgatatatcatgtagagctagagatagagatagatatcgttaatacttcaatcctaagtcaataccaccaggttcattttattttttgccttttccttatttgtaacttctttctgacagtgaaaggcctgacttccgttatttataatatattcacttatttattaaatcctactatacacttaaggtagttagagaattgctaactgatactcctgtgagaaacacttattacaagagtacagtatttatgtacacttatttttgtcttgaactttacagtatccaatcaaaatactattttcttttgaaagtgacttaggttgcttctttacttgcccatcctcttcagtgtggtttggttattcatttgtaaacttatattccatacacattgattttaattatttaactagatttagtttacttaaattattttttttatttgggtgcgtgaaacgttactatggtacttagagtcaaagctttaccaaaaagtatagcttgataatcgttattccctcattatccctcctggccagttcctgttccctctttttttccacttatttcccatgcactgcctataggtaactggtttctttagtttatcttgcctgtgtttcttttgtacaaatgcacacacactcttctatgtagtggtcttttgattgtttccagtattgtactattataaacaatgctgcaataagtaaccttgtgtgtagcattttcatattgtagaaaacactgctaaccaatactcctgtgagaaatacactctgtgtgcctccagggtagcctcctagaaaaagaaatgctgggtcgaaaagtatgtgtatagatatttatgctaagtattgctgaattttactccagaaggcttgtatgaatttagattcctgccagcaatatatgattgcctatttgcccacagccttaccaacataatgtattgtcctactttttcatttatgtcagtgtgattgtaatgttttaatttgcatatctctaattatgattgagtttgaacattttgtcatttgtttgagaacttttttcttatcttcaaatagatacctccaggatttggggctgcagttggacgttttccatctcttctaatagcactgtaacaagttgtcttgaataaacacgagctcgttagccataagaaaactttaaagatgagttatctaattcaaatggaaggaaaatgtttttaaatcatcatagtaaaatatgagctgtttattttgcaaaatatgaggtcaatcagttcaggataataaatacttatgaatgtcaaggaaaaaaagcaattgctcattagtcaaaactcattaccaaaggaggggcacaatacaaaatgggtgtttccacccttttctcctatcacctgaacacgtctctgaccctataaattatacacatttcttgagacctaccatagaagccacagcgatctctctggtaaactttccctcctatctccccgcctcccccaaagcagtcacagcttcctcgtagttcccacagcacactgcaattcctctattataggatttattttattcagcttgcacatgtatattttccccccaagagactatgagccttttcgcctccaaattttggtgttcatgttcatatcttttatgtttgtatatcttggtacctagaatatgtaagaaataatttatttaaatattgatgaaatgaaaacaatggggacttttactttgggaggccgaggcgggcggatcacgaggtcaggagattgagaccatcctggctaacacagtgaaaccccatctctactaaaaatagtaaatattagccgagcgcggtggcgggcgcctgtagtcccagctactcgggaggctgaggcaggagaatggcgtgaacccgggaggcggagcttgcaatgagccgagatcgcgccactgcactccagcctgggcgacagagcgagactccgtctcaaaaaaaaaaaaaacaaaaaaaaacgggggggacttttttgtgattttccaattgggaaaaatatttgtaattctgtattacatttaaaaacaatagctcagaaagaatttagagtgaggatatgaattagatagaagatataacttacttttaaacatttgaaaagtcatcagattcacacatgaaataatatatataatccaaaatcaaatattaataccgtataagatttcaaggataaaaatgtttgataacttggtgtactagagagaatataaaggaaatgggaaccctcatacattcttggtaaaagtaagcattaatgcctttatggatagctatttgtctctaaccttcaaactttaaaaagccaattccccctttggcaaattcttatttagttattttagatatagttgcataagcatacaacagtgacaactgcacaaagtagtcggtacaacattgttgataacactatttgatagtagtgatactaatctatcaataaggaactaacttacattttggtatattcccacaaagtaatgtgctacaatttttttaatatgaatagatctgtgaaatttattactgaatttaacaaccatataaaagaataaatatagtttgccacaatttgtgtaatctagaaaataagaatgtgcatacgttcacgtttataaactcatggactctttctgaaaaggtacacaagaaattggcatcagttgtcgtctgagggagaaagattaggtagcagaacacaacagagagggagacctacttttgactgcattccattttatactttaaaaatgtaccatatgcatattcttcaaaataaataacatattacaacaaaaatcagttatataaatttggctttgatttttaaaacatatttattactaagcttaattaaaatacaaaaatccagaatgtgaaggagacacacagggactagaaatgttatttctaagttgcaacaggatatagtcttgatgccttgagaatcagaagacctaagtgaacatcataacttctcagagcctaacagtagaatgttggtaccaaaaggagttcaagtattgatgatcattatcctctaggatgaagggatgcatgaggaaatgataagaaatttccaaagtgccataaatctgaggtgctactcttattttacttttaaactatatattcatttttaaatgggaagtcttacatttaggtgacattgggaaaaatagttacttccatgtgattgttataaaccatgtttgattcccacatgcccttctggaatttcaacaatcttgagtattaaagacaccaaaacagtaataaagagccctacccaagtctgataataaagattcacccaacctcttttagctttcgtattatccaagctctccaaataaaactttcatcaaattttataagatactattaagtccacctgttaaatgaattaaacaatattcatttctattcactgcacatttagcgagtgcatattttgtttaaatataaccctgccctcagtggactcactatctcatagggatggaaataatagatagctatacaaacaatgttgagatggatagagaaatgtgaagcctgtggtaatgatagcacagatgagaagagtgattctgattgccgaggagggatgcaaaccatgtaaaaccacatagcagtatcatgatatttgtaaagaagaggttcttccaaaatgcagatagaaaaaggatatgtatatgtggaatgacttcatttggggttttagggaataaaattttaacataagtcaactcatggtagacatttattttctaactccatcctttaacagaaaaaaaaaatacaaaaaagggacagtgacttctaaagtcacctggcccccagcagcagggctgcaactaagtggctcagaacccctgcccccttcctagtgcaacattctccaaaagacactatgatgctgcccctggttttgatagcatcagaatcaaacttacttgataataggcatagaaattatttcagggcatttttcctttccctggaaattgaattttctctgtaaattgtctgctttttagaagcagaaggcagccattcatttaaagatctgaccaataaaaataagcattgcctttacagtaaactctgagctttctattagtgttaactttcagaaaagggcataggaaagagtctaagcttatgactttggctaactttcctgatggcaagcttttaactgtcctaatacaaatggttgtgggaaaggaggagaaaaagggttaactggagatgttcattaggatccatatcaaaggcttgttggacatgaagtaatttggagaatgaatatttcagcccctttaaggtgattgttatgctcacaaatatattcacaagtgtacgtatgtatatatctttctgcctgtgcagaacacaggttaaggccaaagttgccactctcacataccaggcaaaaggcacatgtggaattttgaaatctcctttgtgcattatttttctatcctctcttttttcccttccacaaacatacaaacatcttaaagaagaggctatatgtactaccttcacttcagcatttcttttctttcttaaacccgagtgctgcctcctgcttgcacaatctcaccaaagttctttttataaaatcaccataatcaaggctattccagataaaatggacacattttgtcctaatgctacaaagatgcagtaattatatgtgttgaaattattgatcactctatttcaagaaactcttcctcatcttcagaaacatcatttttctctcggttttccttctacttctctattaacatcatagttctctttctgccatcctctaagtgttactatttaccaagcttcaatctcttctccatttttactgttactaggcatcttcttacacattaaaattcctacgctattgataactcctggatctgtgtctgctgacaagatacctacatagatttaatcatccatttccaagtttccctggaaacctctgctaaaggatccacaggtatttcaaaaaaataataataataactacaactggacacgtatctttctctgtaaacttcttgagctccatattttaatgagcaactacatctaactatccagtttccaaattcaaagccttgtgagccatcctagactgttcttgctaacttatctccaatcagagagtattacagatactatttgtttaacatctctaacatccatcactttattcttgccttccttcaggccctgatcacatcttgcctaattactacaacatatttacaaaaatattccaactgccttcaatttagcctccatactgccaaaataatcaccccaaaacttaagtccctaaagaatgtggctcttcagaaacttttcattgtattgaagattaagtcgacagtgtaagtttggtacataaaacctacgatgatttgcttgtcttcttttatctccgtacatgaacttaactccatccatgtccttgagtctcaccgtttttttcttttctattttttttgagtcggagtctcactctgtcgccaggctggagtgcagtggcaccgtcttggctcactgcaacctccgccttccaggttcaagtgatgctcctgcctcagcctcctgagtagctgggactacaggtgtgcgccaccacgcccagcgaatttttgcgtttttagtagagatgggtttcaccatgttggccaggatggtcttgatttcctgacttcgtgatatgcctgctttggcctcccaaagtgctgggattacagccatgagccaccgcgcctggcctgagtcacacttccatgttcatgtctacatgtttttgcacatgatagttcacttgcttagactatcctgctttctttcttcttccagtgagttcacaccaacccttcaaaaattggattcattatcacctctgtcaataaaccttccctggctggattaggtgcccttctttggagcttacctgcgcatatttcttagcacagaactttcacacaatagtctctgatttccaaaaagccaaagtacttcttgaaaatttagccaaatagtcatgcaaactaatatattattacaactgtaacggctgcaaaagtggagaagtacatgattttatggtgtctaaagaggtggtagaagtgttgatttagccagaggaatcaggaaatgctgaggcacttatcacatcatagtttgtgtcacaattagttgggcacatgctttatatacagttcctcacctcaagcttataaacacacacacgcatacacacacacacacatgcacacagacacaaacacagtcacttttgttccctttcatggtaagtcttaaaagtcattcatcatgaaatattactatttctgcctttcgcaatatacagatgctactcaaaacataggaaatggtcaataaatatctgctgaattgaattgaaaactttacccgagttgcagaatagttatatgattctgtttctttagagttaaccatatggttcgactgaagataaagccttaatcaaatttattataaccttacatttcagttacaacaaaagcagtatgcgtcatgccttctgtctttcctaaaaatcaatgacacacctaccacatggtttcaagtatgataaaaataaaggaagtcttgaaaaaatccaaaagaaatgcaagccaggagaaaaggagcctttggaacccttaaattgatgctgacttgaatgtgtcctcaaaatttcatgtgttagaaactcaatccccaaacatatattgataaaatttggaggtggggcctttgggaggtaattaggattagataacatcatcagagtggggccctcacaatgggactggtggctttataagaagaggaagagagacctgagctagcacacacttgccttctgctatgatatgacacagcaaaaaggccctcaccagatgctagcagccttccctgcctccaggactgcaaaaattaaatgtatttttctttataaattacagtctgtgatattctgttataacaacagaaaataaactaagatgatgactagtttaggataaagatcctggaagaccaacagacaaagacctgggagaagaggttcatagtattagtctgaaaggttgtatacttccagattttgccattgtttccatttctagttttataggttaattaacaaataatgaaaaatggaaggatcagaaagatctgttttctatggtcttatgcaagtgcacattgtaagcattcaatatgtagatatgaaaatcactgcaataatgcttctaggagccagcactagataaccatcttcagcatcctgggcttatgtaaataatccatttagactgaactgttattttcatttttatttttttatttgtacatatttatgggtgtattagtccattttcatgctgctgataaagatataccagagactgagcaatttaaaaaagaaagaggtttaatgacttatagttccacgtggctggggaggccttacaatcatggtggaaggtgaaaggcatgtctcacatggcggcagacaagagaagacagcttatgcagggaaactcccccttatataatcatcagatctggtgagacttattcactatcaggagaatagcgcaggagaaagacccacccccattattcaactacctcccactgggtccctcccacaacatgtgggaattcaagatgagatttgggtggggacacagccaaaccatatcattccacacctggcccctcccaaatctcatatcctcacatatcaaagccaatcaagccttcccaatagtcctccaaagtcataactcatttcagcattaactcaaaagtccacagtccaaagtctcatctgagacaagtcccttttgcctatgagcctgtaaaataaaaccaagtttgttacttccaagatacaatgagggttcaagcattggaagaaattggccaaaacaaaggggtgcaggccccatgtaagtccgaaatccagtggggtagtcaaatctcaaagctccaaaatgatctcctttgactccatgtctcaggtccaggtcacactgatgcaagaggtgggtccccatgctcttgggcagctcggcaactgtggctttgcagggtagagcctctctctcagttgctttcatgggctggtgttgtgtgtctgcagcttttctaggtacacggtacaacctgtcagtggatctaccattctagggtctggaggatggtggccctctcagctctactagacagtgccccagtagggaccctgtgtgggggctccaaccccacatttcccttccacactgccctagcagaggttctctatgagagccctgcccctgcagcaaaagtctgcctgaacatctaggcgtttccttacatcctctgaaatctaggtggaggttcccaaaccccaaatcttgacttctgtgcactggcaggctgaactccacattggaactaccaaggcttgagtcttgcaccctctgaagtcatggccagagctgtacattggcccctttcagacacagctggagcagctgggacacagggcaccaagttcctaggctgcacatagcatggggaccctgggccccactcacaaaaccacgttttcctcctagtcctctaggcctgagatgggaaggggtgccatgaagacctctgacattccctggagacattttttcattgtcttggggaacagtattcagctactcattacttatgcaaatgtatgcagtcagctggaatttctcctcagaaaatgggattttcttttctatcgcattgtcaggctgcaaattttcccaacttttacgctctctttcacttataaaactgaatgcctttgatggcacccaagtcacatcttgaatgctttgctgcttagaaatttcttctgctagataccctaaatcatctctctaaagttcaaagttccacaaatctctagggcagaggcaaaatgccaccagtctctttgctaacacataacaagagacctttgctccagtttctcacaatttcctcatctccatctgagaccacctcagcctggatttcattgtccatatcattatcagcattttggtcaaagccatttgacaagtctctagggagttccaaactgtcccacattttcctgtcttcttctgagccctccaaactgttccaatctctgcctgttacccagttccaaagttgcttccacattttagggtatcttttcagcagcaccccactctactggtatcaatttactgtattagtccatttttatgctgctgataaagacatactggagactgggcaatttacaaaagaaagaggtttaatggacttatggttccacctggctcggggggcatcacaatcaaggcagaaggtgaaaggcacatctcacatggtggcagacaagggaagagagcttgtgcagggaaactcccccttatatcatcagatcttgtgagatttattcactatctcaagaacagcacaggaaagacccaccctcatgattcaactacttcccatggggtccctcccacaacatatgggaattcaagatgagatttgggtggggtcacagccaaaccatatcagtgaggtgcatgagaaatgttgttacacatatctaatgggtagcaattaagggaaggtatctaaaatgtccatcacctgaggataatacagttttgtcaagcatggtcatcctattctgctaccaaccattacatttattcctcttattggattgtatgtttgtacccttaacccacttctgttcatccttctctctccatcctgtttttttttttaatttgacatctacattctcttttgatccactttctctcacttggtggagcttagtgtttagaggttgagctttgaaatcaaactggacctaggattacctctcaacccttacatttactggatgagacgactgctccttctttcagtggttttcatgtgtacaatagagtgagtattcatacttccttagaattgttgtcagaataaattgagatagaatatcttaatatggtgcctgccagatcgtaggtccttaaaaattgtggtaatgatatggtggagaagcttattgacatttatgacttttgggaaactctaccagtaataatccttttcatcctttcatccttgaagatttattcaacaacagcaatattgctcatttgttatttgagattattttaataatttctcttctgtatctataaaatatttaagaattgtctttgtttgaaggagaaatctaagaaaattggacttttagtagaaagcttttgaaggattttgcttcatcaaaattctataagaagtgaatactaatgggcatggagtttttttctgaggtgatgaaagtgttcaggaattagagtggtgatgggtgcatagacttatacatatactaagaaccactgaactgtacacattaaaagggtaaattttatggtatctgaattgcattttaatttttttttttagatagagtcttgttctgtcacccaggctggcatgcaatggagcaatctcagctcactgcaaccttcacctaccgggtttgagcaattctcctgcctcagcctcccacgtagctgggattacaggcatatgccaccatgcccagctaatttttgtatttttagtagagatagcttttcaccatgttggccaggctggtctcgaactgacctcaggtgatgcacccacctcggcctctcaaagtgctgggattacaggcatgagacaccacacccagccctgcagtttaatgttttaaaactataagaaaaatattggacagcaagatagtttacagctacacacgttattagagtggtgattttttttctttcctgttttcatttcagttgtccactccacattgtagagattatgatcagtttggttgtcaaagtcttagatgacatcacaagaaacacttgagagctacacattgctgagttcaagtcccagctgtgtgttaatggacacatttcttaactttaatttcattttccccatttgcaaaacaaagctaatagtctgccttgaggtttgttgtggcaaaaagaaaaaagaaagaaagaaaaggaaatgcttaacatagagattagcacttagtggactccccatttacagaagatcttcttcaaaaggactagtacattccgaaaaaagaggtttgggtatttttttttctttttctccggtcagaacctattatgaaacacccactggtcgtccctatttttaaaacgtataattattttaaagcaaatgaaaatacttttcttaaaggtgaaatttaaaacttaaagttattaacaacattttgggttgttatattttgaaaggaagttatgtgaagataaaatttgggaaatcaaccccctcctttaattttctaccacacgcttgatgctgtcactgacaccttgagttgaggaatataagtagcttttgcttaggaggtgttaatctgatggcagcttatttggatagtgctttcttgtttgttagttgtttttagtccatggtcttcctagacactcagcattagacctacattctggattagcatatactaaaatccagtttcattcttctacatgtagcttgctagttttcccagcaacatttatttaatagggtgtcctttccccaatttatgtatttgtatgctttgttgaagatcaattagctataagtgtttggctttatttctgggttttctattctgttccattggtctacatgcctattttttatactagtaccatgctgttttggtaactatagtcttgtagtataatttgaagttgggcaaggtgatgcctccagatttgttgtttttgcttagtattgctttggctgtgtgggctcttttttggttccatatgaattttaggatttttttttctagctctgtgaagaatgctgatgacctttcgatggggattgaactgaatctgtagattgctttgagcagtatagtcattttcactatattgattcttcccatttatgagcatgggttgtctttccatttctttgtgtcatctatgatttctttcagcattgttttgtagttctccttgtagagatctttcacctacttaagtatattactaagtattttttttattttttgtagctgttttaaaagcaattgagttcttgatttgattctcaactttgtcgttgttggtgtatagcagtgctactgatttgtgaacattgattttgtaccaaacttttgatgcttgttcttaaaggcagagtttaaagactcactatgagtgacacacatacactgtacacacaacaatgacaataacatttttaatttctcaattttcttaaccaaatcagaaacaaattttctggaatttgccttcaggtatttttagcaagaaacatgaacaaatatgaaataaatcactatttcttatggttttttgcttgtttatttttttcttctatgagacaattcttgtatttttaatgcatagtcatttggggacatcaaactctgaccatatttatgtggcatgacacttagcaagctgcagacatgatctagaattgttttctctaaccttatttctcctacacaccatcacaagaaaacaaatgatggatgtaaatatctattttcaaaaggcatttcatctgacaccatcttactcagagtttttgtaattgcatggagaaaaaatttaaaatagcgtgtgctcagggattcaaccaattttgataaaaactggttgaatacttcacttcttcttcaaaagtgtataatggttccttacaatctatagtcaaattaccaaaatctgtaacttggtatgttcaagaactggcacaatcttcacctagctttctggacatagtttctataatatcacttcccccataattacttcaagtctacaatcctttaccagaaacagctggggccgagtgagttttgtaattcaggtttttggggaacaaggtggtatttttttaaagtaatacagttaatgtataaaatattagcaaaatccatgtatgttggggcctgcacctataatgaaatacattgatatttctgcagtaaaatctataaatattctcataagtaggacaaataaagactataaatagcctcctgtcaattcaggtcagtctgtagcttaaggaaaaacaacaacacacacagtggtcttcagagcttcttgaatttagaaattaaagacagtaaaatgtaagcctgcacttgctttacttggacatagacttttgaacttttgagcctctgttcattttctttccttagccaaaactgtcctctatgtctcttctagtttattaaagtttatcgtgggccagtccaaacatcagaagcgaccccatttttctctgttgtctgcatgcatatctctctccataggctagaaagtccatagggaatagttctgtgtctaatttgcattgcatactgtgattcctggcagtgtatttttcctcaaaagaatataaaaattggatgaagcaagcctgcttgaaaacataaatgtcgacaaaacaaacccaaagcattcagtgtcctatctctattcctctttataaatgtgaatttttataagatgacagggtttttttttttttcatatcagatgggtaatgtgccgatgtcttgacaaggttcaagggtggcacatctcacacatacacgtgaacacccaatcatcatgcttacgaactacaaaaggatcaggtttggttgtttaaaaaaagtaattttactcagaatctattttttatggtcaaatattttctagtgattctaagaaaaaagtataagcagtatagctgctagctttccattacagttcaacacactgagtaaacttcaaagaagctggttttaggttactgtagtgctcaggaaatgtgagtttttaaaaaattaacttatattttaaacttctgattttttctaatcatttaatcatatttctatcacttccagaaacaaaaccagatgtaagctctttatttttatttttattttttagatggagtctcactctgttgcccaggatggagtacagtggtatgatcttgcctcactgcaacctccgcctcctgggttcaagagattctcgtgtctcagcctcccaagtagatgggactataggtgcatgccaccacacctaatttttgtatttttagaaaagatggggttttgtgatgttggccggactggtaccgaactcctgacctcaagagatctccctgccttggcctcccaaagtgctgggattacaggcatgaaccaccatgctctttagtctattaaaaatgtatctgtttatttgatgttctttgcagtgctctttgtagacaattaagagtggctgataattcatatatgactgaataatactaattttgaataaaatcattttaaaattaccgattttagaactatttaataataataagataactatttttctaatattggagatttggagacattcctccaaatagaaataccaccttactattgtaagtttcagtggatactttgattttaagtctaacttttaccttacacaatttatgatcttatattctatttttaagatttagtagactatcatatgaagtggtattcctgactccttttgtaataaaatcattattaggatatgttataaaatgaaacaaataagaaatgaaaaaaattcttcctgaaatagtatataaggtgtgttttggctatggcaggggatttgaagaacaatgctgaataatatctagatcacaaaatcaactataataagctaaaaataggtttttcatatttggtactagcctccatatgaagtagctatcctaatatacagtactgtataacatctttttagccatccatccacctagtctttcatccatatatccatagggaaaaaattctacttaaaattaaaactcccttcttaggaagacagttcaattaagggagaataggtcttctttcttcagcaaagcatcttggtagatcaaaacatgcacagaggagtcagagagaaatttgggagtaagactggaggaaatggaattaatctgcagaacaatgtgagaagaatttggagctcctgtgagccatctggaagggactaaggaaaaccaaaaaccatggtaggaggctgcagtctgaggtatagaaatggccaagagactttttcagagaacaaggatagctgtacaatctctaaaatgaaataatttgacagaagcagaattcagagccagaggagaccttgaaaatataaactcacactgaaaatttgcatacaacttgctggtggttggggtgggcactactgaactctaaaattcatagaatggagctcaaaccaatcttagctaggtcttaattggtacaatgaatttagctgtatctgagatacataaacatacatatgcacgttttcatatgaagcaagtgttctagagctcattcattcaataaccccaaatatctgccacatagatacaaacctgaaagaagatgcaaagaagggacaaaagaaagacatctaaccacccacaaatgctgtcataaaattgtagcactaaattttacatagcttgtagggtaacattatgtcctaatacaatatgtacttacatttttaaaaattctatttacttttttacatattactctacacggctatttcaccacgctcaacggtctagaactacaacccacacaccaaatccagcaaactgcctgtttttgaaaataaagttccattggaacacagccaaagccatttgtttctgtgttgtctatgactgtttcaggctacaacctgagtcgagtgattgtgacaaaggctatatggtccataaagcctaaaatatttactatctggctcttagcagaaaaggactgctaacctcttatcaagaagcaaaagttgaaatagacagattttaaaacatatggtgagaaataactattttatagcaaaaaagtaagcaaacaacaaaccaacaaatatcatgccctccaaagtcacaatacatggtgccatcatgtgtgaagacaaataacaccagaaagcctatcaagttgtcaacaagtctccgaaagtgtattttacagggcaatacaactattaaaattaataataatgatcctgagacattaacaaaaattgtaaaatatgttgagaattttctaagacatttaaaaatatatatataaaataagatttttgcttttgatattttgatttttttaacttttagtttttgtgggtacatactgggtgtatttatggggtacataagatattttgatacaggcatataatgcataataatcacatcagggtaaatggggtattcatcacctcaggcatttatcctttctttttgttacaagtaatccaattatagttttagttaattttaaatatatagtaaattattgttaactttagtctccccattctgctatcgaatactagatcttattcattctttccaactacatttttgtactcattaactatcctcattccccgccactacacttcctagcctctggtaaccatcattctactgtctatccccctgagttcaattgttttaatttttagctctcacaaatcagtgagaacatgtgaagtttatctttctgtgcctggcttattttacttaacagaatgacctccagtcctattcatgctgttataaatgacaggatctcattctttttttatgggtgaatagtacaccattgtgtatatgtactacattctcttcatccatttgtctgttggtggacatttcagttgcctcaaaatcttggctattgggaatagtgttactataacatgagggtgtagaaatctctttgatacactgatttcttttcttttgggtatatacctagtaatgggattgtgggatcatatggtagccctatttttagttttttgaagaacctccaaacgattttccatagtggttgtactaatttacattcccaccaagagtgtacaaggattcccttttctccacatgctggccagtgtttgtgatttcctgtcttttggataaaaatcattttaactggggtgaggtgacatattgttagtttttgttagcatttctctgataatcagtgatgctgagcatattgttatataccacttcgcatgtcttcttttgagaaatgtctattcagatattcatgtattttttattcagattaatggattttttccctattgagttgtttgagcttctcatatattctggttattgattccttgtcagatggatagtttgcaaatattttcccccattctgtgggttgtctcttcactttgttgattgtatccttcactttgcagaaggtttttaacttgatgtgatcccatttgtccacttttggtctggttgcctgtgtttgtggggtattactcaagaaatttttgccaagaatagtgttgtggagtgttttcccaaagttttcttttattagtttcatagtgtaaggtcttagatttaagcctttaacctttttttttttttgagatggagtttcactcttgctccccaggctggagtgcaatggtgcgatctcggctcactgcaacctcctactcccaggttcaagtgattctcctgcctcagcctcctgagcacctgagattacagatgtgtgccactgtgcccggctaattttttgtatttttagtaaagatggggtttcaccattttggccagactggtctcaaactcctgacctcaggtgatccgcccgcctcggcctcccaaagcgctgggattacaggcatgagccaccgcaccaggcctttaatccgttttttttcttttgttttgtttttgtttttgtatatggttagctagagatagggggtctagttccattccgctgcgtacagatatccagttttcttagctccacttattgaagatattgtcttttccccaatgtatgtccttggcatctttgtttatgcaataagttaactgtagacatatggatttacttctgagttcttcattctgttccattggtctatttgtctggttttatgccagtaccatgctattttggtactatagctctgtagtacaatttgaagtcaagtaatgagattcctctagttttgttctttttgcacatgatagctttagctggataattctagctttttcctgggtcttttgcagttctatataaattttcaaaattttttttctatttctgtgaagaatagaatgtcattggtattttgaaggacttgcatggagtctgtacattgctttggtcagtatgaatattttaacaatattgattcttccaatccatgaacatggaatatcttttcatttctttgttgtgctctttaatttcttgcatcaatgttttatagttttcattgtagaaatctttcacttattttgttaaattaattcctagatattttattttatttgtagttattgcaaacgggattgctttcttgatttctttttcaggttatttgctgttggcatatagaaatgttactgatttatgtatgttaattttgtatcctgcaactttattgaatttgttgatcaatttgaataattttgggtgcagcctttaggtttttccaaataacaaaaatatcatctgcaaacgaggataatttgacttcatcctttccagcgtggatgctttttatttctttctcttgtctgattgccctagctaggacttccactattatgttgaataacaatggtgaaagtgagcatccatgtcatgttccagattttagaaacaatgctctccatttttccccattcactatgatactagctgtgggtctgtcatatatgggttttattgtgttgatgtatgtttcttctatacccagattttttttagggtttttgtcatgaaatgatgttgaattttatcaaataatttttcagcatcaattgaaatgatcatgtgttttttgtattttgttctgttgatataatgcatcacattgattgatttgtgtatgctgaaccatccttgtatttctggaataaatccaacttggtcatgatgaatgatctttttaatgagttattgaatccaattcagtttgctagtattttgttgatggtttttgcatcaatgttcaacagggatattggcctatagttttcttttctttttgaggtgtctttgtctggttttggtatcagggtaatactggcctcatatgataagtttggaagtattcccttttgccctatttttctgaatagttttagtagggttgatattagttcttctttaaatgtttggtaaaattcaccattgaagccatcaggttccaggcttttcgttgctgggtgacttactactgctttgatctgcttatttgtcatttgtctgttccagttttggattttttttcatgtttcaatcttggtgggttatatgcatctaggaatgtatgcatttcttctagaatttccaatttgttggcatagagttgtttacagtagcctctaatgatcctttggatttctgcagtatcagttgtgaagtcttcattttcacctctgatttttttggggtccttctctcttttctttcttagtctggccaaagttttctcaattttatttatcttttctaaaaaccaatattttctttcactgatttttgtattgtttcttaatttcacattcacttatttctactctaaactttattattttttctctactaatttcgggtttgttttattcttgcttttctatttctttaagaagcataattaggtagtttatttgaagtttctctaatttttgacgtaggtaattatagctataagcttttctcttagtaccgctttagccatatcctattggtttcagtgtgtcgtgtctccattatcatttgtttcaagatttttttcaatttcctttttcatttcttctttggcccattggtcattaaggaacatactgtctaatttcctcatggttgtatagttttcaaagttcctcttgttaatgatttctagttttattccactgtggtcacagaagatacgtgatataacttccaatttttttaatgttttaagacttgttttgtgacctgacataaggtatatccttgagaatgatccatgtactgaggagaatatgtattctgcagttattggataaaatgttctgtaaatatacattaggttcatttggtgtattgtgcagattaagccagatgtttccttgctaattttccgtgaggatgatgtgtcgatgatgaaagtggggtgttgaagtctccacctgtgattatgttggagtctatctttctctttagctctaataatatttcctttatatatctgggtgctccagtattgggtacatatatatttatagttgttacatcattttgctgaattgatttctttatcattatgtaatgaccttctttgattctttgtatagtttttgtcttgaaatctactttgtctgatgtaagtatagctattgctgctctttttggtttctacatgcatgcaatatatttttccatccctttattttcagtttatgtgtgtctttatggaaaagtgcaacttatcattgggtcttgttttttttaaatccatttagctactctatgtgctttgattgaagagtttagtccatttacattcaagttgttattgataagcaaggacttacccctgccattttgttacttgttttctggttgtttgtggtcttctcttccttctttccttttgtctgtcttccttttagcaagggtgattttctctgacgatatgttttaacgtttcaagttcttgatttttattgtgtttgttgtatattttctgattgaagttaccataaaacatgcaaataatatcttataacccattattttaaattaatgacaaattaacacctattgcataaacaaagagaaaactaattaaaagtttatattttaattgtgtcccccactttttaactttttgctatttctatttatatcttattacactatctgtatcttgaaaagttgttgtagtttatttttgattggttcatctttagtctttctacttaagatgtgagtagtttacacatcaaaattatggtgtcaaaatatagtgtgtttttctgtatacttactattaccagtgagttttgcaccttcagatgattttttttgctcacttacaaacttttctttcagactgaagaactcccttacatttcttggaggacatgtctgatgttaataaaaccccttagttttatttgtctgggaaaaatctttatttctccttcatgcttgaaggagaatttcactggatctactattttaggatacaagtttttctccttcagcacgttaaatatgtcatgccactttctcctgatctgttaggtttccactgagaagactgctaccagatatattgaagctccattgtacgttattcatttcttttctcttgccacttttaggatcctttctttatctttgacgttgggggcctcagcctcccaagcagctgggactataggtgcacatcaccatgcctggcattttttttttttttttgtatttttagtggagacggggtttcaccatgttggccaggctggtcttgaactcctgatcttgaatgatccgcctaccttggcctcccaaagtgctgggattacaggtgtgagccaccatgcctggcccattcttttttcttcttctttttttctgtctcccctggctatttccaaatagcctgccttcaagcccactaattatctcttccacctgatttattctgctgataagagactctgatgcattcttcagtatttcaattgcagttttcagctccagaatttctgcataattcttttttaattatttgaattcctttgttaaatttatctgatggcattctgaaatccttctctgtgttatcttgaatttcattgcgagtcctcaaaacagctattttgaattctctgaatgaaagatcacatatctctgtctctctaggattaattgctgctcccttatttagttcatttggtgaggtcatattttcctggataatcttgatgcttgtggatgtttgtcagtgtctgggcattgaagagttgggtatttattgtagtcttcacagtcttttttttttccacctgtccttctttggaaggctttccaagcattcaaaggcacttgggtgttgtgctctaagtttctggtcactgcagccccatctgtattagggagcaccccaagcccagtaacaatatggttcttgcagacttatagagatacttcttggtggtcttggatcagatctggaagaattgtctggattaccaggaaaagactcatgttctctttccttacgttctcccaaacagctcagctctgtgctgagctaactaggctagaagagaggtgacacaaatactcctgttgtcaccactattaggactgtgctgggtcagacctgaaactagtatggtactggggtctcacccaagggctgtggttaccactgcctgactatcacctatgctcacccaaatccctagggctctacaatcatcaggtgacaaagccactctggcttttgtccttccattcagaatggtgagtttcctccagcaccagtcacgtctagcgatgtttttcagaagccagtcccttaagtcagaaaccttaggaatctacctgttgctctattctactgtggctgagctggcacccaagccacaagactaagtccttcacactcttccctcccttttctgtaagcacagagtttctgcctgtggccacccttgccccagacccatggcgagtactgcctggctaccactgatgttcactcaaagcccaagggcacttcagtcagcatgttggtgaatgctgccaagcctgggacactctcttcaggacaatgggatcccctctggttcagggctaggtccagaaatgccattcaagaaccaaggcccaaaatgaggactccaagagtctgcttggtgctctaccccattgtggccgagctggtacctaagctaaggaacgaagctccctttactcttccctccccttttctcaagcagacggagtctctccctatagccatcacagctgggaatgtactgggtctcacctgaagccagcatgtctttgagtctcacccaaggcccacagcgagtactgcccagctaccactgctgaaagttcaaggcccaagggctcttttgtcagcagatgatgaatcctgccaggactgggttctccccttcaaggcagtggattcccttttggcccagggtgtgtctagaaatgtcatcctggaattaaggtctgggatggggccctcaggactctgcctagtgccctgtctttctgtggctaaactggtatccaagtggcaagtaaagtcctctttactcttccctatcctctcctaaggtggagggaagaagtatctcccagagctgcaagctacactgcctggggctggggaacggatagtgcaagcactctctttgctgttcaagctgatgtctcactaggtcacatgccccccaagttcactggttctgagcaattcccctttgctagggctggtctcattgctccctccattagctttggctgagttctgcctggtgttgctgtctgctgtgacaggacagcactgagttccaatgcaaagtcccacaatcactgtgctctccctcttccaagcacacagatttttttttctccacgccacagaactgctgctggggggagggggatgggtactgttggcaattcaaggctctcttttccaccctcttcagtgcctctttaagcaatatgaagttaaaactgggtactgtgattgctcatctgatttttggttcttatgaaggtgcttttttgtgtggatagttgttcaatttgttattcttgctgggaggacaatcagtgaaggcttctatttggccatcttgcgctgccttcctctctgatattttaatttttagaaggagtaagtttcgatatctggacagtgaactcatgtaaattatctcatccttctgagaattttactgtaaatttattttatctcagtattaaagttatccaaaagagctatttaacacataacaaaacatatagatttctctctacaacactttaaattttacaatttttttttatagaagtagggtctggatttcacattcattttattattttaaagtattattagtgaagcactatactgtaggttttaagagagctgattctagagctagactttttagactctcattccaggtctagcccacacaagttgtataagcttgggcacagaatcagggtacagtcgtgagtatagcagacctttgtatttccattcagtctgtaagtcaacaggtctgtctaagagcagacacctatttcagggcaatcgccgcaactactttgtctggactttgacttttcctcttcctggaagaggagatggaggagaagtcaggtgagatagcttaaggagaacttgaataatcagtaagctggtacaaagactcacgcaagatcaactgagccatgtccaagggaagcgagccccacaatgatcagaaacacctatgagaagcagcactctctagcatagcattataggggatttctgtgccaactacaactgcctggggaatcaaatactacaggatattcctttatgtaggtaccaaccgaacacttgcactctggcccccaaaactacttgtgtataagccttaattatcaagacaattgtaccaatttatcattaccaacatattttccctggcactgaattccaggaggcatttaccatgtgcatccacatgataaatgttatcacaaaggacagtgagcatcacaaataacagtcttcagctgtgaatagtcatgtttcaacgacctctgaaaaagctttcctccacaaccactgatctttctctcccacagaaaacccttcacaagtatgtgcatagcttttgtgaaatgtttaccttctagcaaagctgtgaattacgtcccatagctatagcttgtctcagctggcccctatcccgaggcgagtgacacatggtgaagagaatgaaactgtaggtgctagaaaaagtagcttccagaagaaaacaaaattgtccacataatatccagagggttcttttatggataaaatattgtaattcttcagcgtggtagatgctggtactttaaggagacaattctcaactcaatattaaaaaatattctctttctcaaatccatccacagttggaattacctgtctctactcatagtgagcttctttttactttcagaggacatttgagctgtgggcaaaggacgttgaaccacttggctacactctctaagacaaattagatctcagagattttgaaaagaaaagtagtccaatctgactgattaaaggcataaggatctctatgctctgaatggattccacccaaataaactaaggaagaagtcataacttcatttcagaatgaaatgtaattagctagctgtaattattgccttaggaaagacctagtaaatgagggacagagtggtgtggtggaaaagaacataacttttgagtctggacaactttgattcaaatcctggttctgtcatttattagctgtgtcatcttagacaatttacatgacctctctgagtctcagttgtttcctctaaatatagataagaatgcctcattatagagtattgtaagaagtctatgagatattatacatatagtgactaccgcactacagggcttacaataggcactaaacaaattaaacctatcatcactaatactttaggtgcaaaccacagtgatcccagctttttaagatcatctatggaaaaatcaattatatatatataattcataaattaaggagaaatttaaaatgcgcagcaaattttagaatctgtaacatgtttgtcatgagaaattgctacttttcaaaaaaaaaaaaaaaaggatatttcgacagataaagaatacaccaaaaccacaactggagaataagggtttaattgtagttccctggttcaatgcttattccttcctgatagaatgtaagctttatgagggcaggaactttatctgattcaccaatgtatttctagagaccagaactatttctgacacatagtctctactcaatagacttttattgacaaatgagtgaaccctaactcagtaccctaataaccaatgactatttacaaaatagtagggtgggctgggtggggtggcttatgcctataattctccacactttgggaggctgaggtgggcagagcccttgagcccaatagtttgagaccagcctgtgcaacacagcaaaaccccatctctactaaaaaatacaaaaattagcctggcatggtggcacacacctgtagtcctagctacttcggaggctgcagtgggaggatcgcttgagcccaggaggttgaggctgcagtgagctgagattgcaccactgcactccagcctgggcaacagagtgagacccggtctcaaaaaaacaatagtggggcaagacaaaccagattctagctgagcctccacaaatgttccttagacctacccaactctatctgtactaatttcacatatcaaaagaaaccttgtgatgactctttggctttttataagccatgtatggaatcctttatagaaaacagagtggcaatttccattggtagtagagcaggtgacgtctctctcccagtgtaaatgtatccatcagcatctgactcattaattaaatgttttttataagtagtctctatgaattagtctttttcagtttgatcacaatagaataatccacaatcaaactatacatagttctcaactccctcaagttcaccattttctttatagagtctctgcttctgcaataaactcccccaatgtctctctttcatcacctcaatgataccaagttatttcaggaaggttgtctctaataaatgattattataatttataacaggttattatctttacaatggtatattgttgtggacaaatctcaatatgtatacaaattatagcttatgttgcagtaaaattggccacatagaaatgatactggattctaaacagtttgctgaattcacaactgaatccaaaaccaacaggaagcgttctccaacctgttcttaaaaatacctgctctaggtatataatgctagaacttaaccaatgaaactagtattattcctcatcacagcactggccagggttgcctttcagtcactgcgataaaaattatcattttcttctctatagcttctgtcactgttttttctatagcttctgttatcattttcttcaacatgtgctgggagataatactctgttcccttacaaatgcttcccaagtattagctagaaaatttactggaggcctctgtacattcagaatgtagatgactagaaccagaaatgaagtcaaaaaatgaaaccaagatttaaaaaactttccaactactacaggatttgaaaatgcctttcttagcatacttcaaaatgagtaaattgcttctaagtgagtaaatacttctaagtaaatttgaataacatccaaaaatacacatttcctgttttttaagtgtcagggtatgctgagggagagaagaagggtgtttgctgtctagtacatagagagactttagagctgttaccagttgaattggtgacaatagataacattaagcaacttaaagtccttaattcccgaagcattgatacacatgtttaaaaatataaaacacgaatcagaaatatttcttaaatttcaaattcaatattagaattgatataaatttcagacattacacagttcaatgccttcattgtacaaatggaaaaaactgaggcatagggaaatgaatcactcagaaaaactcacaacataattactcaacttggagcagacttcaagccttttcacttctaaatcccttttccagaggattttgctagattgattcttatcaactgtgtggctatcacctgtattttcagtgacactacaatggctcatctaccgtgtctaagatggggttaactaattaatcaaggtatgtattagccagattctgaacattattattaattccagtgatagctattctctaataatgccaccattgtgtttcagagcagatagactcaaagacaatcatgtatttacccagttgtagtgttatatcccttctaacacatttactgatatttttattcatctcaccaataacaacacacagcattaaaaaaaacctggcaatattaacctaaaaaatggaaaggaaagctgattccataactaatctacagttgttcctgtgggaataattcattgcaatataaccctgtctcttataacctgaaaaaatacttcacttgtgtttcttccatcaaaaaaagtctttcatagatctctacatcacttctctattataaaccactgccacatttcttaataggcattaaagtggatgtaatagtttatgcttcctaaaccataccaggcaagctaattacactaactgttgctcaggctaagaaatctggatttttaaaaatgctatcaaagctgttgaaagattttaactcctagtaggctatatatgtgattcaggaggattactctggtactagtatggagacagagaaaaccaatatgacctgacaacaaattgtaaaaccctaaacgatggcaaatgcagtcatgataaaaataaaagaacagattctaataattaatgtaacttagtaattgattgtgtgtggaagtaaagaagaagaagcaataatgtccaagctcctggaattgtgctaagtagaaaaggggctcaaaatgaaaaatagacatttattattcatgacagaataatgattattcatggtaaagtgtataaagtgtcagatataggaacaaatgaaaaggaggataaaatcacatttgaaaatagaaaaaaggaaatttggaatgttaattttatgtgtctacttgagtgagccacagaatgcccagaaatttggccaaacattattctgggtatgactatagggtgtttctagatgagactcacatttgaatcagtagatagagtaaaacagattgcttttcatagtgtgggtgggccttatccatcaattgaagacctgaatagacaaaaaggctgagcaagagggaactccttctgtctaactgctatgagctgggacattggtctttttcagccttcagactcaaactgaaatatcagcgtttcttgggtcttgagcctgccagctttctgactggaacttacaccattagcattcctggtattcaggccttcagacttggacagaagctacacaacagctttcttaggtctctagtttgcagactgcagaccttggaacttatcagcctccaaaaacatgtgagccaatctcttataataaatctcctccctctgtctctctctgtctctctctatatatgtatattatatatacacacatatatctatacactcacacttatatatgtgtatatgtgtgagtgtgtatatatatatgtatatataattacacatatagaaaaaaggaaattgggatggttaattttatgtgtccacttgagtgagccacaggatgtgaggtgtatcagagaccatacacatatgtgtatatgtacagatatatatgtatgtatatatatgtatgtgcatagataatatttgtacacacacgtatatatgtatgtgcaaacatatataatatattcctttccttcctatatatgtgcatacatatataatagattatatgtgtgtatacataatatataatgtaattacatatattacatatataacatattatatattgcatatgttacattatatattacacagatataatattatgatatacaacacctattgaagaaccatgagttccatgaaccatggttctctgaagaaccatgagtaatgcagaaataagtaacaaagaatgtagtatgtcaagtttgctaagccttaaaaaaaggaagagggccgtttcagacaaagagaaaattacataggtagggtatagttttaaaagaacaaatagtataacacaactagagcatcaggtgagataaagtaggaggtaagcagaaaaaggtagattggaggtacacaggggaaaatttctgatacataaccaaagagttcagagctaatttaagaaaaagaatataattcaatgaaggttttgtagaagacttaaaatgaaattttaaaaatactttaaaatactcaaatatttaaagatacgaatacctttttctctctctttacaaaaagcaaaattatccccatttattttagcttcctctccctggaacgcatgtaactgtcaggtttagagagtcacttaggtcaggaaccctaggaatagattgtgtatgcaatattaaataaaaacaacacttctgcttctagccatgacaaagtccaactagtattggacttatccttctgccataaacaattataaaactgggtcaaaaactattaacacattattttcaagcacttgataacaaatggtgcaggactgtcatattttagagaaagggaaaatgtaagttaaccccgtattaactccagctttctacccggggtcactttccaggggcagcatgggagacagaggccaaatagagaatgacaattttactgagaggagaaggcacagatcagagtttcgggctggtaaggtagctagaatttgtgtggccaagtactgaggagagaaagcttcgcagactaggggaagcaagaaatcttcacagaggttgccctcaggcccttggccaaaagatgggctacttttgttcaggagagtattctgtgacactcttaagagaacaactatagcagtgacaaatccttcagtgctcatctgaatggagacattaaacagtgctcatagatgttaaagtcctaacgcagccagagtgagaaagcttcactgagcaacaaaagcattcggtcgagatgctggaatgaccatgcctaggaggaaagaccgtgacctaaaataatggccatgccatagaactaaggataaaattgaaataaagtataaatccattctaacaaaatcaaaacaagccaccagtagttaaccacttgccagaataaaactaaacactcctcaaagaaaaaaaaaatactcaatacataccatcccacaacataccattcataatgtcaagcatacagtcaaatattactagacatgcaaagatgtaggaaaaatgtgacccatagtcaaaagtaaaaagttgatataaacaaatcccaacatgatagagatgttggaataaggagataaagaccttaaaagtggataaatatagatatataggtggatatgttattatttatatagagatatatatgtagagatatagatataaacttaaagaaaaatgtagaaataatatattcacaatgctgagttgggaaatctcaggagagaaaagaaaactataacataggactaatgagaattctataataaaaaatactttccctgaataaattcactagatgggctgaacagcagattagacactacaataaagggtcaatgaatttgaaaacatgtgaatataaattaaccaatctgaagacaatgaaaagaaaatgattgagaagaacaagcagagccctggtacctcagaaaattcaactatttgtgaaaatccagaggaagaagaaaaggagacggaggaggagaaaaagtaggagagaagaaaaggtagggagagaaaaagaagcaaaaaacaaaattcaaaattcaaaatttgttttaaaaattaccctccagattcaagacatttagtaaaccctaaaccatgtaaatagaaaaccttgactgagtatattataatcaaagtgctgaaagataatggtaaaaagaaaatcttaaaatgtatcaaaaaaaaccctcatatgaagggaaaaaagatgaaagatgatggactcttcatcagaaaagtaaatacaggccagccaggcatggtggctcatgcctataatcccagcattttgggaggccgaggctggcaggtcacctgaggctgggggttccagaccagcctggccaacatggtgaaatcccatcgctactaaaaatacaaaaattaagcagatatagtagtgtgcacctgtaacaccagctactccggaggctgaggcatgaaaatcgcttgaacctgggtagcaaaagttgcagtgagccgagatcatgccactgcaccccagcctgggtgacagggtgagactctgtctcaaaaacaaaaacaaaacaaaacataaaccaaaaaaaaagaaaaaaatacatgccagaagatcttgaaacaacagctgtaaagtactgaaagttttttaaagtcaagccagtattccacggtcagtggaaatacttcaaaaatgaggataaaataaacatttttaataaatgcgtactgagaaaatttgtcaccagtaaaaatacgctataataatttgttattaatggttcttcaaactgaagtaggataccagattgaagcacagatatgcaagaaggaaagaagaaaattagaagtgctgaatatatgaatctatataaagaaactattttttcttttacaaatgtcattaaaatgcagcttactagtcaaagtaaaaaaaagaaattatattgtagggtttataacatatgtagaagaaaaatatataacagcaataccacaaagatggaaaagggtataaatataattataatacagttcttacattttatatgaaatactacaatggtaactctaagtaagtaataataaattaagaatacatattttaatccccatacaactgctaaaaataaataaagcagcacagcttaaaaagccaatagaagagcaagatggcaaaataagaagcccagaacctctttcccctcataggacaccatttaacagcaattcagtgacaaatgtcccttgttagaaacccataaaccagttatgaggttcctgaacctcaggcaaatatgaagccaaatgcattgaaaccagtaagaaaattcgtgtcactcatacaccatagtccccccaacccccggctcagagttgtacaatccggagaaaactcccatttcctggcttctctctggggaggaaacgaaaagactaaaacacatccaaaactcagacttttgcggtgctgcccaaggaactggtttatctcctgcctgactctaagcacagaaaaacaaaagggccaggttggggaccactgaaaacaaaagtaatggtttagactaacaaacactcgctcaccaaaattctatacccttcccctctggctcagtgcagaatgagtagggagaaaaagaagcctcaactcctggcttatccctgtggagggaaagagttaaagtgtgtgtccaaaattctgaactttcaagggactgcccgaaggactagattctgtcttgcctgtcttggaggatggatgggagggacctcgaatactctatgtacttgcaaggcacagaggacaaaatagagctgggcagattgctgctgctactgataacatacaacagacagaggcctatgccatttggtggtctctcctttgtggggtcatgccagaagagaagagtagagtatgcctctagtggtctggcttttcagggagctctctggggggaattgtttctgtgtcttcggacttagtgcactgatgtgtcccaacatttactagaagccactgagagcaaaagagagctaggcaccttgtggcagctccaaagaacacaaacagacacattagagggagaaagagatgatgaattcttaaaaaaagaaactggcaaatctctctaatgaatttatatgcacaagtccagagaagaggcatccataggaaaagtttgagaagctctctagaatatctagctgggctgattggtaaagatcttttcctatacaaagccagttcataaaaactgatatatatggctattttttcaaatgaagagatcccaacacaaagttataaggcacataataaacagagaaacatggttcaataaaaggaacaaaataaatctccagaaactgaacccaaagaaacaaaggtatggagattacatgaaatagattttaaattgctactataaagatgctcaatgagctaaggaaaaaaaaaagaattcatgaataaaatgagaatatcaacaaaaataaaatatttttaaacacccagaaagtttggaatgaaagaatacaataactaaattgaaaaatttactagaggggttcaactgcatatttgatctagctgaacaaagaattggtaaactcaaagacaggtcattgaaattatccagtaggagaaaagaataaaagaatgaaaaagagtaaagaaagactaagaaacttatggcacatgatcaaggtgttcattatatgcaatatgagggtctcagaagatgaggagaaagagaaagggaaggaaagattatttgaagaagtaatgggcccaaacttcccaaatctgtggaaagaaatgaatatccatattcaagaataccaaaagacttcaactcgtataaaactagtatataagaaatctataacaagccacattgtaatcaaattgtcaaaagtcagacaatgagagagttttgaaagcagcaaaagagaaagtgactttcacatacaagggaggctcaataagactatcagtttaaagctagatggcaaaggtaaatagaaaatcagagaatagtatggtactataaaagtagtgcataaatcacttttaattctggtgtagaaattgaaagataaaagtacaaaaaatgacaataaaaacatgataatacacaatataaaaagatgtaattgtccaggcacagtggctcacacctgtaaccccaacaatttgggaggctgaggtgggtggatcacctgaggtcaggagttggagaccagcctggccaacatagcgagaccctgtctttactaaaaagtaccaaaaaaaaaaaaaaaaaaaaggccaggtgtagtggcaggtgcctgtaatcccagctaatcgggaggctgaggtgggggaattgcttgaacccgggaggtggagattgcagcgagccgagatcatgccattgcactccagcctggatgacaagaggaaaactccatctcggggaaaaaaaaaaaagatgtaatttgtgacatctatagcatagtgtgtgcacggggagacattacaactgatggcactgataccatggggaggagacgtaaagggcagtttttgtgtacaattgaaattattagctaaaaagagattgttacaactataaaatgtctaatgtaagccctttggtaaacacaataaaaggtatctataaaagatgcaccaaagaaagtgagcaataaatcaaagcatgttgctattaaaaaaaaaatcaacaaaacacaagggaagacaacaagagaagaaaggaggaccaaaaggcaacaggatagacagaaaacaactaataaaatggcaatcataagtccttccctatcagaaattacttcaaatatagatagattaaactcttcaatcaaaagacattgagtggctgaatgtttgtttttgttttaaagatccaactataagatataaacaaatcttgctttagatttaaggacacacacagactgaaagtgaagagatggaaaagattttccatgcaaatgataagcaaagagaatcatggtaaccatatttatttaaggcaaaatagacttcaagtaaaaaactgttataagagacaaagaaggacattatataatgattaaaatgtcaatttaccaggaagagacaacaattataaatatatatgcacccaaaatatgggcaaccaaatataggaagcaaacactgatagaactgaagggagaaatggacagtagtacaatgataataggagatttcaatactccactttcaataatggaccaaacatacagagaagaaaccaataaggaaataggagctgagcaattctatttatcaaatggacctaacagacatgtaagaaacattctacagcagaagataaacattcttctcaagtgcacacaaaacattctccaggatagatcacgtgttgggtcgcaaaaggagttttaacaaatttaaggatattatttcctatagggttgtttgagctcctggaagattaaaattatacgaagtatcttttccaatcacaatggattgaaactagaaattaaaagcagaaagaaaacttaaaaattcacaaatatgtggaaactaaacaacacacccttgaatgataaacaacgaatgagtcaaagaaaaagccaaaagggaaacttaaaaatattgctagacaaataaaaatgaaaacacaacataccaaaatgtatgggatgcatcaaaagcagccgtaagagggagttttatgtcagtaaatgcctgcaataagaaaaaaaacctcaaataaaaaccttaatggtatacctgaaataactagaaaaagaagaacaaattaagcccaaagtcaccaaaagaaaggaaataatcaagattaaagtagaaataaataaaatacaagtagaaaaacaatagaaagaaatcaacaaaattaagaatttttttttgaaaagataatcaacaaacctttagccagagtatgaaaaaaacagataagtctaaaaaaaaagacatgaaagaggtgacattacaactcatgccacagacataaaataataccaattacaggtaaggagattgaatcagcaccaaaaagtcttccaaaaaggatgagcccatgactagatggcttcatttatgaattctatttacaaaacacttaaagaagaattaatatcattttttctcaaactcttgtagaaaattgaagagaggggaacacttcaaaactaattttatgaggacaccattaccttgatagcaaagacaaacaaagacaccaaaagaaagaaaattataggcctatattcccaatgaatacatacgtaaaaattctcaacaaaatgctagcaaaccaaattcaacagcacactgaaagaatcatgtatttattaccaggtggtaacatatattcctgagatgtgatgatagttcaacttacaaaaatcaatcaaggtgatataccataataacaaaatgaagggtaataaccacatcatcaactcaatagatgcagaaaatgtatttgacaaaattcaacactttttcatttaacaaacactcaaaaaactaggaatagaaggaaattacctcaacataatgaagactatatataaaaaaccaacagataacataatattcaatggtaaaaaattgaacatgtttcctctgagatctgtaagaaggcaaaaatgcacagtctcaccacttctatttaactgaaatagtacttgaagtcttagctagagtaattaggtaagaaaaaataaataaaatccaacaaaatcagaaaggatcaagtaaaattatctctgttctcaaataacatgattgcatatagagaaaattctaaagtgcatatcagaataaacaaacagaaaaacagagataataaattcagcaaagctgcaagatacaaaatcaacaaacaaaaataatttgtgtttctatacactaataccaaataatttgaaaaagaaattaagaaaataattccatttacaatagcatcaaaaataataaaatacttaggaataaatttaactgaagaggtaaaaaatttgtacactaaaaactacaaaactttgttgaaagaaattaaagaagacacaaattaatggaaggacatcccatgttcacagattggaaaaattaatattgctaaaatgtcgagaccacccaaagtgaccgaaagatttaatgtaattgctatcaaaatcccactggcattttttgtggaaatggaaaaaaaatcctaaaattcatatgaaaccaaaaaataaacaacaacaacaacaacaaaacactgtatagccaaaatgatttgagagagaagaataaagctggaagcttcatacttcctgacttcaacatattacaaagcaacataatcaatgcaatctggtactgccatcaagacagatatatagatcaatggaatagaataaagagttcagaaacaaacccatatgtatatattggttaaatgatttttgacataagtgccaagactacaaaatggagaaacaatagtctctttaacaaatagtgttgggaaaatggaatatccacatcaaaataatgaaattgaaccattatattacaccataaacaaaaataaactcaaagtcgattaaagacttaaatgcaagatctgaaactatagaactcttataataaatcattagggaacatcttcatatcgcttttcacaaggatttcattaatttgacgctgaaaatacagacaacaaaagcaaaaatagacaaatgggactacatcaaactaaaaagcttctgcccagcaaagaaaacaatctgcaggtaaaagccaacctaaagaatgagaaaaaatattggcaaatcatatatctgaggaagagttaattccaaaatatataaagacccccttcaactcaatagcaaaaccaacagataacccactttttaaaatgttttaagaattggcaaaggacttgagtagacatttctccaaagaagacatataaatggtcaataggtgtatgaaaacatgctcaatgttactatgggaatagtaaaaagatgagtggttatcaagaggtagggatagggaggggtaaacaggtagaacacagaggatttttagggtaatgaaacaattctgtgcgatgctatgatggtgtatatatgttattatacatttttcaaacctcatagaatgtacaacactaagcaagaaccataatgtagaacactgattaataatgatgtgtcatatgtatacatatgtaacaaacctgcacattgtgcacatgtactctaaaacttaaagtataataataataaaactaaaaaaagaagaaaaaaaagatgtgtcaatagattgcaacaaaagtgccactgaggtgggagatgttgatagtaatggaggttgtgtctgtctggggacagggacatatagagacactctctgtactttccactcaattttactgggaacctaaaactcctctaaaaactaaagttcgttaatgaattaaaaaaatcagtaggtaagtagaagatttcagcactatctcaaccattttaacctaattgatatttataggacactactgcaacaattgcagaacacacatccctttcaaatgctaaaaatgttcaagattcattcatgatataccataaaataagtagcaataaatttaaaaatattgaaattttacagtgtatgttctctgaccacaatggcattgaattaaaattcactaagatgaagaaaatcttcaatattttgaaacgaaacagcacatttgtaaatcacccaaggtaaagaagaaacaacaaggcacattagataatttctgaaaatgtatgttcacgaaaacaaatcactctatatttgtatgatccagtttaactaagtcttagaaatatatgagattcaaattcttatatttgaaaaaaattaaaatcaataatctaaggattactttaagaagatagaaaaagtagagaaaattacactcaaataaataaaaaaataataaagagcaaaaatcaaaatataaaacaaacaatattggaaaatttaaaagccaaagtgtttttgtaaaaaaaggtaataagatggttaaaccctaacataggtactgttgatgaaaaaagaaaaaacagtaattaccaatactaggaataaaagatggcatgtcattgtagattctatgggcaaatattatacatgcccttgtgttagtatattcaaattaggtaaaaggattaatttcttgaaaagcgtgaattaaaaattgaaaggaaaaatgaagaaaataaatataattctgcctggtaaataaatttaatttgtaaattaaaaaccttctcacagagaaagctggaggcctggttggtttaactgctgaactatatattaaatattaaagaaagaagaatgctaattttaacaaactctttcctaaattagaggaagaaataaaacctgtcacaaatctaacaaacctattactgaaaaaaaggcaaattaatattctcatacacatagatgtgaaagagtaataaaattctagcaaacaaaacctagcagagtattaaaaagaataaacaaaatatagtacatgcatacaacaaaatatttagccacaaaaaggaataaagtattgactcatgctacatgggcaaaccttgaaaacattatgctaagtgaaagaagactgtcacaagaggtcacatattacatgactccatttatctgatatgcccagaacaggaaaatctataagggaaaggggaagcggggagtaaccaacatatatatatgccatatatacacacacacaaacacacgcacagctatatacacaaacacacattctgcaaatcaataataaaaagacaacacaaattttaaaataagcaaaatatttgaacaggcacgtcagaacagaggacatacaaatgaccaataagtacatgaaaagttatcaacatcattagtcttcagcgaaatgaaaattaaaatgatggtgagaaacttcacttttctttttttttttgagacagagtctcgctctttcacccaggctggagtgcagtggtgcaatctcagcccactgtaacctccacctcctgggttcaagcgattctcctgcctcagccttctgagtagctgggactacaggcacccgccaccacgcccagctaattttttatatttttagtagagatggggtttcaccgtgttagccaggatagtctcgatctcctgaccttgtgatccgcccgcctcggcctcccaaagtgctgggattacaggcgtgagccaccgtgcctggaaaatactatttatttgtgaggatacagaccaactgcaactctcatacattgggagtgtactatgttacaaacgattagaaaataatacttctagaaatgtcacttaaaatagtatcagattgtttgcaaatttgtttcccagttcattataaagttaaacaagagcttacactatgaccccgtacttctgctcctgggtttttacacaagagaagttaaaacatggcaaaataataataataataataaagaaaaaaagaaagaaaaaaaaaagaaaatgacttgtacatgaatatttccagaagctttattcaagttagtaaaaaactgaaaataattcaaatgtctaccaaaataaaaacaaataaatacaccatggaatacttagacaatagaccttatactcagcaattttaaataattaactagtgatacacaacaacatgatggatctcagaaattttgtttaggaagaagtttcaaaatagtatagactgaaaaaattcatttatatgcaattcaagattaggccaaacaagtctatgatgagaaaaattagataattggttgtgggtgggtggggaagagactgactggaagggatgtgaagaaattttcccaagtgaaatgttgtatgtcttgatgaatgtgttggttatacaggttaatttaacaaaactcaataaattacacatttaaactttctgcattttattgcatttaaatttttaattagacaatagaaacacaaagaatgcatgtatttttacttcataaatgcatgaagtaaataataagaaaaacatgaagggatttcttcagtaaagttcaaaatttgattgaaataaaaaacccacaatgaagtagaattgtactagatacagctcttattaataaataaaaaaattatataggccatcttgtcgccatgggacaaataattgctgtgaatttatattatcttcaataaaacatatttgtaatcagtaaataggtatactcttcattatggcaactagtatggaaatttgggtacagaagataaattctgggtgatactaaccctacctctgagactttttttttttttttgagccagagtctcactcttttgcccaggctggagtgcagtggcgcaatgtttcactgtgctatgagagaagctatgtttcatccactaagcttctcttgcaaacaattatctctcttattcacactgtcattgttcatcctgaacgttctctatcaagcattcacacggatttcccatactgaaaccaacactgtttggcttacatactcttagacacattgtttgccacatgagtatgaccagggtaataaggacactcaaagtgctatcacagaaagactccaaggatcttgagaagactcatactggacgtataagtggcttttatatgccatgaaagaagattagacttttttatgtgattttgagagctttagaactgggacctaccgttgaagttaaaagtaaagcaatttcagttcaaaataacaaagttagatctatccaagattaatggaatattattaaaaagttgtataaactgaaaacaggtaaatagacacaaattttaagcatttgatgaatggctagacaatccaatctttaatatctctcatatcccaagatttaatggttctgggtgcagatggttcaccaggctctttatgcccccaagctcacaactcacacattcaccacttgctcaaacaatgaagacttgcacacacaatcccatcctcctcctagtttgttaccagctgctgccaatgatttaatactggagactgaggagagccagagtagtttcaattgtactccctaaagaggaaaaaaatcaagctaaatccaatgaggaaggataatatttgagaatggcattttcattagcagctgacaagtttaaaagtatgaacacaattacatagtgctttgtcagcaaagatgtatcattagtgtcctgaaacaaagagagaaattctacataattaataaaatgatatttaactctgctattatcaatagataaacacaatgataagtagtattccttagtagttaaagcttgaactttggatccagattgcctgatttgaaatcctaacctctctgtcagttctccaatctgagaaaatagagatgacaagaatacctatatcatagacttcttatgaggattaaattcattaattcaaatcaagcctaagaaaagtgtattgcaagacataggtatgtgctattatcaatggatgattaccatttggtatgcctacatttttcagtgttcaacctgtccatatattaggaggcaccaaggcttaaaattagactatgtgtagttttttgtttttttttgtttgttttttgtttttgtttgtttgtttgtttttgagacacagtctccctctgtagcccaggctggagtgcagtggcgcgatctcagctcactgcaatctccgcctcttgggttcaagtgattctcctgcctcagccttctgagtagctgggattacaggcgcccgccaccatgcccggctaatttgtgtatttttagtagagacggggtttctccatgttgagcaggctggtcttgaactcctgacctcgggtgatctgcctgcctcagcttcccaaagtgctgggattacaggagtgagccactgcgccctgccgaccatgtgtagtcttattggaacatctagaagttccagatgctccacttacctcagggattacattttttcatgtccactttatgcttcggggacagtattctcaggaagactttccaacacaagccagcatttaaggcagcaggtgatatgtgatatgtctaatgaattgcttttggaattgaatcattgtctttcctactgtacaagctttaaaatacttggtctttggggtctccacaccatctgcacacttaaagaaatccaagtgcaacagaaaccagtgatcacagttcatgatcacatggagcactgttcccaaaatgggctatagcaagttgatgtagcttcagtgcagcaatgagcttgacattctgcattccactgggtttggaattttttaaatgtttctgtgttttggtattcagaaacagcatctcaggactgaaatgaaagattagaggagaatgtatttatagcacagaattcccttaagaatgtaagctcttgagacaaattgcattggttctaatctactctccatttactggctgtgggactttcccacacctttgtttcctctacataaaataggaatgctgacattactactgatctcaaaactactgtgtgtattaaatgaggttatctacataaaacattttgaacagagctttttcacttggtgaatgctcaataaatattaatcactgtttattaactaaaaatttagcaagtttgaaaattctctgattaatgcatagacaaatcatgagatgactttaagcatattttggtaatataatgagagttccaagaaataaactggcttaaagcttagtgatccttcacctatatgtttaaaaatcttatcaaattactacaacttaaaagtgataggtgaagttgaagatgctaagacaaatcaaattcttgcattcaaaataatttgcattctatcagagtgctaataatagcaaatattagttgaacactaaattataggcactgatgtgaattcgctcattttatctgtgtcagaaataaagttacacatggcgtaacaatgtttcagtcaacaatggactgcataatagtacagtggtcctataagattataataccatatttttactgtatcttttctttgtttacatatgtttagatacacaaatacagttgtctgtagtattcagcccagtaacatgctgtataggtttttgtagcctaggagccataggctataccctacagcttagttgaatagcaggcaacagcatacagcctattgtatagtgggctatacactacagcctagttgtatagtaggctatatgatctaggtttgtgttagtatgccccacaattttcacacaaagacagaactacctaacaatgaatttctcagaacatatccctgtcattaagagacgcatgactgggccgggcatggtggctcacgcctgtaatcccagcactttgggaggctgaggcaggcagatcacctgaggtcaggagttccagaccagcctgatcaacatggagaaacactgtctctactgaaaatacaaaattagccgagcatggtagcacatgcctgtaaacccagctactcgggaggctgaggcaggagaatcacctgaatccgggaagcagaggttgcggtgagccgagattgcgccattgcactccagcctgggcaaaaagaacgaagttccgtctcaaaaaagcaagagagaggcatgactgcatatgaagcaggcattagtagtatcatatttcataggtaaggaaactgaaataaagagcatttaagtaacttgcctccggttaccaaatcgctctactagttagagccaaattgagggatctcagtttcagactcaaggaatctggcctcagactttactctcaatcactgctctgtactctttctatagtgcttcatgaaaatcattctagcagcatgtgcaagataaaagaaaaataagagatcatggagataggaagaccaggtattaaaatgatccagacagaaagaaacaaaggcctcaaatacacaatagccataaggctggagagtatagaataaatgaaagagatattggagaaaagaagctaaaaagacttggagactacctgtggagagcctgggaaaatttgcaggaaatgttagaattcaaataactgtattttatggatgcccctggatagggcacatgcttttgtttctctaaagtctacaacactgtctgttgtctctttggcccatcccagtcttttaatctctagatttgtccgtcataatatttcaaatggtatttccaaaccatctcctagtttccctcaaacaagaacatagacactgaacaatttcacagttgtatgaccagtatttttctaaaataaaaattactttttaccctgaaaatttataattataaaatttatggctaaaactattaaatataagaaccaacaacactaacaactaccagaaaggccacacgatggcagcaaagtatagggtacaagcagcaagagccggcggcctagagggtgctatgcactgaattctcagattccgtctattctctattgagttcatacatattagtcagcagctgtaatgctagtaacattatctccacacagcacctcacactttacaaaactcccacagatactttctctcgtctacttcttaccaccactctgagaagtcaacaggaaaaggatcatgctttgtgtggaggataaagatggaagttttactccaggtactagaagcacctcagaggctcaaaggtgagacaaagatcaaaactttgtcgttgtttcttttaggatatgatctggggaaatataatatgaatgggaatactctaccttcaactttagtggggaaaaaaatctaaggcttttttaatagaactgggaattttttaaggggttggggctgtaagttattcctcaccgaagttggagaaaaaaaaagggaaaagataaggaaagggaaagggctttatttttttaagtaacaaaggctaaaaattttcttagagattattatagaaagcttaactggagagaaatatgcctggggggaaaagcatgtatcctccaaatggtgcttgcattcattttctagggcggctttaaaaacccactacagacttgggggcttaaaacaactcttctggaggtctgaagtccaaaatcaaggtgtccacagggctgtgctccttccaaaagctctaggtgagaatcctctcttgactttttagcttctgttaatgccaggccttccttggcttgtggtgcataactccaatctctgcctccatttttacatggtcttctccatgtgtctctttctttctttctttctttctttctttctttctttctttctttctttctttctttctttctttctctttctttctttctctctctctctctcttttctttctttctttctttttttcagagttttgctcttgtcgtccaggctggagtgcagtggcgcgatcttggctcactacaacttccccctcctaggtgcaagtgattctcctgcctcagcctcccgagtagctgggattacaggcaccagccatcatgcctggctaatttttgtatatttaatagagatggggtttcaccatgttggccaggctggtcttgaactcctgacctcaggtgatctgcctgcctgggcctcccaaagtgctgagattacaggtgtgagcaccatgccccgccctttgcatgtgtttcttataaggacacttgtcattggatttagggtccacctagataatttggattgatttcatctgcagaactacatctgcaaagatcccttttccaaataagatcacatatacagttaccagggtttaagacacggggaaatcttttaaggccaccattcaacccactgtagtgctcttgtgactgtacttcctcctgccagtggggagctcatgcatgtacacattatggactcctacccttccgtgtgtttagttgccatagagcaataatatctgatctctgctccaaaatctgacaccattttgctgtatcctctccttgggttgtctcctcacctgtaaaataagagagttagaccagccaatggtcacagtcaaaagcgttcttggtctaagaggaaatgaacagtaaggcttcagagaaatgaaagcattcatattttctgccaattacttgtcatattatagtggaatcagctatcttatctccctcattagttttgagagtgtttttgttaatttttacgttttattaaatatctgcctattgtggatatttaataaatcctgagactatagagatgggcaagacagagtccttctgccaggaaatccataacccagtaggagagacagatacataacgttatcactgtgaggtagtgttcaagcagtaaggagagatcctttgcatacatgagcatagagcccacgtgaccactctaggctatgggtagactcaggtatgagataacatttattcaaccttcgagaaccaacttaagggtgtccttcataaaagaccaacttatgaagggcacacttacgttggttctccaaagttgaataaatgttattagctgagcaaaacaggagaaaacagtacatgcggaataatcaccatgtctaaagatgctaaaatgtgaaaccaactggttaagtgccttggataaagtacagcgatgaaaggtagaaaaaaaatattgtctgcaaagataatcttatgtgaacacttgctttggggccaagcatcatagcatatgcctttgtatattatataatttctcataacagcctttgtggtagaatgtcagtgtaggttaagctgtgctgaggtaacaaacaaccctcaaatatcagttgcttcatctaatgaatgtttatttctcatccacacatagtctgctgtggatttgagtcattcctcaggacagttgtcttctgtgtgtagcctcagcattctatctccttaatttctaaggaaccctcgtattcctatgttttcacattcagcaaaggaacgtctggagaattcagtaccagtaattaaatatttatacacagaagtgacatatagctattgtgcttacatttcttttgccaagcaagtcatttgtacacacctaacttcaaaggccagggaaagataatgtccaaaattagaggagaagcaggtattggggaactgaagtaagatttatcgcaggtagccaccaaattattctcattttacggaagaggaaattgagatatagagaagttagtcatagtcacacaactggtaagttgcagaatgaggatttgaactcagatctgtctgattccagatcttacactttctttattgagaaacgcatgtgccatacaaataagtttggactttatcctaatgataacagggaattactggaaggttgcaatagggaaaacacgactcatatttatgctttagaaatatgtgtataaaacaatgattggggaagaacaggactaaggatgtgaggatactagcgctgctatgacaatttttggaagagaaaagataaggccctacactgagccagtgccgtaaaagtgccagtgatgactgcaaggaggcagaagttccaaaggcaagtaagaaccagaatctataggttttaataaatgagtgaatagttaggatgaagaaaaaagaaaagaggacagaatatgattagcaaggtccaggcttgagcaaggaggaagacagaggtgccatataccaagacagggatgtaatacaagcatcaggctagctgtgtttgtttgcttttgttttccatgggggggagggccataggtggtttggatttgaacatactgaatttgagttgcctatggaaatccaagtagagagctccagcagacatttaggcatatgtatgttaaacttatcaaaaaaagattttagttacagataaatacttggggaaaaacatgcaaatctggtagtccaaatatgtgattaatgatattgccaaagagaaaaaaagagacaggctggcacaaacactataaaagataaaggtttatgatgtgtctggaggtggggatttcatcatagtcacctttgatctctcagcctaattaaggactgagtctggaagtttccccaaatttggttagctggatttatgaaacagaaaacataccagagtgtacatcatgtggacataagaataacatctgctgtattcatagcaccatattgtctacagcacatctagtagtatgcagatccccaaacttcacaatcctggaaatcaacacacacacacacatccatacattgttttatcttttcataaaatatttttattgattttggcttattaccaaaaaaagttcactgtaacagtaataatatgtataagaaaaaataaaactaaataaaaaataagattataaccttagcacatccctttttaataactattctaagctggaagctcactttctggcatccgtcctagcaaggctaggaaagtaaatgacgtagtaatggaaaagggaggggaaacagacggggagttctattcatttagggttccgtgattccattaaccttctgattcttcagagcttctccacacctttccaattcctctctgctttcatttctacattggtgttggggggaaaaaacaaaccttattagccacacataaacatcttccattaaactgctctaaagcaattactgctgttaacacagttaatggactgtcaatgtcaaatgtgaaaccttttctcctggaaaggcaacaatgacttcgtgaaatcgttttctgtgctgtagcagaaagggaggaattctggaggatcgctctttctgcaaacatcgcggtctgtgaaatctgccccctaaaaaacaaacaaacaaaaaaaccaaaccaaaacaaaaaaaccctgatcatatgcctgttatcctaaaatagcaccttcctccattatgccgaggttcagcgcaaaactgactcatgcagtaccgggatcgctgccagagcgacggagcgcgcgagcagcgcggcatcaacaggcagaaggtgccacggggcggacgggacccactgcccgggtccagactttccatccgagaaagcaaaagctttcagtatccaacttattagaagataacatcttgatagggttctcgggccttcttaaaataaatctgtcagactgtgcttttgaatctgtcctgtgtcaaggttgctcccccagggcagggcagcaatttagcttttgcaagatcctgcacttgctcctcaaacgccaaagcagcaacgcgagcaacttccgagcagctgcttcttccccactcaaagccacatcaccaacttcctcagcagcagccccagcagcaatctgggtgttcaatctatctcgatctcacaatgcccatgcctcctagaggtcttcccagagcttaggagtctttgcccctcctgggaactttctgagggtccatatagtggtccttagcactattgctgttttttttttttttttaattttagttgtaatatacgagtgttagcaatcctcatacatctctgacttatccacagtgcctagtatacaatggacaatttagtgaacaatgaataaatcagaatattgaggcttaggaaactaggacccatcacgaaccttctcatagtaatccagatcctggatggaagcttttaataaacacaacttctgttttccttcctctttgttttttatttcttctcgaaagagacttaattgaagaaaatgagctctttcacttcttccatcctccaggaacataaaactgacagcctcctccaaatgattatttagcatttaatgatttattccttgagcgcccagttgatcttccttgggcccatttgaagaactcttgtagcaaggggaaaattcacatgatcatgcacagcgtcaagctccatttaccttttgtcctttaatgatactgatgagcaggcaggtgatttaaaagagaacaaatggtcattaaaattaatcaaaaggacacaataaggaaaaatgtgctatataagggcaacataagttttgtagtgacacaaacagaacaaaacaaacaaaactcaaaggaatgcaaaggtggcatgtatagtattttagccctttaatttgaacccaaggacttaaatatgcacagttttatgcacagacaaataccactcactggggccaaatacacagtaacaatgctaaaagtttaccccttagactatttttagaaattacatactaaactattttaatcagagctataaagcacacagtgacccattcacaatttacaccaagaattctgtttttatgtacaatttaaaatgcaggggactcactgtcatcacaatggcaatgtatagaacattttaaaagcctacaatgagaaataggagccatttcatggtcatcctcatagtttttccaaccgttagaattactttatataaaataaatatttagtaaatgttagaaaaagggagagagaaaatgagggaagaagggtgatgacatgactctaggaatgaagaaatggcattcggaaaaggtattttcttttatacttgggaaagcaaaggacagaagtaatgagcaaaactttatactaaagagtctcattctatattcagtggtcagaactaggaaaggttattttggaaagttgttctcttcctgtaggataggggttctcagtgcttatggaacctacttctgaactggccttaaaaataatcttggaaaggggatggttggtgccttgtggagcttaaaaaaaaaaaaggatagtcaatatacctgtgatggtcaattttatgtgtcaacttgaccagccaaagagtgtccagatatatgttcaaatattattctaagtattcctgcaacgttgtttttggatgagattaacatttaaatcagtagagtgagtaaagcaaattgacctctgtaatggtgggtgggcctcatccaatcagttgaaggcctgagtagaacaaaaagttaactctcccctgattaagacagaaattcctacctgaaggcctttgaactggagcatcaactcttcctggttctacagcagcctactagccttcggacttaaactgggacactggctctgcagacagtggaccagcctcaataatcacatgagccaatttcttataataaataaataaataaataaaaatctcctattggttccaattctccagagacccctgactaacataatacctattttacgatacttattagaaaaaataaaacccaaccaaatttgggtataagaaacaaacagagcaagaagacatttcaaaagcggtctgagttttaaaatgtcaacactgctggtgtgtcagcaacatttaattgccatcttatccatgcccttcctcttacatgttcagcaagtgtcatttagtcttcatttaagttaggaacaaaagttcaataataggtttaacccagttttctcctttcccagcctcttttaccctaaggtgcccttgaagcaagggcctctgcccagccattccctaacagaggatcatgggagtgaagtatagtgtctttcctgtccagattaaacattatcgttgagctataaagctagatgctgctttgggaagggatcacatacaggactcttgtattttactgacttttctgcaattaataatctacttctcatagtacatatcctaaaacttaaaaggagtgcagaagttagctagtcaatattgtttattttggatatggagaaacaaagcctcagaggagaaaaatgtcctatctgtaccatacagcaattattagcagatctgtaaagcctgctatataatgaagcctcaattcttagcatgtctttaagatgcaagaatttttaaaaagtgtagttggagcttcatgaaaatccactatgtctgctctgcaggaggggctatgcttctgaccctttaccatataaacttttgcttaaagatcaaatcaagaaaataaacctctgaatctctaagtagcactgcacaattggatagttcatgtcgtcctactcaaaaatgggccacctcctgtcaatgaaaccagacttccaaaacataggttatcatagcattccccattcaaacccctgcaatgattctccattgcttaggggggatgagggcaaatgttcaaatgcttagcctaaaatttaagaacctccataatcaaagcttaacctactctagcaacacatatttgttgaatactactgtgtactaggtacaataattgagacagtagataaaaatgcatctttggaagtgactcctccagcccagtcaaactttcaggtaactgcacatgcagaagtggtcacctgcttaacagcaatctcatgagagaccctgaaccagagccacccagctaagccgctcccaaatgtctggcccacagaaactgtgagataatgaatagttattttaagccactgagttttgggataatcttttatgcaataatggataatgtacacatccatgaacagataaatggataaacagactatggtatatccatacaatggaatacaactaagcaataacaagaggtgaactattattatatataacatgctttaaaatctcaaataattacatggagtgaagtaagcctagaagagacaaactaatcaattatgatggaaaacaagtagtgattgcctaaggatggagaggaggcaaagagagaaagagttcaaacacgtacaatgaaactctggggatgcaattgttatattcattaattttatcatggtaatagtttcatgtcaaaatttgtcaaattgtacattttaattgtgcacagtttgttgtaatctgtcaattaaacctcaatagagctataaaaaatcaagtaaaaatggtgatcaaagcattggcattggccctgtcctaatgtacttcagtttggaataaaggacattaacttcgctaatagccacagtgcagtggaagaagggctaacacagcaacatggaggaggaagaggaggaggaggagaagaaagaggaggaagaggaggaggaggaggaaagtctcctgttctctgcctcccactagggcttccatattgaagtcctttctttgtttttccttttccttcttttggtaccacttagccagtagggtttgctaatgctttttttttgcatttaggttttggtccctcttaagcctagtttctttctaattcagactgatttttttttaaagatctattctggatctcttctctaaatgactctggcctattgataaacttttcaccccaacaaataatctgtagggtgttgagaagctttaaactgatatatgtagcacctagctgccactttatgaatagttaatacattgtaattattatgttgatattgttactactataaggttatattctatgataaatatgaaaaaggtacttgaaaaaaataactaaggttttctttcaccaatagattttttacttgcaatgaaaattttagaattgtaatttcaccatccaaataacctttgttttaaatcatcagataaatcaggtcactgaggggaaagggtgagttggggttaaacattaacaaatcctttgggaggtcaggcaattgaatgatgtcttttccagcacatttatgcagcccttttttttctgcttacaaacgaagaaaaataatgaatgttgcctttgggttagaaaagtacagcacagggaaagaaccatctctcactttataatatgtaaaacaatttcatattcaccatatgatttcatccgcacagcaaccatgttgtaacaaaggcagggaatgttacccaatcacacagatgagagagctgaaggtaagtcagataaagtaacttgccaaataccacgcaagctagttttagaacaactgactctaaatcttgcacattttccataacactgaaatgtttaagaagaaagtttgattggaaaaggaggtaagaaaaggaagtattgtgtgacttaaagtaaagagtaatgtcttagaaaggtactgaggggaaatcaggtcaatgtcttacctgcatgctatggcctctccttatactaagagaatgattaaataaatgataattaaatccatcagatacattatttaagaatacttgatggtatggaaaaaaaatgctcatattttaatattaagtttgaaaggcagagaaagaacaacagtttagtcccaaatctgctaggtggcaggggagggcagaaaaataaatcatcatgtttattgcggcactattcacaatagcaaagacttggaaccaacccaaatgcccatcagtgatagactggacaaagaaaatgtgacacatagacaccatggaatactatgcagccataaaaaaggacgagttcatgttctttgcagggacaggggatgaagctggtaaccatcattcttggcaaactaacacaagaacagagtaccaaacactgtatgtctcactcataagtgggaattgaacaatgagaacaccgggacacagggagggaacatcacacaccagggcctgtcggcgggtgggggactaggggagggatagcattaggagaaatacctaatgtagatgatgggttaatgggtgcagcaaaccacaatggcacgtgtatacctatgtaacaaacctgcacattctgcacatgtatcccagaacttaaagtgtaataaaaaataaataaataaataatactaatggtagccatgctctttctggtggtgagacaataaacgattttgtgtttgtttattcttttctatacttttctacttttgaactgtgagcatattgtccttagtgcaagaaatagaatctttttttaaatgaacaaatggttctgagagtcattgtgcttatcttctaaatatttggccctttgtatgtactcggttccagcagcaaaacactcacaaagggtatatgtaacaaagtggaaacatgatcctgccaactttacctggaatgctatgtgcattttggcagtgttggagagatgaaaccagaacagacttagaaaaaagctgggacagagaacaaaggaagaggaaactctgccatatggcatagaggaattcactaaaatttaggaatcttaaatagagatcccttaagactaaagtgatatgattgaggttcataaaataatttgtcattatatatttgaatatctgaataccactgtactttactctcctgaataataactgttttactcatctttctaatctcacaatgatatgcatagtattggcaaatagcaggtgcctgaattgagttgtagtttataggttgaataaacatgtatttatccaagaagtcttaaaatactaatgtgaagtgttagataaagccctaaaaggatgcttcaattcaaacaaaacaaaagaaaatgctctttttatgacaagcagtaactatgggtaaatatttggctccaaagaaaggtgcagggagatagcaaggtctagtgaaaggggttatggttggcggggggcagggtatctaaaatagcaacattgtacattcacttcatgaaagataatcgtgttctctatggcaacaaaaaatatttttggtacatttgtctgaaagataatttcaaactctagttacctgtgtaatatcaaattaataccaagtaagtaatagtaaataaaaacactttgtttatgtagcaatcacaatgtgccagacactgctctaagcactttacatatattaactaatttagtcttcctaaacttccctgtcgataggtactattattctccttgttcctttctttttactggagtaaaggaagattgagtgatttgcccaaggtcacgcagctaggaaatatttagtaaagccaggatttaaacccaagtcttgtggctccagagtctgcattcttaaccctttactgtcttttaagataaaacaacaacaataacaacaatgcatatattcaaaacttatttattaactgctcttattccttaatttcatggcagttttgcctctcagattagatttgtaagtaggaagtgtgtctttaatttttgtcccacctaacctcagagacacccagtacttttagagccaagtaatagatattcttctgctatgatgtgtctgatctttacttgctggacattcaaatttcttttgataatattacctttttcactcaaattatcaaatgaaaagaaaaaaacaactccctggacagttaatgagaaaataagaactgggtcaccatatgtaaaatgatttgcggatttgattttagttctcctgttattgcaaagcgagtagctcatattattcccacctgcaaaggaacagccttcatgaactacattttcaccacatagacacacacatccactttctataagaatgctcagcccatctgctcacatttaaaaataccaattgaagacctcccacgctgccttggtttgtaaaatgtctatcaccaaatcttcattccaacactcctttaagtttataatttctttttctcttttcttttaatgattttcactagttctttttcaagtacctaatgttcatcattaaggtttttctgaaatagacaatggtctttaaaatacagggtttcaatgttatttccatctatgatgtgtcttcattttgaggaaacattttcctatttgggaaaaggttaccttgcaccctggtaataagcctgtttccaataaagaaaattaagatctctatctgttctcaaggtacaagacttgattacagcactatgaaaagcaattcttaaaacacacacacacatacatacacacacacaaagaaaagatgaaattgtgcagacaactcattctcaagatacatttaagagagtaaaaactgaattgcgcatatatattcctgaacaaggagtggaggtatttgttggggtaggcacttcctgtatctccatgaaaatatcccctggagggtaggtaagctcaggacacacaagcactgtttccatgttgctgtaaaccacatgttattattatcattattattgagacgaagtctctctctgtcacccaggttcgagtgcagtggcatgatcttggctcactgcaaccactgcctccggggttcaatgcctctgggattcaagtgattttcctgcctcagcctcccgagtagctgggactacaggtgtgtgccaccacacccagctagtttttgtatttttcaatagagacagttttctccatgttgcccaggctggtgttgaactcctgacctcaggtggtccgatcatctcggcctccccaaatgctcagattacaggtgtgagccactgcacctggccccacatgttattcttctaagagcctcaagctcagtattccttcattcattatttcttttatctattcactcattcattgaggtaacgtgcttttactgagggccgtttcctgggcattctcataggcagtagagagaaatggtgatgacagatgccatgctccctgacctcaaataacttacaatctgggagggaggcagactagggtcctcttgacttttaattcagtgcttgctctttcctttttctttttttagaaatccaagacatacaacgttgtagcttactctttatttgcttatatacttacttatttttctgaggcactttatgcaagatcttatgcagtgattcaagttcctgtgtgctatctcactggccataaaggtgacagccaatgtgcggtattagaagaagctactggaatttatcatggagtcaacatttctattttttttttttgcaaatgttatgaaatcccttataaaaaatgattagagatgaaaactgcttcaagctctccctgaaatccaactcaataatttttttaggaaacatctagtgaccgctgaactgtggagcagcttgctaaggaaatgtgtcataatatgtagataccgggatcctaaggtatagctccacatagtttatgtctgagaggaaaattggtctatgtcccacatgtggggcttttcaaaaaatccttctcaataaagagatttttttgttgttgttgttttgttttgttttgtttttgagacggagtctcattctgttacccaggctggagtgcagtggcccgatctcagctctctgtaacctccgcctcccaggttcaagcgattctcctgccttagcctcctgagtagctgggattacaggcatgcaccactgtgcccagataattttagtagagacagggtttcaccatgttggccaggctggtttcaaactcctgatctcaggcaatctgcctgcctcggcctcccaaagtgcttggattacaggcatgagccaccacttccggcctcaataaagaattttaatgacactaatacatgttgtgaggatttaatttgaagtagatttatttgaaatacatatgaaaagtcttaaaatgtccatgcattttgaacagcaatttgagatgaaggaaataatcagatatgcataaaatgtctattaaaatgttctatttttataatagagaaaaattggacataatatactcagtgagaagggaatggttaattatgaaatcattgtttcatagataattgttatcattaaacattatatagaagactttcaatgatgtgggccaataaacacaatttattactaaataaataaagtatgtagagaattataagactcaaagcatgttaaaatatatttcaacacatcttaatacagccgggcatagtggcttatgcctgtaatcccagaactttgggaggctgaggcaggaggatgtcttgagcccaggagtttgagactgtagcctaagcaacatgatgagacctcacctctctaaaatatatatatatgtgtgtgtatatatatatgtatatatatgtgtgtgtatatatatatgtatatatatgtgtgtgtgtgtatatatatatatatatatatatacaggaagaatacatgcaaaaatgtcaaaaatattaactctggacaattagagattctaaaatttcttgactttgtcatgctctctataattgaggtcaagtgttctctttccttccattgaaatattcaactcccatcactctttgtggactttgaagatttctaaaatgtaaatgaaaatattttagaggacttcaaatttttccattctttagaacccaaatggcatgatggcttttttatctaaatacactgtaattcaaatttttcctgcatccaaatctacatggcatggtgaattcttaattactcaatgtgctgagcacagttatctctaaaatatcattatctttaattacctaaaagattataaatacatataaaaatgcttaaaacaatgaatgccttactctcttcagggtactcaaatgtcctgatagactcaatgttttactctttgacaatatttctgcaacacttgtacttgttcaggatttgtgggaaaataaaattattctaggcccactaaagtagagtctttccaaactcttgatatattaagcagctatatatagctgtacagatgttaacctggttcaccgttgcattacactttgcattttatttcagaattactaaattatggcagctttaaaaatagttttaaactttcaaaaataattgtggctgtgtatttagaatctctataaagttatttttaggattgtagctaatctgccatagactgttaacataaaaaatttatgttttatttcatatcttcttccaaagcacatactataaatataaatgggagttgttagcctataaaggaggggaactctaactgaaagttagagtttgtatctttatcacgttcactcattgttattactggattactatttcctaccttaatacatagtttagcaagttatgaagaggatgggctgacgtttgacaaggatgaagccttccagctactaagcactgtgagatctggtccagcacaaagagaaatgaaaagaaaacttcaaatgccatgtaagaagtgagagcagtcctaagggtcaggagctaaactgacttgaatagctttgaaactaagtagaatttcagtcctggtggttggtgattagaaaatggagcaggaaatgcttccacagctagtaaaaaaaagaaaaaaaaaaatccttatcttactgtcattatgaacatagatataaaggtctgggtatgaaccaggatcaaggtgaagatgaatgaggcagttcaaatgcctgtgcctagcttctcagcttcatttgaccctaccacacctgagctctcggcaggtactccccaggcctaccccactctgtttcccttcctcacatccctagcctcaacacaaacatgcacactgtgcacttttcattcctggctctataatttgctcattttgttcctccttcccttccccctcatcacatatagcctggcctaaatgagattttatctgttcctcaatctttccagaccatcccctttcttcaagagctaggtcacatcacatctcctccatgaagagatccttagttctcattcatttctccagtttccaaatctttattttatgcattgctaaatgatatccagtttgctatctaattatacactgcctcaaataacacacacctttattttctctgcaggtcaacggtgaatatcactggcttcgtgctctcttatattctccatggggcctagtgtagggtggaaaacattgaaggtacataggatatcagatgagcgatgcgaatcgtttaatgatattattgcacaaaatagtttatacttttcaagcatcttcacaatatgatgttcttccttttctagagaaaatactgttaccggtcctaaaaaaatacttttggcagtgagagtgaacctatctttgatttgctttagtggtacttttcagcccttctgaattgacaagaacagtttcaaaaactcaagacttggatattaagtcacatataatagcagaaaaagactgaagcagttttgagtttcagaatactaaatgtgaatctttctaaaatggatcagaaaaaaaaatgtgactttcagaccccctgacttcatcctacctacaattgaagagcaacgtcacagtcttgacatctgacctgtttccttggtgcttccacactcagacaggtgtctaggagaggcatcagtaactagatttctatctctacagacatatttcacaaaggctctatctcctaactctgactttcaatttagcttgttttataggccttaaagggctgcttctgaaatgatcgttttatctttttctctgttaatttaaatcctggaaaaaaattcagtctgactagctttacaaagcctgctgagctgttgtgaagaatagggttctgctgacttaaaaaaaatctgagctcataatcttctttagaaatacataggaacatcaagctgatctaccatggaatcatggagtttaatgattccggtatttctaaattcaataaggagccatttaagagacgtggaactggcttcatcccacaccttcatttcctctgatattgcctatgctctgtttcagaaggagcaaaagagatgaataattactggcagattaaccttagtaattactgtttctttgatacctttgttaacctttgaaatctctgggcatttcctgagggcacaactctatacttgcaagtatggaaaagccatagccgttttctttgttgtatgccgatcttcttcggccttgtaaatttgcaccaattaagaatattatttgcagtcttatttttaatcatgataacataattataagaatttttatctagtatattagcgatccctgtggaaaacagaggcccagagaggtccagagatacactgaggccttatctcaagtcagaggcatccctgaagcagactgcgatgggttcagagtttgaggttctcaatgtgctgcctactgttgccctagatactttcagacgatttcacatagaggtttggctcttttagttgcataccagaatgtcagccacattttctatatttatttatccttcatccctggccttatcaccagagtttgtagacaaaatctgatactcctgtctcctacctttccggattgtgccaggctgccctgtattgtctgatcctcaggctatcctgtgatcagcttctaagattttttcctttctctgctctctctgcttggctaagacatttcctcaggtctcaagcttctcttgggcttttatgcaatgttgcttttcctctattgatgaattactgtaaagctgccaacaaaactctgcccctccataaagaatgccatccccatctctagacatctctgggatatgacatctgcttttcaatagtgtatgccaggccctagctaggtgccttgctgaagccagtgaattggttaaagacaagatgtggttcagttattttcagataaaaaaattctcattctggaaacaggtttattctgctgcattcaacatcaagtgagaaaaagttaccctgctttcaataaagtaatgtggcaatagcataggtgaattcaatatttaaggaacaaactgcatgccaagtcaattctttctaggtcgggtccaaacaatactatggagtgcctggtaaatgctggacactgtgcttcctgcctgcttgcactcaccactgtcttattttagactccacaaaaaccttggaagcaacaggatataacccaggtctcttcaactataaatctttatatgttctaccatatataataaattatctttgtgcctctttccagctgtaagcaggagtgaggggtgggagcagtttcagggatctcagtagagatcatatccaacacttagttgtggtttggcacaacctggtggcaagtttcctgctcccactctaatgtccataagagattctaggctcagtgattggctgaaacttctagacacctaacaagctggtaggtatctcaccagcttgacccaaggaggttgggcctgtagaactctggggactccaggacccaatttttttctccccacttactgaggaggggttgcgtgacatttcctgctcagccttatcttgccatccatgaactccccgagcccctcaacacccacaaccagcaaaacaacaacaataggtggaagactggggccaatagtcaattgtcttgaatggaggtggggaaggggataactgtatttatagcaatgtaatattatgtctaagagtttagcttcaccgatgaaaccccatgattacttatacttagtcgaatgtgtttacatacatttagttgaaatctagcaacatatctaagaactagtgaagaaagcatacagtagtagcagtaataatatatgaagagaaaatattgtattgaaaaaatttttcaaaagaaaataacttgacactggaaagtggggaatagtccataaaagaaaaaaatcattgttataatgattactaaacataaaaattaaccaagtgtacatgtgaaagccaccatacacaaactgaataaaaaggtatgagtctttgcttcttgtgcacttgtgatttttcaggggggtggggatataacccagatgagacaagcatgggtaacaagcaggtaaatcacatctcctaaaactgaagacctggaacaaatgaaatactgaagcagacagtatattaccctacactggatttctgctcatgagcttatgaaggctctggattcctgcttatgagctacctaatgaactctggaaatttacgcaagttaatttctctaaacctcaatttccatatctatatatgggccataataatatccatctcattggttgttaccaatgatttaatgaaagaatgtaaataaagaactcagtatagtacctgacaaatagtaaatgtagttatacaatcagctattgttattgatcttaatataattaaatcattccaaaatagtgcttggaaaattggtattagtgtctccagaaagagcttaattgcctctgacacagtctatgttgcaatataactttgcctgaactggatagcaaggaagaagccagcaaggaaggctctattttcctccagaagtgggtatcaaagactaaatttcatcctctcatttttgtagagaggctttagtaaatataaatgtaagtctaggtaacgccatagagatccatttgtttatgttggaaatgtgcatatgtcctgctgcagactagaccacactcatttttactctttaaaaaaatcattcaagtcttgttaaaattctttctattaaactgctgacaactgtacttcttgttagtgtggtttccatttgtacacatttccccctgtgtctctacattataaacctaataatgtattattttagaaagagtctaacatgataattcttacacttttttggaatcactgaccccggggggtctactcagaatatatatatataaaagctatagtttaaagcaatttatgaattgaattaaatctctaaggttaatgccagcaaggcatttgaagggaaagtgctgctcataactgctccatctagcatttctgttaatgaaaagacattaccttctggtagtaatggagccacttaatcctcaatgtagaacttggtaagagtggtactcaaaacggttaccagttagttctgcagggtcatcaatcagaatgaatgccttgtgatcaagcaagtttctagaggcccccacttattctaggagtggacccactttattgctgggctgtggagcgggcactcctggcagaggttgtggtggtagtaggagggtctttgaacagcagaatatggatatattgtaatattttaacaagcatgacagctaaatgtcagccttatgtttacatataataacaaagaaataaattcatgccgaaaatcaactcaagatactctcccaggttgggcatggtggttcatgtttgtaatcccagcactttgggaggctgaggcaggaggatcagtggagcccagaaatttgagaccagcctgggcaccatagtgagaccctatcactgtatttttaattttttaaaaatttgccagatgtggtggcacacagctgtagccctagctacttgaaaggctgaggcaggagaatcgcttgagttcaggacttcaaggttacagggagctatgactgcatcgctgtattccagctgggtgacacagggagaccctctttctcatcatatatacgtaatctctctcaaatctgaaaatgtgaggaaaaagaatttctaattctaaaactttgggcaccaccttcttaaaacatgggtgaaaaagacaaataatacttttatttttgccttcacttttggttacctaatttagttatttcatcactctatagactttctttgatcatctatgatttccttgtattttatagaagtttttaacaacaggggcatatttaagaatccaggccgggcgcagcagctcacgcctgtaatcgcagcactttaggaggccgaggtgggtgaataaccaggtcaggagaccgagaccatcctggctaacacggtgaaaccccgtctctactgaaaaaaaaatacaaaaaattagccgggtgtggtggcgggctcctgtagtcccagctactcgggaggctgaggcaggagaatggcgtgaacccgggaggcggagcttgcagtgagccgagatcgcgccactgcactccagcctgggcgacagagcaacaatccgtctcaaaaaaaaaaaaaaaaaagaaaaaaagaaaaaaaaaattcagcatctggataaaaaattaaataaaattaaaacagtaatgatgttaggaacaagaaagaaattcttttataaaacagtggcatattaaagaattcagcatctggataaaaaaattaaataaaattaaaacaataatagtaacgatgttaggaacaagaaagaagttattttataataatgctaatttttgtgttttagactttacagtgttattttacatatatcaactcttttaatccatgcaacatcctgggataccagggttattattcctactttatacatgaagatgttaaagctcagaaaattaactcaaattaactcaccaaggctatacagctagaaactgggagacagtatttatacccaggtcttcttatttgagttcactttccactacattaaagcacgctggaattcctgggatttttctttaggtgagaggtaaattagtaattataatgtttgttctagagagtaaaagaatgaaacatattatcatcttaccttattacctgttgtatgtatttgtgaccacttcttgagctccataacagaatactcaagtgctgagactaatagggatgtgtgtgacagaggtcgctagaaactgtatcagcatggtcaagaatttcacactttattagcttattttaagcttatttttaaggcgtggtggctcacgcctgtaatcccagcactttggcagtccgaggcaggtggatcacaaggtcaagagatggagaccatcctggccaacatagtgaaaccccatctctactaaaaacacaaaaaatagctgggtgtggtggtgcgcacctgcagtcccagctactcgggaggctgaggcaggagaatcacttgaacccaggaggcgaagtttgcaggaagccgagattgcaccactgccctccagcctggtgacagagtgagactccatctcaaaaaaaaaaaaaagtcctaaaattttttaaaaaaagaaaacaactgctactggattgtataacaccattttatacgagcaggttgtgctaaattgtcagaagatataaaattcttaaagacttgcaaatcacaatgttttggaatggaaaagaaagttagctaacaagaggaaaaacactgcctgctccatgagtaggtctcatcaaattctatcaacttatttctaggcttaaatctcatcagcaagtccaggatgtctgatatagaacacccattatgtaagtcacactgaaaccctataggattcatgggatggagggaggaaatggacagtcaaggaagagtggagtcaagaagtagatgaaatcccccaaactcactgaatgacactaatcgaagtaaggtcccctggcaatctcctttagtccctcactttacataaagagtgactgatgctcggaggacacaaatcactttcttaaggtcacacggtaggaggacttttcagagaaaatgacaatttttaggagaaagactatgcaagcaagtaatatattttatggaaaaagaagagggaagaatagtgattgttcagcacctgtgagagaaactcttatcttccttctctaccaagatggaggttggtattgtttttactactacacagatgagaaaaaaatgatcttgggagattttttttaattgctcaagggccactggactctgaagtggtagaatggggatcccaaccttggttcttctctctcaaagtcctttgctctttccaccctaccaccatatttaacctaaaactcaggcttcagatatcaaattcatgcattaatgagtgtaaaactagacaccatagtgattcattctagaaccagtatatgtatggaaccagggaaatatataaaatcagaacacagataaagagaaaaatttcaaaccatgaaaaaaatttgtaaagcctaaactgcattgcacattgtcatactttatagatagttaattcattcagaaaacatacatagttctcaggaaattaaattcctacatttcgaattcatttatccctatttttttgtgaacatatcagtagaactgcagataatcagaaaggtttatgaacacttgaaggtttttctttttagcaggaaaacaatatttttcagcagaacaaataaatgaaattatgtaggtaagtatttattctgaatcaaaaaccccatagaagtcaagtgctgcccaaaaattatcaacagaaattatttctacatccatctttaaaacgaatgacttccttttgcttcaaggccaaagatggaggtttggatcacaattactcatgttccactcctctctgtaccacacatctagcagataatcacatggaccttgccacattttcttgaattatggattttgtgaaatacagacttcttggccttagattttaaacctctcaaaagtggcaccatcaacttaagtttctgtcccaataaaacaaacaaaaaaacagctccagccacagtgatgacctgatagcttgctgttcttgacataaaccttgttctgctcccccttgctcacacagttctctgaatagttctctctctccctcttcctcccatgcatatcactttctaacaaaacaccaaactgtctgtctcctcaaggggccttgccttcctcagtccaatcaggtcacctctcttcattttctattcatatgctttgctatctcgtattggaaacaagtagtgtgagtctaagataaagtcagtgaagaaggcggtatctatggagaccaggcaaaacccagttccttcataggcacagtcggaccaaagcagcagtgttgctctaagaagtgtcttctatccgtcttctacttgagtgctcctggggattggaagtttctaattagcccttttgatgaccagttggagcactcttacatacattttttaaaaatagagactcaatttgtcatcatgagagaatctttcacttctggacatgctcggctcccagttttaatgccttaaaacagctgccagtgaaggaaaagagaagaaatgagaaaggtgcttattgtttttcctaaaggactaaaccagaaagtagctaagtggtggcactgaggaaaaagagacaggaaataagctggttgtggcttatttataatctggttccaatggagttcaggccaaggcccatcaagccctttacctcaacaaggccctacagtgggctcaggctgaagtcttctttctcatgcatcatttactcataaggcaaaaagatatttagtacccaacataagcaaggcattgtgccagacactgaggtgagtgacaggaaaggggatggtatagttggaaatgcttacgtggcaatagaaagtccaccatgtttagaattaaaggaactgtaattattttctgcacaagcccttcacgttatagatggagaatctgaagactttggggaaggatgggtggaagggtatgggtagagggaaagctgggactagattattcctaccacaaataaaattggaagctaagcattttttttctttttttgccacagtacataatctcagtggtttaaccagaaaaaaaaattataagaaaaactacttataagtgactactcttgctactctgttttgctacaggctgtgtaggcaatacaaataggttaggcagggggaaaaaaaaatctctattaggacaagtagccctgtatacctggatacttttacctagttcaaaattctagaattataattgctccccattcaactcgggcctgatagagtaaacagacattttgtctgaagttgttttatcagtattgtcttgttgatgaagattgcacacattttacaaagctctgttgggataaaccctcctttttgggagaagagattatgtcttcgttatttgcccctgtctttgctggtgtacactgtagcacatttcagactacctggttctaggtattggaatccaatcttatttgtctactgccaccagcatctctggccctttcacgggtcctggtaaagtggtatttgcaaactgtgtcctcctgatcctagtcacagatccttcttttctgctggttttttcccctcctatcgttgtttctttcttagggttatgggaaacttttagttgttcaccatgcgggatgcataggaatttgagaagcaacactcttgtccatcttcccaagctcctcgcccagttgttgctcctctaccatcataatatcatgcaggatgcaggatacttcacagggcatagttgtccttgcagaaaaaaacaaaacaaaaacaaaaccactttccagaattccctcaaatttctccaagggtctccatcttctctttatctccagagcttggtatcaagcaaagggaagaggggttgagcatttcatggagactcagtacacctcagctcgactcatagctcctctagtgctatttcctgcccattaggcacaaaattgtctgctttgatgtcacacgtttctgactgactatgataaatacatacagaagctgataattcctcacctgcctgccattacaataatggtctgagccaccatcatcctccacctgtactactgtgattgcctcctcactggtccatctgcttcctcttttgattctctagaacctatattcagaacagcagccatgtgatccctttaaaatgcaagtaacatagcatcattcttctgttccgcaaaatccttcattggtttccccttcattcttaataaaatccaaagctctgatattgacccaggaagccctatattatctgcccttcctgcctcctctctaacactctgctcttttgcctcaggcctctgcacaagctgtccccattgcttagactccagatatctttttcctgactgccttcaggtctggtcaactgccatgcacctgcgtgaccctcttccctcatgatcatacgtagaatagcaaccctatgccctctgtgaccctcttctccttctctctgcctcttcttccccacagcacttattatcacctgacatactatttgtttatttgctgatatatgctcatttccacccattggaacataaactccatgagaacacattattttgtttgctactgaatacccagtgcctggcactttacagatactcaataaatgtttgtaggatgagtgaatgaatgaatgaacaaactctaaattgggagttcaccaaactttgaatctttattagcaaagtcaatctttggaactaaacaaacaaacgaaccgaaaaacaatctcacaagaagcctgcattgggtttcaaaattattttttctgcggtgcacttttaaaagttcatttttcaattcaaagctaggcattgatttctttgttctgggttgcttctgccctccctctgaggcttgaaagatactggctcaaacggtagaaggctctggaacaaaggaaaaaccaggaaaaaaaattcctctttttataaaaatcctcaaattgcattactctgcctgagaatattgtaataaggatttaaatggttttggtcttactttgtctagacactttcattcttagtcttgccttgaattgcttaaatattaagagggtaagcagcttgtcggttagagtaaagttatgcaaaaagagcaaatctgctaaaattttccaaagaacgtagtggagctggggcttgaaatgtctggtaaggacatttgaacaggagactgcctattttcaaaagttggataacaggctttgatagtgaaacacggggtgcataactggacacaatggataaaatgaatagaatgagtgtcatcacatgatgaatgggctagttttagagtccacacattcactcaataatggttttacctggtttgcaaggtggcaatccacagttgccagtcctcaagcacactttatttagcctatatttgttaaagaaaaaatttcacatataaatcttgatctccattttcctttaaaagtagaaggtctgccacacttgcttgttaagaaaaaatcacccaggccttggaaataagacaaaaatgagacaaagggactacagcatgctcattcagtcataatagaatattgtctaaaaaatctgctgctatggtttggatatgtcccccaagtttcatgtgttggaaacgtaatccccaaattcatacgttgatggcttttggagatgaggcctttgtgagataattaggatcagataaggtctgatcctaaacagagttgggcccccatgatgggattggtggttttataagaagagcaagagagtcctgagctgacatgctctcgtcctttcaccatgtgatattttctgccatgttatgatgccgtaagaaggttctcaccagacgcaacccctcagtcttagacttcccagtctccagaactgtaagaaataaatttgtttataaattgccgaatctgtgatattctgttacagcaatagaaaatggactaagatacctgcctaagactcatacaattgtctaggccctagactctagtgatgcaatattgttacatttactgtgtactactgattagagttaaaagtctataaagttagatgccaacttgtagaagattgagtgattgtaaattatttttgtacaatagaataaataactccataggtaacagttttgtttccttgtagggtattaaccaattttttaactaactttattttctctcagtattcttatttctgttgactgtataaatattccagcctctcattttctcctttgaaccagctgtcatcttactaaattcttattatgagttaaattaatctttgacacgttcactgtatatttgtaagacagtcatgctttctttcagcttttggaaaattatatttggacctgcttcacattcctaaatgggaaccaatgtctagaataatcactagctgctcccattaagcaagggcagctctccaattcaacacagtttcctcctcccactcctgataatcttatttccagtcctttccctcattcatgtgtccttcttggcctcggtgagcctttgagttcttaacgtctgacttataccttgaggttttagtagagcagtggttcttactcttgaacatgtatgaaaatctccaggagggcttattaaaacacagattgctgggctacaccccagagtatctgactcagtaggcctggggtgagactcaagaattcgcatttctaacaatttctcagatgatgctgatgttgctagtgcagggaccacacttggaaaatcattgttgtagtaagtggtaggctttgaacttggtcttggtagattagaaggcatttttcactgtaacaatttgacaagttgaatgcaagacatagtaaagtaagacttatttttaaaaaactttgaaagccaagcacagtggctcacacctataatcccagtactttgggaggctgaggtgggtggattacttgagctaaagttcaagaccagcctgaccaacatggtgaaaccctgtttctaccaaaaatataaaaattagctaggtatggtggtgcacgcctgtagtcccagctacttgggaggctgaggtgggaggatggcttgagccagggaggcgggggttgcagttagccgatattgtaccactgtactccagcctggtgacacagccagaccctgactcaaaaatataatataatataatataatataatataatataatataatataatatactcttaaaatgtgaattacaacatattagataatagcatttctcatgatgcctactctacttgagaattaactgctgatgatattgaaaacaatgagtaatttttgtaaatttattgaaacgtcaagactgttcaatgactactttttttgtttgtctacattttaacttctttgaaggcaaagaaatcctagtagcctcctcagtgcagtgtctaacgtaggctaatgctatggacctggcaaacacctattgacttacaatgatacatttctatgtatgactgtggtttcctaagcttttcatattcattatctcattcaacatatacaacaatcctgtgaggtgaatagggtatgtgtattactctactttacagataaataagctaagttttagaggcttgacatgtctttccctaggatacaaagcaaatatatggcaaagccagggctagcacttgatctttagtcttgctcaccaggattatttactgacacacaatgaaaactagattaaaaatgccatgaggatttaggataagctaaaagattcttaaaatgcaattggacccataatacattactcacaaattacagaaagcatctattttacacacacacaattatttacacacggcagctttgcagtgaatactttgagtgagatttaaaaaatagactctattccacccaattaatcagcatcagatagcaaggaggctgctaaactttctggaatttaaaactttgcaaagaggaagatagtgtgtagaaagtggataaatgctggagtcaaacaaatcttcattctgtcattgaccagctatgataccttgaaaaaattcaccttaattctatgaatgttaagtcccttgcctgtaaaataaagtatatgtatatgttaaaattttaatctctaataaggattacgcaaaaatatatgtgaaactaagaatgtacatacagagtacctagtccagggccttgagtagtgagagtgcacaataagagttaattcctaccctaacttattggaagggcaaaaggatgtgctaggactgttaggatttgaacattaaagaacatattgagtgaagtgttattactcattcccactacatcctcaaaattctattgaatcgttcacgcaccaaaccacagtatattccagaaaaagcaaatataggcatattattgcaatactaatacagttttccattgactagtacactaagaaatcaccagcatgtattaccatcatggcaggtgatttaaatgaatgtcaggtgcaacatattgtatttccatttgactgttttgcagtgcaggaatcaatgagaaagaacaaggcaacagtttgagccacaaaggggaaaaaaggagaaaatggaataattgcattcaccctagtgcagaaatgtacaagtgtaagtggcatgaaaggaaatatacataattatagtctgcatagaactgggaacaaatggaaagagtggctgtgttgactgagaaagagaagaaaagtcggagaaactggccactctgcattccagacacaggcagatttcatctgcaaacagtgccctggccagacttgccagttacgtggatgacaaagcagaaaacaaatgcactgattaaagtgctgaattcatcctcagactgaaatacaacttacagcagaaaaagagggggcctaaactggagatgacaatctggcattttgatgcagacaggctgggatagatggcatacctggagtatcaaaattcattttcccttgtgtaaataaatgctcataaactgtaaagtgggtaacgaaggttgggtttgtttggaccagagatgttagaaaacagtcaacactttgttccctattgtaagaacacagcagcctcaagatgtgctaagattgaccacccacaacttccctggtggacatgcagtagctcttctgtgatttgtagtaaaatatcagcccttcctggcaatgcacattactgcataattgcagatgtactacagtctaactggtataacagaactctacacaactacagttagaaaagctaacatgacaccaaatgcccacgccaccagtgaatcacagcaagagaaaaagaaattgcattgtctatgcattattggaaaagaatattttatactgtcgaggggctagaggctggcttgttcaccctcagcaacactatctgccttactagctggctgatagttcattgcttgtataatttataataattctgggtgtgtattagtgctagcaagtgtgataagcatgagtaactatgacccctcctaaagtgcaaggtattctaaaagctaagatccttgtttgctcactagtcaaggacatgggagttttgggtcttgatattccttagagggcagtgtttctcaaacacacatatctcatgtatacaaagctgctggagattttgtttaaatgcaggttctgcatcagtaggcctggagtacagctaaaagtctgcatttctaagaaaagtcaggtgataaccctagagcacatggcacagcaaatagtagatgtgtaattattaaatggactagagttaaatatcaaggcacttagattaagcaaccgtatttcaaatccaaagagtggagtggattagctatacactttcctctcactctaaattccaacatacagtttaagaagacttggaaccaacccaaatgcccatcaatgatagactggacaaagaaaacgtggcacatatacaccatggaatactatgcagccataaaaaaggatgagtttatatcctttgcagggacatggatgaagttgaaaaccatcattctcagcaagctaacacaagaacagaaaaccaaacaccacatattctcactctaagtgggagttgaacaatgagaacacatggacacagggaggggaatatcacacaccggagcctgtagggggtgggggactaggagatggatagcattagaagaaatacctaatgtagatcacaggttgatgggtgcagcaaaccaccatggcacgtgtatacctatgtaacaaacttgtacattctgcacacgtaccccagaacttgaagtataataataataataataataataataataaagactgttacctttggaatcctacagtcctgaatttaggccttaactttgcaatttactaaatatgtgatcttcagtaagttaacttctctgaatctcatttttgtacctaaaaaatatctcgactacttatatactacctatattacctgttaaatgttacctacctcagaaggtagttctgagaattgaataaaataatgcacttagaatgtataccacagtgcctggcatctataagataataaaaatgacaaccaatattgttattgccactatgtaagtatttccaacgaccagtttctaatgttagcagaaggatgagagtaattataatggagggaagatttactcatttattaactaataaatatttattgaggacttttctgagacaatcatagtctagcactgaggatacgacatttaaaaagtaagagaatgactgtgctttcatgcagctgtcattctagagggagaaaaaaataaataataaaacatgtaaataatacaaatagtgatatatatgttttaaaaataaagtatccaactatatgacattatagagaaaaaaagtgtggagatagtaaagttagtggctagtctgatacaatcccatttgtttatatttacttttgttacctggattttgaggtcttattcataaaatcctttcctgtgccagtgtcctgaattgttttctctatgttttcttctagtagttttacagtttcaggtcttatatttcagtctttgattcattttgagttgatttttgtgtaggaagagaagcagggacctagttccattcttctgcatatagttatcctgttttcccagcactaattattgaagaaattgtccttcccacaatgactgttcctggcgcctttgtcaaaaattaaatgttggctgtagatatgtggattaatttctggaccctgtcatctgttccattggtctatgtgtctgtttttataacaacatcatgctattttagttactacagctttgtaatatattttgaagtctggtagtgtgatgccttcagctttgtttgttttgctcagaatcgttttggctatttggggtcttttgtggttccatacaaattttatgattaaaaaaaatcctgtgaagaatatcatcggtattttgatagagatttcactgaatctgtagattgctttgggtagtattaaataaccaacaaagtgaaaaggcaacctataaaatgaaataaaatatttgcaaactattcatacaacagaagattaatgtccagaatatacaagaaactcaaacatctcaacagcaaaaaacaaacaattcaatttaaaaatgggcaaatgaactgaaaagacatttttcaaaagaagatatgcaaatggccaagaaatacatgaaaaaaatgctcaacatcactaatcaacagggaaatgcaaatcaaaaccacaatgaagtatcacctcaccccaattataatggctgtaatcaaaaatacagaaaataacaaatgctggcagggatgcagaaaaaaggttactcttatatgctgttgatgaaaatgtaaactcataacaccgctatggaaaacagtatggaggttcctcaaaaaactacaaatagaactactgtacgacccagtaatcctactactgagcatctatcccaaggaagggaaattagcaatatcaaagagacatctgcaccccatgtttatggcagtactattcacaatagccaaaatatggagtcaatctaggtgtccaacaactgatgaatggataaagaacatatgatataaatacacaacgaaataccattcagccataaaaaagaataaaatctgtcattcacagcaacatggatggaagtggagggcattacattaaatgaaataagccaggaatagaaagttaaagttctcaatcatatgtagaagctgaaaaagttgatctcatagaagttaaaagtagaacagagaatactataggctgggaagagtagggtacaggggaaatagggagagatctgttaaaacataaaaattacagctagataggaagagtaagttctagtgttccataccactgtagtgtgattatagttaataataatatgtagtttcaaatagctacaaggaggatattgaatgttcccaacacaagaaaatgataaatgtttgagataatggatatcttaattacccttctctgatcatatacattacatgtattgcaaaatcacaatgtacccccacagatatgtacaattattataggtcagcttagaaaagaaaaaaaaagtcactggttgctaggggttagtgaagatggggagatcaatcggcaaagcacagaggactttaaacacagtgaaactacagtcatccagcagtattcctgggggactggttccagaacccctgtggataccaaaatccacatacaatggtgtagtatttgcatatcaccagtaaacattctcccatgtactttagatcatctctagattctttataatacctactacaatgcaaatactatgtaaatagttgttatacaatatttttcagggaataaggaaaacaaaagaagtctgtacatattcagtatagacacaactgtccattttttttaagtatttttgtttcacagttggttgaatccacagatgtagcacccatgaatatggagggctgactgtatgctgcatgttagttactataaaggtggatacatgtcattaaacatttgtttaaactgatagaatgtacaacacctagagagaaccctaatgtaaactatggactttggatgataatgatgtgtcaatgtaggttcaccaattcaattctaacaaatgtcttattctggcttaagatgttgatagtggggagattgtgtatgtggtgagagggagaggatatataggaactttctgctcaattttcctgagaacttaaaatggctcaaaacataaagtctattatttaagaagtaaaaaattagtaggcaaataaataatactaaagaggacagattacagctggctgggtcatgggtaaggtgaggggtatttgagacatcatggtcagggaagctccttcccaggaggtggtatttgtgcaaaacctaaaaaatgagaaggatccaactaagcaaatccttctaccaccttatccatcaaattctatgttgatgattacacatcctctcagagctgtgaagtgtagttgaattaacgctgataagaagtgtccactctcaggcatgtacaagttgctgccacagtgtgtatgcaactgtttctaaacagcaaagtttcaatagatacttgttaaggaaaagatctatgataccactgtgggacccaggaaaacgttgctgtttatgagtatctggcacttctaattaaattagtgcacaaaggcccaaaaaaaaaaaaaacacagaaaaatacaggtcaatatccctgattaagataaatgcaaaaatcctcatcaaaatactagcaaaccaaatccagcagcacacaaaaagtcaatttactatgatcaagtaagcttctttcctaggaggcaacgttggttcaacatatgaaaatcaataaatgtgattctctctataaatagaattaacaaaaaccatatgaccatctcaataaacacaggaaaagctttcaataaaatttaacatcccctcatgataaaaacccacaggaaactaggcatcaaaggaacatatctcaaaataataagaccttctatgacaaatctataggcaacatcatactgaataggtaaaagttggaagcattccccttgaaaactggaacaagacatgatgtccactctcaccactcctattcaatatagtgctggaagtcctagccagagcagtcggacaagagaaagaaatcaaaggcatccaaataggaaaataagaagttaaattatatctctttgctgacagtatcattctatgcctagaaaacattaaagactctgccaaaaggttcctggaactgattaatcacttcagtaaagttttaggatacaaaatcaatgcacaaaaatcagtagcatttctgtacaccaataatgttcaagctgagagccaaatcaagtacacaattccatttacaatatcaacaaaaaaataaagtaaaatatctagggatgtattgggggaacctgcccccaatatttcaacatagattctattttccataagtgttggccggctgagaaataaagagaaagagtacaaagagaggaattttacagctgggggtgctgggggtgacatcacatatcagtaggactgtgatgcccacctgagcctcaaaaccagcaggtttttattaaagatttcaaaaggggagggggtgtctgaacagggagtaggtcacaaagatcacatgcctcaaagggcaaaaagcagaacaaagatcacatgcttctgaggaaacaggacaaagggcaaaaggcagaactcctgataagggtctatgctcagtggtgcacgtattgtcttgataaacatcttaacagaaaacagggttcgagagcagagaactggtctgaccaaaaatttaccaggatggagttccccaatcctagtaagcctgagggtactgcagaagaccagggcgtatctcagtccttatctcaaccacacaggacagacattcccagagcggccgtttatagacctccccccaggaatgaattcctttcccagagtattaatatcaatagtctttgtgaggaaaagaatttagtgatacttccctacttgcacgttcatttatagtctctctgcaagaagaaaaatatggctctttttgcatgcacgtgcaggctgtcagaccttatgattgtcttcccttgttccctaaaaatcgctgttattctgttctttttcaaggtgcactgatttcatactgtttgaacacacatgttttacaatcaatttgtacagttaacacaattatcacagtggtcctgaggtgacgtacatcctcagcttatgaagataacaggattaagagattaaagtaaagataggcataagaaattataaaagtattatttgggaactgataaatgtccatgaaatcttcataatttatgttcctcttcttcagctccagccggtccctccgttcagggtccctgacttcccacaacaggaatgcatccaatcaaggaactgaaagatttctacaaggagaactacgaactactgctgaaataaatcatagaggacacaaacaaatgaaaaagcattccatgctcacggactggaagaatcaatattgttaaaatggtcattctgcccagagcaatctacagattcaatgctattcctatcaagctacaaatgtcattttttacagaactagaaaaaactattctaaaattcatatgcaaccacaaaagagcctgaatagcaaaaacaatcctaagcaaaaagaacaaagccagaggaatcacattacccaacttcaaactatgctataaggctatagtaactaaaacagcatagtatgggtacaaagcagatatagaccaatggaacagagtaaagaacccagaaataaagctgcacacctacaatcatctgatcttcagcagagtcaacaaaaacaagtaatagggaaaggattccctatttaatacatggtgctaggatagctggctagccacagtaaaactgggcccctgtctttcatgatatacaaaaactcaagctgaattaaagatttcagtgtaatacctcacactataagaatcctagaagagggtcaggggcagtggctcacacctttaattccagcactttgggaggtcgagataggcggatcatcaggtcaggagatcgagaccatcctggccaacatggtgaaaccctgtctctactaaaaatacaaaaattagcttggcatagtggcacacacttctagtcccagctactcgggaggctgaggcaggcaggagaatctcttgaacctgggaggtggaggttgcagtgagccaaggtcgcaccactgcactccagcctggggaaagagggagactccgtctcaaaaaaaaaaaaaaaaatcctagaagaaaacccaggaaacactgttttgtacattggcttggccttgggaaagaatctattactaagtcctcaaaagcaagtggaattgacaagcggaacctaatgaaacttaagagcttctgcacagcaaaacaactaacaacagagtaaacagacaacctacagaaagggagaaaatattcacaacttatgcatccaccaaaggtctaatatctggaatctatgagaaagctaaacaattgaacaagccaaaaacaaataatctcattttaaaaaggcccaacaaaaacagaaaaatacagatgcaaaagacatgaacacacacacttcttaaaagacatacaagcagctaacaaacatgaaaaaaatgttcaacatcactaattatcagagaaatgaaaatcaagaccacaatgacataccatctcacagcagtcagaatggctattattaaaaagtcaaaacacaatagatgttggtgagctgtagagaaaagggaatgcttataaactgttggtgggaatgtaaattagtatagccacaatggaaagaagtttggagatttctcaaagaacttaaaagagaactaccattcaacccagcaatccccattactgggtatatattcaaaaggaaataaattattctaccaaaaagacccatgcactcatatatgttcatcacagcactattcacaatagcaaacacatgaaatcaacctagatgtccatcaatggtggactggataaagaaaatgtgccacatatatgccatggaatactatgcagccaaaaaaagaacaaaatcatgtcctttgcagcaacatggatgcagctggagatcattatcctaagcaaattaatgcatgaacagaaaaccaaatactgcatgttctcgcttacaaatgggagctaaacattgggtgctcatggacatatagacggccgtaactgacactgaggactaccagaaagaggagggagaaagagggtgcaggggttgaaaaactaaccattgtgtattatgttcagtacttgggtgatgggatcaactgtacaccaaacctcagtatcacacaatatacccaggtaacaaacctgcacatgcaccccctgcatctaaaataaaagttgaaatttaaaataataataataaattagtgcacattaataatcactgttcactaggcactatctaatttatgtgccatgtacttgattctcattacttcattgatcatcacagagaatcttgtaacattgatatggttattttcctgttacacaggaagaaacaaggcttaaggggttaagtaagctgtccaaggtcatacagttatttaaaagcagtgcaaggatttgaacctggatctgttctattctcaagtctgggctatcaaacagcttccaactgggaattccctgctccacacctccagtaaacttcagtcttccccctgactcccaggtataaatccccctcttccaaacagcgtgaaatatcttaaagtaattgcagcagcatgttgaataagccaggtgaatacaaatgtttattactggaacttcataagaatgcagagacagcttcaaggacaaccccctcccccaacacacacgcaggtacacacacacgcaggtacactatccattcagtcacaattttaccatttatgctctgactgattctctgtaacttttgaaatgttttcactgttgtttatttaacagctacaaccagagtcattagccattgactactggacataagaggcttgctatttgactaaagttggacaaaaacccacatgaagctgccacatcctgcagcagttcccatgaaatccaccttatccaggaaaccccatgtgttcaggagcagtatcagaaagccgttctgctgagcaaagaagagaggagcacagagagaaggtgcttcaacaccacagaaagaaaattgaggcctggcataaggaagaacgaagaatgtggtggtatttggagttagtggaagaggaggagtttcaggggtgtcagacttgagttttcatcctgctttccactagagcttctgttaactagagctttagtttctttattacatgctgatagtagtgccagggtgaagggaagactaaatatgatgtcaatgccattacaaatgcctgacatatagcacgctttcaaaaatatgtcagttcctttgttggagtaaaaggttttcttcatttctaattgactgttttaaaaatacaatgattattactcttgttactctgatgtatgattcattaattttatttaagctccccatgtatttcaatagaactttgacaatttttaaaaaggacataaaaagttcgttggtggaaattttcttgtcagctctcttcgtttcaccatgagcaaataaaaatagttaacatacccagagaacactgaaaattaaaaaaaaaaaaaaaaaaaaagaagaagaagaatagttaacattccctgagcacttactttgagccagtccctcttctgactgaattccgcatcacaaaaacccagttaggaacatgtccttgccattattgtgcccattttacagatgagaaaactggatcattgaggccattgttaagtgaaataagccaggcacagaaagacaaacttcgcatgctctcgcttatttgtgggagctaaaaattaaaacaatcgaacctcatagagatagaaggtagaatgatggttaccagagttgggaagggtggtgggggcagtgggaagtgatgacagttaatgggtacaaaaaatataattagatagaatgaataggatctagcttttgacagcacagcagagtgactacagtcaacaataatttattgaacatgtaaaaataactaaaagagtataattggaatgtttgtgacacaaagaagtgataaatgtttgaggtgatggatattccatttaccttgatatgattattatgcattgcatgcctgtatcaaaatatctcatgtgctctgtatatatacacctacaatatacctacaaaaattaaaaattaaaaaaggagaggaatatgtaccaaatttgacaaactatccccttataaggagccatcagcacatgcagaccctcccttttaaatttatatggaatttattctcctatggcagaatcgtctcatatttcaggtcagataaacagtgtgtattaggcagagcccagaacacccaacagatagaaaaagctgcaaactccttctggccttccgagaagatgcttttacatctagaagcagatgatttcattattgctactttactgtgaacctcaaaattgctgacggttaaataattcagccctctgggaaaatccagcccccagttttaagtctctaacccttatgccaatttgataagcagtagagagagacataacatgactctttaggttgttctaaatttaccagctccgaaatatttaatgcagaagaagtgcatggtcagttccacatattctggcacttaaccagcttagtgaggcaggcttaaagaggaggatactaaaaaaggcatttggctgagctataatgggcatccagcttaagggacagaatctgtagttagctaactttggaaattctgtgttccttctggataaagctgtgatcattctcttcttcctctagattcttcttaatgacgggggttcaacaggtcaaataaactaaaattctgcaaactctccatatttgttatataagcctggtgtgttgattctggacggtagtcacaccctctacccagctaactgtgttacatgctgaatagatgatgcataggcagaccttgaccatacttgatcagatgccatacaacacagattttcctgaagccaatcataaacggggggtgaagcgtgtgaaaaggctgcatttgcaggactgcttctcccactctccagatatactttggcttatgattgttggttcttatagtgctgggaagcacccaaaccagggtaggagggagggatcatgaatatggaaaagatatattgccttatacggctgttgcctaagttagtgtgttgaacgctggcttgagacattgcatgtctgttcttaagatgccagcaagcatcatgaagtcaacaattcctaatatcttgcaagtaagcttgttcttctttcattattacactactctgaaatctcaggaaagacacagttaccgtgttaggggcaagctgctgggagccaagaacccgtaaaatagttgttatggcctcatatgttgcaacattcttaatttgttttgagtgcaaagtgttgtcttctgaaacagattaaaaacactcagaaggtcataactgtattttataccccttttaatatttttctcaaaatatcaggcacaaacctaggcaaaacatctgtgttcactgcacttgctcacttgacttggttcaaacagacgtagaactttgtcagaccatgtcagctaaaatataatttgatttgtacctgagcataagcacaactaatattcagcctgatgcatggctgtgcctgctgtttacagttggcatctgttctgactggtctgtgctaggacaggtgtgaaatattttaaatacatccatgatcattagtatttgcttccaatttattgtgacaattggtgccactatcatatataacttttcagtctttgaacattcaatttccagagttactaaggatcacagaatcacagaatctcagaattagaaagaatgctcacattcatctatttccacccgctgctgggtacagaaatctcctcttcagattctttcactcattggtcagtcagaatccaagcaaaagaagctgagagcttactgaatgtgaatcaaatttcccttttattgtacattgtctgcaattataaaaaggaagccattagaagtgtacactgagctccaagaaaatatgaacagtgatgatgtatatccagggaggaaattgtgtgttctctccagtcttgttatattggtccacagatcaaagggaagattcacataaaatctggccactgtttatctcccgttgttaacaccttattccaaaccacaattatctcatccggattattgcaattgctttctgcctggtctctttgctacatccattaccttgttcagtttattcaacatggaaaccagagtgatcctgttaaaatgtcagatcaggtcactcctttattcaaaagcctcaatgactttccatctctgtaagaattaaagccaatgtccatattagaacctgcaaggccctgcaagatctggcttccccatttcttctttgactatctcttactcctaataccctggctatttctcgaatataccaggtgtgtggtcatgtctcaaaacctctgctcttgctgtgccctcagcctggagaacgttgtcacccaaatattccttcacctcattccattgtttgctcaaatgacaccttctcagcagggcctaagctagcctccttatataaaaattgcagcctcatttatactccctataaccgtttctgttttactttcctctttagcccttatcatgatctttattttccccaattacattttaacttctgtaagggcaagaacttctgtctgttttgtccactagcataatctcaaagcctacaatagtgttcattacatattaatcacttaataatcagctatagaagaaagaaaagaagaaaagatggagggccagctccattgcaatgccatacgtggaagctacatacctagaagctctgctttctgctttgcttgtagaatttaaaactctttaagcctctgggaagatcagagtatccttgaaaagcatgtatggctacttattggaattatttctagcttttaaagcctacatacacagtggtcagaaaaggaggctgttatcagggattgtctttttaattttgattttagatcttactttgatactgtttgcattagcatgttttacgggtgtgttcattcattcaacaaatatctattgagaatctattatctacaaggtccttgcattagccttaaggatatctgaagctgtattgaatgtattctgtaaaatacataaagaaaaagtgcaccgtcaggcaatggttctgaacacagcttcataatagaattgcccaagaaactcaaaaccaaaccactgcctgggacctggtttcagaaagaagaacagaggaattcttaagtacttcccacgtaactgtcatattcactccaggttttactcctgctgtcatattaaaaggatgtatactgaaggagcaacagatataagtgctagaggagtacgagaaagagtaatgctgtctagtcagagctatgttcctcaaactatgttccaaaggacagtagtcatctgtgaaaggttaatagctattttaggtgagtaaatagccccacgttcaaataaatttgggaaattattcattctccatttcatggagattcagtgttttagggaatctctctgcactcaagtgagttgagggagatgaggcagacattctacggagagtcattgatgagttcaaccctgttaaacaggcctgcagaggctctgggattataatactacttgggcttcatgccaccacatgactctctatatacccatttatcttagccatgtagaattgcaaccaaggccagttcttggccacgaaaacaaaccagtcacagtagtagagaaatggctctatttttaaaggtttatagtgactggatgaagtatcctctgctttccttctatgaccctggactttgggtgctcctatctacctggattttttttatattttctccacatttttgcacttcttaattgactaggtttgtatatcatttcctttgttagccttttgaaagtaaatgaatcacttggaagacagagaaacgaagttttgctttattatgccgaactgggatctataacacacatctgaatttcataactgtgtttggcttacatggttgacttcatattcaattgatgatattcatcttaattaagaataaatagacaaatggctactaaaagggaggctgattaaatacattatgataaacctagatggtgaaatactttgcagaatgggaaatgtcacgggaaaatggtcaccataaagtaagaaaaaaatgtgagggtggaggatacaaagctacttctgatataaaaatgacctacaaattatagctatgaaataacattattagggctatatattttcatattctgcttatttcataccaactcttctaagctgaacatgtattaatttcaaaacataaaaaatagggacatttaagccaataacttgtggtgttttaatggaaaccaaataaatagaaatcagttttcctttataccccctgttccaagaaacatgctccttgcccaaatttttctttgagatttaaattggcataactcttctgagttgaatgtttccacaattttaaggcaaaaacaaattaatgctgataaaaatactttggaaccacaaactgtgggatagacaaataatcctgaaaacacacgctggtgacctttccctgctcatttttcttggtgggaagatctgtaggcactacttcttatttaccattttttttctgatctgttttttgttttgttttattttgttttacttcaaagcaaaaagtcttgctgaccagtggaaagcttgttgaagtcaattattccttgaagactttttgtacaattcatttgatgaaaattatctctgaaaagagattagtaactttattgtataatttctcccttattgattgcctccaaaccctttctcattttatttatgagcatttttataggaattgcttttatgatagaggaaattgtaacagacaaccccctcacaggtataccacagatatcttgctctgttttattttctggaacagtacgatgagaaagtgtttgctataaaaatatgacactaaagactgaaagcaaaacaatataggacttacttcatttacctttatctgaatagattattatatctaggttcggagaacatgtaataaataaatcgtccaataaaggactcttctgtggaacaaatgctatttgacctgtagaccttcaacacaattttccagatattttataaaaatttacaaatatttaccaagagtcttggcatgttcaaagaaaaaaataggtatgatcaattttcccagttaagagaagtcaaaggtgaatgatcctaggtacaccaagcaaactaccaagacacattcctacttacactcatattattggaaacatccaaaatgaaatctttgattagtaaaattccaaccctgtgtacaggctcaaaaatgcaaactttttttttcagtaattatgcataagatcctaaaacatcacttataaatttacaattgcaataaggccattacacaaaggaatgtaaattaattcatttatcagtggtaagaatgatcaaccttggaatgatggatgggtttcttattgaatcaaagtcataagagcatgctctcccctggcatcctagcatttcttgtccttccccattgcttcccactgaagacattgttattcatctctcctgaacatatacttgctccaggagtatgaggggtgaaaacgtgtgttcaatgtagcactctgtatatccctaccacagatcattttatttctaaatttttatttcctttttttttcctttaattgcatttacaaattttttcctaagggtcaacattttctatagttaaagctaatttttttcttttaaatcctccttttttcaaacaatctgctacaaagatcctttgctcatctgcccttgtatttctacatctagacgaaagtgaagagaataaaattagagttttagtattcagaatgcttttaattgggacaagaaggaagaaacctatatcctgccatggattttttaacttctaaaaaacttcagtggtagtttgaaaaggacttgagccatttcaagaaaaaaagaaactatttcattcaagttaatttatctagctttttctgtattattctttaaatttgcttattaccttagatacatgaacagagaatagtgtgttttctttgtattgctacaaatggtagaatttagattttttaaaactctaatccgtttttttctcagtcgtaggagactacattttaaaaggaaacatttctgaaggtgttatttagtattctttatgctgtaataaggcaaaggaagaacagagagacagagtttcaggtaactggcctttgaaaagtgagagagagaaaggttttctgtgagttcctggactttcctggttaagaaaaaaatcccatctaccgcaatctctagacagaggagcacttccagccttctaagtacttcaaccttcagaatggcctttacatactgtttttgttttatttgtttacaggggtttttttctccattatatcactctctaagaattttgatgaaaataaaatcatcttgaccagatctatttaatactccagaagtcacaaggaagagattctctacactgtccagatatctactgtgtactcttcatgtgtcaagagatctatgggggactgagatgcagagcccctgggacagccgccatcttttgccttcacggagtttacagtattgattttgtgtgtctttccttttatgacaggaagaaaataatataaaccttttaaaaaaattttaaagagattatacaatctcagtgttatgccaagataaacaactaattacacactttaaatgtgtgtgtttttttattctattagaagatgaaaagattcgaaattctcccttctctataattatagaattaagatttctcattataaaatcacattttagagtgtttagaattacttaatagctaagatcttgaatcatctactaacaaatgattttccttttctttccttgagaatatgtaactccaattctccatttcctcaccccttaccagccccgccagaccccatacacactatccactccacccaagtggcattttaattaatggacaaactaaaccacctacacatttaaaacatatgtatgacatgtccataatttttaactcactgattccaattcacagaatccattataaggaaataatcacagaagtgctcaaaatatatatacaagaatatgcattccagtgaaagcaataaaatgttaaaagaaatctaaatgtttggcaagaagataatggtaaaataaacaaagcatggcatattcttgtgctgctttgttatgcaagaattaaagacaaagaatatttaacaagatggaaatttatgccaggtgataaaagcagaatatgacattgcatagagtcaataaccatactcatgtatatgtttatatatttcattgattaaaaatgaaaaaagtacatcaaaatatcacatttatctacaagtaatgggattatggatgattttaatttctttgtaaatataatcaattatagcattaaaaattctacaataattattagttttatgcttacaaaatttttttcttaaaatctaacacatataacctcaaatgtaatataccaacaactaatatattttatagatacttacatgtaataaattccaatagagcaaattttactgaaaaaattatcttaagttgtatttattggaatcattggcaaagaaaagaaagtgtgccacattgtcacagcctcagagaagtttcaaaatcacttatggtttatttaacttatttttatttgtttaactaaaacaaataaacgtagtatgtctctaaagtcttacgatctacaatctgagaaatggaataccatcagtgaagcctatgaatctaagttagtttattgtttatttaggtatatacctcatcaacttataaaagcctcagccatcacaacatttcttacatcagatttattatgattcctaagcctattgtttttaacatccaataatttgagtagccctggacacacagagcctttgaggcatagactctcagaattttgttgtttgaagagttctcagcataagtgctgagaaactaaaatctagaatataaataaactggtgaaaaaaagtaatatgggcagtgatattttgagaagagaagatgagtagctcatctgtttgatgcatgagaggtagtaaagtaagagagttcttttccagcttggttgcatgtggaaatcttctacggcattatgtacaccctcatgtatatgagaatgtcctgtgttgttattctctgccttctgctatctcctgcttgtgatcatcaatttattttgtgatcaacttgtatcatccactctttagagagttaagctatattctggacaaataactgaaaaatcaaacatgagaaaaatgtgagagatgtcagaatgtgcagtgcagaaatgagaaagtttgggggacacaggcataaaaatgaccttcaaatacctaaagaacagatacatggaagagaggttaaaagtatattttttcatggcttcggaagacaaaaattagaaaatgaagaagtttttggaaggtatgtcagtacaatagaaatgaatacgggctggtccagttaaatccagaaggaattcaggcttatttgcatgtgtgtgatgtatgtgggtccacaagggtcttggcaccaactgatttctaggtaagcttttaaatttcagacttaaggagaataggctagggatatattaagaacctaaagagaagtttgaaaaagtcattggaaaaaacataatggtgtagatagcatttccaggatccctcagaaggaaagtgggggaggtgggaggttggaggatcaagttttatgaaaagctccacggagagagtggggttcaggacatggctgcctaggacactacaaagtgataaagggggtcataaaattggagaagtcattctcccactttctgtgcagaaccttctccaacttgaccattctggtttggaaatcagccagaagcacctctttcagtcttgaaattggtgttataagaatgggcaaagccacaggcatcataaggcactatttagacagaccaatccctctcaaacttacataagaatacaaccaacctgaggctcttattaaaatgctgatccaattcagtgggtctgaggtgggacccaagattccacctttcaaatgagctatcacgtaattttgatagtgctagtccaacaaccaccaggtagaagagttttagtagagattattgagatgagaagaaattgacaaggaaaatgctaagtaggagaggaaaaactgggtagatgctgaacagggtccgaaacccacatggtagtttatgaatactctggaaataccctccacacacaatccagacatacccagaaacgctgggagtactccagctatcctaggtattttaagaacatatatataggaaaggaaaataaatttgggttattgatataaatatgactccatctgtatacccaggatggcaaagaagaattgaggttgactaacaaaggaatgcgttaacttggaagataataaatcgcttggaatggaagtattcaagatgaacataagcaacccttacaggaatggtagagggcttgttgaagtgacagccaaggtcctttcttattgtacgtttttctgattttataatggaatcactaaggtgaaaaagagtacattcttttataaagagatatcatggggaactaaaaaaaaaaaaaaaaaattctgaagtccgctaagttaaccagagaatgctactgctgatagaattgcattccaaactggtacaggtctctaagctcaatgtgtatcccatgacctcagactcaagtccatcaagttctggcagattagtgccatttgatgtaaggcaagataataaatagattgatttttaaaaattatcacttctaggtgaaaagaaggaaggaaggaagggaggagacttacagtatgatagacaagatgagaagagttagttaatgtattaaaatggcagcatatcaataataaatttgaccgatttctcctcagaattaaagctaaaaatattctctctaaaactctggctcagaaatggactgcttcaaaattttaatttcagtctcatttgaagctgctaagtcttccagaacagattcacagatgaaaaagaaaggtaataacgctgttcaattacaaatgtggcttctgccttcatagatcaaagttcgactatcttataatactaaaaaaaaaacagtaagaggatttgctctttgggtgagaacagttccaagaatccgccttaaattagcaaacgttcaccaatccctactaagtgagaaacacttgctagggactgggaatgcacagacaagacctggcttacagtcggatagaggttccagccagccaattaaaaaatcatataacatgttaaccacttaaaataagcctataaaaaatatatatatgtcaatatataatatatatgtaatatatacaagggattggtaaatgtttgctaattaaattagctaattaaaggctaatttaattggtaaacatttgctaatttacatatacatattttttagtagtcctgttttaagtggttagcatgttattagattttttaattggctgcctgtaacctctatcaggcaaatgagatgagatgaaagagaaatttattcctccttcctcccctgatgggtgggaatctgaaagagatgttacagaacaggtgatgtttgagctgggcctcaaagaaggagcaagcatttccaggcacagaaaacaaaagcatatatgaaaagcaaagggaagtgaaaagtgtgggcaggaactgggaaaggtgattagactagtgcgtatagcaggaaggtgcaggacaaggctgaagaagtacatctgggccttgactggcgttcccatcagtcgctctagccaagcttcccccgagcacctcctgctgacatctttgaaacatttggtatcatagccatggcctttactgacctcagaacttttattggcaagtttgggctggcactaatttgaggactgttacctctgcatcttgctcaggtatgagattttagaatccaagtagtaaacccaattctgacactctctatgggaagttctttgattttgcttgtttgattttcctataatgtgcgaaattggagatacattgctctattccaaacgtatttggccataaattcttaacatcttgaaaaaataattaggaatacttgttagacctatgttttcttttgtcatatcttcaatcaggaaaccatctcctgctgggcgaattttcagctggagcagaagaatggattttagcaatggagtttaatcagttcccaaaccaacaagttgacagcttctccttaacccttggggacaggtagctgagatgggttgagaggacaaaaatacttattgagaaacctattgattgtttcagaccgggataccctgtggtcatttgtgctcagtgggcgagaagagcttactggaactcttattcaaatcccccacaacacaggttcactcccattggcatccacttcctgtcaacactccatttttgccgacctcactctcatcctcctcatcgagggggacgtgaaaatacattctggccctgaattcacaaaaaaaattcgtgattcagtttaacaagatcaattacacacacacgcgcgcgcgcgcgcacgcacacacacacacacactcaaacctgaaaaatatttcaaggtttcaatagactaaaaaagagcccacattcttcttccttttataagcactccttacagtaatcggagagtttgccaaaaaggcttccagggcccatatttcatctaccccagtggctgtaacatactagagaaaatctgcatccttccctgctgagaattatttgcttggagtgtgctctgcataaaaactatacggtaggaaaaatgccaccctgtctaagctagccagcatgccaccaacctgctgcccaagcttcttgcctggcaagctgctgatcaagagtccatattatttagcttttacgttctgaaacctaatgtgctgtgtcctccctgagtatatcattcactagactcactcttattttctttatgaggtctatttggtttcagaattgtccagatatattcttaagatcaaaatgtctgaactgtcatgtacccagctgtgagccccccaacatcaatgcagtgagctctggattcatttttgaggcaagttgaaagagctgggatatctacttccctaccaaagcctatcatggcagctcacaaaggagacctgggctcgagctcagtaagcttaggttctaggtctacgtatataccagtatgagctccaggtcataagcctccatctgtaaagttggagaattaactcccagcatcatctgactctaacatactacttatatatttttagtcaggtaaattaagggaatataattctatatgacttgaaaatttcaaacatctcctcccctcaaccttacattctcttcaagcaatccattgttgactttaaatccattaaaaaccattgtttttgttttcacccacccccaaaatgatatgtgcgcttttccctcacctttcctgcctgcatttagctggttaattttcataaataaatttccttcctcaaaaattttatagagaaatgtacttcctcaatgaaattcttttttcttgtataatttattttctgtccagaattttttcccataggtagcaggttgggtaaaagttactgtgtgaaattaattgtcaccttttgtaaaactaagtttctgtgtagttcagctatgcagtaatgcataccagaaaaagcatgggctttgaagcccgacaagagccatttggaattgaagttctgccactgtgatcttagagaaaatatggagtccctcactttcctcatagcatattgggaataatagcacccactctgcagggctattttagagtagagataatatagacgactcgtggagcatagtgcctgtcaaaaagtagatattcttattgatgagaaaattgtgtcttttgtttagggaagtagcagggttaaattaagttttcagcaatatcttaggcaagatacaaatacaaaaaaaaaaaaaaaaaaaaggaacatacacttgcacacatcctcctgcctccagccctaagaactgttgctctcagaaccagaaggggcctcaagaaatctggaaagcttggcaagacgcttggtactgtgctccaatgccactagtggaaatgatacaacgcaagttctttgggggcaataagggaaattggtacatatcttctatcccaaatatttaccctgtgacgagaagtcaaataatgccagatgtatatgaagaaagttgcagccatccaggattgagaactcagatctttccagttgttggtgagtagcccactgaggaaaaggcctcttttccaatttctttacaaatgcaagccaagtactaaattttgctgttgtcaaatggcatgggcacaaataaatacgcacagcatggcttctctgtgccaactggtatgtagatgtaatcatttccacagcatgccctccctcagcccaagggtatcaagcaaaatgtagcaactgagagacaggaaggctatggagcagtccaaagggaaagaaagagacatgcgggaacagagtcatccaggagtgctcctttcaacctcacatggagccattctagagttatcatcgaaccgatgagacagtaggtaagtcattggtagaatgccctgagcagaaaccactaaactaggagtccaatccttggatcagatatttccaatcctcacagtaccctaagacacccaagacatacaacattctctcatggaaacagtgactaggaaaaggaggggtcagggaccaccagtcagtgggagtcactgtggagttcaaggcaggtccccacataattcaagtttaccccagtcttggttccaatctttactaactaggagaacttaggcaaatcacttaactgttctgaagcttagtttacataattgtaaactagacaaagtattctcataccgttttgaacattaaatatgatcatggaaaagcacagatgcatttcataaactgtgaaacaccttgtacccacaaataaacagatttctcacttttcttcatcaggtgaggacccaaatgcacacacacttacacacagacacagacacacacacgtggctaaagaaatcaaggttttgttgttttcttagggtggccttcctggacaaccaaggagagcaagtcagtggcgtcttctctcctagatccagggaccacagaacaatctttctggattatgacatttgcagcaagcacttaatatattagaaataaaaccaatttctatatcaaacctggcatatctcccttcctttcccctctgtttacgttgggataatcaaagtgtcactcattattcaattaaatcaaataaacatcaaccatgtaacagctataagccaggtcccctgctagaggttatggtagataaagatagaaataacatggtctttgtcctctgtttgttcatgttcatgttcatgttgacatgaaagcaactaataacaaggcaaaagtgaagtcagtaccaaatggactacaagagcacagaggggggtatcatcttttttctgatgagacaacagaaagtaaaaatttaagcaagccaaatatgctttttgtgaacagctctggatgggatttctgatcaggggattacaatgtttgctaaaattacacgttttgatgcttggtatctgaatgccagtgtaaactgctactaatacagatttggggggtgatgcctcaaggtcaactgaatttcttcataatcctgtaaatataatgccctaaaaattgcgattgctcttttgttttgtacatagtccctggtgtttactttgtttgtattctgttttttatccagatgtattggttttgttttgcagaaagagcaaggctctatgaatgaaggaaaccagacttccattagtttctttcatacgtttgcctacagtagaatgctgtcctccttaggtgtaaagaacataaacgagtcactgcagtgcagattcagcagaaggaggagaggctgtaagaaaatcagccagagaccaaggaagtccaataacttcaccaacttcacctctctctcggctattattccctgttggattttttcatggtgcatcagagctgagcccttctttgacagccccttacaggagcctcagaagtaatcatgactagttgccaaaactgcatgtttcaaaaagtaattagtttatggagcctccaaaaacatgctcgactgtataatcaattttaagactaggttatcacaggatgtgacagaaggttaattaaatgtgaaaacacaccatatcttgaactagattgagatgacatgacattatgaggctccgtggtttaagttccttttttccatattttctttagagttggtaatagcaaaaattagtgaaatttgctaatactttccatagaaatatacatagggcatacaacccagtagcaaatgcggaacaatctcttagataaaaaaaaaaatcccacatgaaactgaatgaaaaactaataaaatccctattaaaataaggctggtatgtgcagaaaggcagttaggcctgtttctatttatatcaacataggaaaaacataatttagatgaatatctaaatattaatttacaattgtcatgcacatacctatattttgtgaatgtattttgaaaatccttccaataccagcgaatgctacagataaactagacaagaagaagatgaagaggaggagcagagagaagaggaggaaggagaagggggaaagtgattcacttatttaggtgttcatttatattttttctcatgtgaataatacaagtagaggtaataaactgacttcaatgctgcaaagctttattcttctctttaaactttaaaaaatcatttttcatcagtattataaaataattatatagcatcttccttgttaaaggactatattaggaaaaaattagcttcgtagcaaggagaaagttgcttttaaacatttccatttactatatattatgtgtgtatacaatgattgtaaaattaatttatttttgtgattaggtagcataatcacatagtttaaaaaccgaaagtgtaagagaccatacattttaaaagtctctatcccctatttgtgatccatcagtacccttccatagagcagccattttgtcatgttttactgcattcttccagagatactttatgaaaacattaataagaagcaaatagggtacagactactgtcatagtcctgtacctttgctctgtctacttaacaagcttgggaaatagtccatatagcacattaaaagctttgttatgtttcaaatatataggatttcattttatagatgtgccatcatttagttagtacttaggttgtgtctaatcttttgcttttatagatgattctatgatgtattactttacataatcatctttcacatgtcccaggatatctgaggtaaatttctggaagtagaattgctggatcaaaatatgtatatctgtaattttgacagatgttgccaaattgtccttgataaatattataccaattctcatacttgtattatgagtacctgttccccttgcaactgagtcaatagagtgtgttataaaattttctcatctttgaaaatttgtggatttaaaaatggtatattgatgtttaatttttagtttgcttttttcttattaagactgagattgagcatatttccatatgtttaatagccacttgaatgttttctgttttgaaattatttttctatattaaaaatttaaaaatgagaacctaataagttcaggctgttactgccttttaaaaattaaacaagaaacattagtgtcaaacactaatgcttttcagaaagcaatacagattctaggttttttcttaaaaactgagcaaatacataaaggaaaaatctctattttcagaaaataaactttttttaaaaagtcatattttttcaagtactttgttactaggtgtctagattatcccaaagggtatttaggtaataaaatattgaaaagaaaaacacaaaatacattcaaaaggaaaagggcatgaacaaatacaaatggaaacaaataatgggcaaaacagttattagatgtcatgtttctaaactttaaaaacctaataccatgaactgcaatttttcccaagatcccaaggttaggattaaagggttaaaagtaaattgatagctagcttgttgggtaaaattagataaatagatgatattagaaagatgagacagtccctgttgacccacattctgtagcttcttatttcctcagattgctctttgctctgacagtgctgcaatgcataaagtctacaaaattttctcacggctgctataatgactgccatttttaacacaaattaaatgctcaccaagaataagtaaatgattaaatgcttcataacctgacccagtaagtggttggaggtttcaatgccaatcaccaatgtatcatctcaatcttttgaaataattagcatatgttatttatttcatggtctcatcagtgattaattttccaggcagtcaattaattatctactaccaaaattaacagtaaatatttttcaacgcttttttttctgctcttcaggatcaaatcatattccttaagtatacaccctatatttgggcatagttaaaattaaaaattaaatactccattcaaagactctgtcactatccaagagaatctataaggaaaatttcagctgggtagacatttgcatgtctttttctctcagaaatggactaactgtaggcattttggatataaattaaatatcgacaggaattagtcatcattagagtaagaaggaataagttaaacgctacatatacatgccaatttgtttgtttgttgtttgtttatttagagaatgggccttgctctgtcacccaggctgaagtgcagtggtgctatcatagctccctgcagcctccaactcctgggctcaaacggtcctcccacctcagcctcctcagtagctaggtgtgctccaccatgtccagttaatttttaaacaaattttggtagaggtggtgtctcactgcattgcccaggctgatgtcgaactcctggcctcaagcaatcctctcacctcagcctccctaagtgctggggttacaggcatgagcactatgcctggcctatactaattatttttaaacaaaaagtatcacatgctcatgctcactgttaaagatttttaaaatacagaagagtgtaaatatgagacgtattactactaaccaaatacaactgctatttattatcagcttaaaaatctacatgctaggatatgcttggaagagctataatcatttaattaaaaaagaaaatgaacgattcctattgtattcctttgcacagataacaagtccatagagaggtttagcaattcacccaatatcacatagctagtagcataggagtcagatatctattttgatatatagtttgtaatataataaataaaattttatcttatattttgtacttaacattgtctcaggggcatttctccaattaacaaatatagttggaaaatataattttaataaaacatataaaatactatattttattatgtaggttatttttagttttattgctatcataatacactataccgaatactataattaaacacttatatgtaaattttattcatttttctgattattttcctaggacaatttcacaggtgtgaaattatcatgccaaaggattaaatatatcaaattattgttaaaagtacagcaatttctactcccatcagtacagtatagaagtatctattttcctctgtccttgacaacaacagaagcatacaaatatccttttgaggcacaagaaaaatactaacagttttctaacttgcttattagtagggatatcatttatttgaaatttttacaagataattgcagattcacatgcaactgtaagaaataatgtagagagaacccgtgtatactttacgtagtttcccccaatggtaatattttgcaaaactattacagtcttactaccaagatattaacatttatataattcacagacctcagtttgacttgtactctgtgtgtgtgcatgtgtgtgtgtgtgtgtgtgtgtgtgtttagttatatacaattttatcatatgtagaggttcatgtggaggccaccacaatcaaaatgagttttgtcacaggtatcttttatgttgcccttttataaacatactctcctttccttttcccaccctaccaactgatctctaacctctggaaaccactaatctgttttccacttctaaaattttgtcatttaaaaaacattacatgaacgtgattatacagtaaataacctttggtgactggcttttttcactcagtataattccctggagattcatccatgttgttagatatcaatagtttgtttctttttattgttgagtagtatttcatggtatgaatgtaacacagtttgttaaaccattctcctgttttaggatatttaggctgtttctacttcagagctattttagataaagctgctatgaacaatcatatacaggttcttgtgggaatacacttttgtttttctggaataaaactcaagagcataacataaataaaaactgccaaattgttttttccagagaggctatacaatttttcattccaaccaaaggaatacacacacacacacacacacacacacacacacacacacacacacagacatatatgtatatatatattagtgtgtgtgtgtatatatatatatactatttttcattccaaccaaagtttcatatatatacataaatatacaaagtaaattcggggcagcaaatagatggaggacactgtgagcctgtgatttcattatagatttaatgtatatatagcaaatatatacattaaaaaagtatatatacatttatgtatatatacacataaatatatacataaatacatatatacacatatatacataaatatatactttttactataaaagttgacgcaaaagtaattgtggtttttaccattactttctacatagatattaatatatatacacacacacacatacacaatcctatcggttccgtttctctggagaaccctgactaatataggtatggagaatattcttattatttttattggccactgaatgcagagctaagaaccagaggctgagactgtttttgccaccaatttactgtgtgatcttgagcaaaccatttcctctctctggaacatggtttctgtaaactacaaagtttctaataatgtttaattttaactttatatgaatataagataaaacagactatcatgactgactatgaggtttagaatctaggaagaatctgtaaattatttatcttctgaaagacaaagaattaatttgcttaatgagtaggaaatgctatttttggagaacaaggtaacatgtgggccctagagcatatcatgttctccaaaagtaacccactgaacacagcaagttgatttacttcatctgagacaaactccagaaagtttttcccttgtcctgcattactgcagaaatcacctaatcaccaccatgactgatcctatatttatttatgaaaactttttctctaaagagtttaaaatgttggggagatattactagttaggcttcagaaaagcctcataaaatagaaaaaggaaaccagcgatctcaagaatgcaaacttctgcatctgcaaaaatgggctcagaagtcagatgaaaacagattctagattggacttttgattgtttgtgctgctggggctgagtaagcaataaaaactaacttccctgcattatttggctcccagacttcaagtgactgctggaaagagtgtgccaataaacttctttattggatctttgagcatcatcccaattcatgaatacaaaaaagtacaaaggcaaatgatgataagagaaaatactacaaacagaatgttgcagagacttcacggtctctaaggtagtctcatctccattcctacctcagaaccacgtggagtgcctgttcaaagcacagatttctgggatctgtccgcgactatttcaagcacaatctgcgaggatataacacaagaacacgtatttttaacacgctccctaggtaatccttattagcaacttagtgccagcctgagatagtctggatgagctccggcccaaatcgcatgttgaactggaatccccggtatcagaagtggggcccagtgggaggtgattggatcatggggtggatttcttatgaatggtttcacaccatccccttggtgctgtcctcgtgatagtgagtgagtgctcaagaaatctgcttatttaaaagtgtggggtacctccctgcccgcctctcttgctcctgctctggccatgtgatgcgcctggtccctctttggcttctgccatcattgtaagtttcctggggcctccccagaagccaagcagatgccaacatcgtgcttcctgtacagcctgcaaaaccatgagccaattaaatctcttttctttataaattaccaagtctcaggtatttctttatagcaatgcgagaacagcctaacacacagcccatggcctgctatttgggaattattaatatagagaaatgctttcattttatagatacggaaatcagggctaaaaaaaaaaaattacccagggtcatgcccctgatacctaacaaaggctgaactagaactcttccacgcttcctgtgctcttaacgctgtgtgacacattgttgctataaaaaaattcaatttttttttttttttttagatggagtcttgctctgtcgcccaggctggagtgcagtggcgcgatctcggctcactgcaagctctgtctcccaggttcaccccattctcctgcctcagcctcccgagtagctgggactacaggcgcccgccaccacgcccggctaattttttttttttgtatttttagtagagacggggtttcaccatgttagccaggatggcctcaatctcctgacctcgagatctgcccgcctcgacctcccaaagtgctgggattacaggcatgagccaccgcgcccggcccacttttttttttcttagaaaaactatattatggcctagtctggttccaaacttcttcactcttcttccccccaacagctgaggctaaagctatgtttcacatctgcaggcacttccaattctggctttccccccaaattttgcctcataacacaatttactaaactgtctccggttccatattctggagttcaaacgtatcaagtccttgccagcagcttattccttatctctttctccagttcctgagccattgccactttttttgcctttgttcttatgagaaggatctttttttgctaacctgcttcagagttcagtgtcctccatctatttgctggcccgaatttgcttttcacttcccctttcatagagaagagtcctattcctaaacttcaggctagacactaggtcctacgactctgatgccagtgtctggatatttgagactaactgtgtcctcacactcctctagcatccatcacgacatctagcccaactactggaacgtaatgtcacttcatccagtatagcactcctggcttcccacagcaactgtttaactataactgaaaatcttgctaacatcatttgttcaccacattgagccctcatttgcagccacacctggataattttcctaactccttgtaccacaccagtgggcaagtttagcacctggatgttttggtctacataattcctccacattcttgctgaaagtaagtggccttgtctatttaaagtggagctctaaaaaatggcatgccacttcacacactgtgatttaacttcctctctccattactagacatgacacattgaaggcaggtggcataccccattatagttatcattgtatttctgcatataaggcagtggaatggaaactggaaggctaaagacagagcaaatgggttttgcaatatgtgatatactataaacctagaaaaattatttggccatttaaagcatggtcaggaatagtttgtgggtgctgcctggggtcttcacatgctagtgggggaagctcatcaatgagtagagccctaaactcctgggagtccagctccagcagcaatatctactccttttacatattagtaaatcactgaactgctccatttcagcttccatgttacaaaagaacccaactcatagttctctcaggagagcaacgcaaacaaattagccaacagttgccaaatcatctaaaaatgaactgagctaaatagctttacacatgcattttctcctggaattccatattacacttacgatgtggtacatggagctccttccccccatctaatccaaggcaaatgagaagtgtgactttcctaagagagggtgagtagtaattgaaaaccagagcatggaattcaacacccactgaaatttttattttaacttgatatacatattttacttattaaaccatagcatagcaattttgcttatctgtagagaaaaagaaatgattttgactaaaaaaaaccactgccagaaagtaaaaatgcattaatcatctcattttaaccactgcactcactttttcccccagtaagtaaagacttacaaaattttgttgacatcaagcttcaaatgccaagcaggtaaaatgacaactaaatattgctaattctactgtgagagagcaggcataatgtgcttaatgctttggttgatgcacagttaatgctcagtaatggttagatatatttcccaacactagaaaatggagttttaaattcgcagatatttgtagagcactttaaatgtgataaatgtattcttaatttgattctggttcattaattcttatcgaaactctcagaggtaaaaatcatcatccccattttacaatgaagtaaataaaggtttgaaggtgtatttgtttcctagggtcatcataacaaagtagcacaaaggggcaccttaaaacaacagaaatgcattttctcatggttatagaagccagaactctgaaatcaacgtgctgcaggggtggttccttctagaagctctgggggggaatctattccatgcctctctcctagcttccggtggttgcaggcaatacttggtgttcttggctcatcgatgcatcaattcagcctctgctttcatccccactttggcatttttctctgtgtgccctctcctttttgctttgttttgttttgttgtgttgtgtttgtttgttgaggcagagtctcgccctgttgcccaggctggagtgcagaggcatgatctcggctcactgcaacttccacctcccaggttcaagcagttctcttgcctcagcctcccgagtagctgggattacaggtgcacatgaccatgcccagctagtttttgtatttttagtagagacaaggtttcatcatgttggtcaggctggttttgaattcctgacctcaagtgatccgcctgcctctgcctcccaaagtgttgggattacaggtgtgagccctcgcgcccggcctctcctcgtcttatcaatcattggatttgggaccccctttaagctaatatggcttcatcttaattcaggatcctatttccaaataagatcgcatccttaggttcttggcggacattaatttgggaaaacacgattcatcactacggaagagttaaaagattcccccaaatcacacaagtaataggatgtggagccaagaccacaacaaaagtatattcaacccttatccaattcactccatttttctataacattatgctgcccaagtcagagaagttaggatgtgctgctgtagcactggagtcattccgtatcaccctgcaaaagcccccgcttcattcaacttcttttaatttacaataatcagcacaggattaactatctgtgacagtcctatatggaggctcaactcccttcagccaacagctgaaagtttagggtttttgttgctcatgatacccgaactggacacctggccatcattttcagtaacctctctcacatctcaacaacccttcatgcgcctttatgttaaaccaaggtgaattagacaggtgcctgcatctcctccacctttttataactgtatatcgttgttgcttctcctgaaatccctgtctgctcaggtcatatctgcatgctcaaaatccatttaggtctaaattcattcctaaaggcccagtgcagatataaatctgtctcctcaattaccatagcactacctctttgcttcaaaggatacgaaacaaaatgtaattttcatcatactttattcttccttcctttttctttcttttttccttttttctctctttcatctttttcttcctgtatacacatgatgcctacacacgtagattcatatacacatgcgcacatacacgtacgtccagtcagccctcatattcatgggttctacatccatggattcaaccaaatgcagatcgaaaatatccaaaaaataaaattaaaatgtaatacaataagaataaaattaaatttaaaaataatacagtataacaattatctacatagcatttacattgtattagaaattaaaagtaacttagacatgatttaaattatacagggaggatgtgcataggttatatgcaaatactacaccattttacataaaggacttgcgcatccatggattttggtatccacaggatgtcctcatggatactgagggatgactatatatacatatatgcacacacattcacatccacctaattccaaaagaagaaaccgacatctgagagaggaagccccataccttactatctctcaagagtgtatactgcagtatactttgttccaagaaggtgtacaataaatcactaataaatgaataaattactttatatatttaaatgactttatagaaacttaaattacttaaaattaattagctaaattaattaatttatatatttaagaagaaaataactgtgagtgtttaaaaagaataactgattttaggtataagttcacaatagggatgagaataattttttttcttttttgcaacagagtctcactctgtttcccaggctggagtgcagtggcatgatctccactcactgcaacctctgcctcccaggttcaagcgattctcccgcctcagcctcctgagtagctgggattacaggcgcgtgccaccacacacggctgatttttgtatttttactggagacgggtttttgccatgttggccaagctggtctcgaactcctgacctcaagtgatccacccacctcggcctcccaaagtgctggggttacaggcatgagccaccacgcctgacggagaataatttttaaaatactatgatctattactataatcacataataattgtaagacattcttacagttttaaaagatagagctataacatgatttagaatcacttgtcccccgtgttagtgtttagaatgttttaatttttttcaagtacctctttactcataactcttcttgctttaggccaacctgattgtgttttaaaaatcactgaaatccctacatatacacatgtacattttgatgctagaattgatacatatatatggtattgcatatatcacagagaattactgtttaacttaagtacaacctggtaaagctttgttgattttgctacgtcactttacaatacttaataacttgtcattaaaccctgtactataccagcacctaaaagtgcttgaccgtagtaagtttttataatgcttatgacttggcctgacaccgtgtatacattaatccagaaaccagagaaaacaatcagttatttgatatcacttcaaccaatagatggtttaaaatcttgctgtacatttttttctttctgttctttttttacgtgtggggagggagtttattggaagtagaggtccatccttttagtatatgttagtgctatagaggtggtttctcttctgaagttctatggagaagtctggataagatgtagaactgattctcttttaattgatggaatcatataatctcatgatcagaccttaaagatcgtttggtcatcaagtcttaattgatgatgtctgtatcaaagtacacaatatatgttgtctcaagcacctcaaagatagaaatcaggtgtctctctcttcacaaatacaaccaattgacactagctacccgaaacactgcactgaggaagattctgagactgagacagggagctggaggataaatggcatatgtgttcttccaataaatatttatagaatagaaatccttgatgtactgagacctttctgctcaaatacaatcatgtaatgtatagaaactcaccttatatgttatataactaggaagacactagatcaccctagattgtcagttctgaatatttggatactttgatccatagctaccctgttctatgtggtagccactagtcaaatgtttgaaattaaataaaagttgaaatttatttccttggttttatttcaagttccacattttgagggttcaaatgccacatgtggccactatattagacagcccagacagaggacatttccatcgctgcagaaagttctctgaacaaatttcaacaaccactataaactaccaccatttcatcatgttgaaatctgcacaagtcaattcttaacaaatagtttcataaatctcttccaaggtgtcatgctacatctttacttcttttctccttcatgagtcaaggatatgacagtgtctagtcccctgaaaatgggtgtgggtacatgtgtatgtatcagaattggtgcagagtttgaggaagagtcatagctattggctactctgcctgctgaatccttctgtgccatgaggtaacctagccatactggtcagcagaggtgacttcaggggacttctccctgatgactcaggcactcaggagagcaacagcgatgttatcagagaggacaattccaaaatgctatatgtgtatcatactaaattaaaagcagaaatggaaacaaggatacagtcagtgtggccagggtactaagaaaggccatgagaggagaagggcaatggcaatgaagagagtgttaactactgattagggaggtgggagaagggaggtgataggaagccaaagagctatgggcctgcacagaattacctgacaatccaccttagcctgattatcataggctgtcagctcagccaagtgagggatgactgagaacacagctgataaatagatgtttcctttattcttccttttatagcgtctctccctcgctcctatttctttggataaggcaatggaaatcttgcggaatgctgacaatgcttttggctggttttataatgacacttcagtgatgccaagcttctatggccctcttctcaggacgcccagaatagccatgttctgcacctctcctctggccaccgacgtgcaggccgcctggcatttctttcagtgctttcactcatatttcctttcagcttaaattatgaccataagctctaggaggacaaaatttgtatcatatttgtggcccctgacagttattagcatggtgccccaaacatctataggcaatatggcattgacattgcattcaggcactaaagtacatttgcctgggttcaaatttcacctctgccacttaccaaatgtgcctttcagaaggtagacctctctgcattcagcttcattttccttctctgttaaatggaccataggctctgtgctaagagctgtatttttaggaagtcttgtcaaagtttgtggtgtttagcttcttttgagagtaaagattataggacgccagaactggaagggatcttttgagtcacagaatagaattcttttcctaagtaataaaaatcttcagataaaagtgtaaaaggaaacaatatatataagaaaaaataataaatgagggttcttgggcatataagtctttaatatttgttggaaagtacttaactgttggtagaaattttgaagcatctgttctaagccttaaattccaaaaagcacaatttgaaaatcaagtataatcgtccaatttagcaagaaacctgaaatgcagaaagaaaagaaacttgctaagaaggggaaaagctgagtctctaaagaggtggcttgcctccaggccagtgttctttctattcatattataacatgctggctggctttcacattattgcaagtgagccttaaatggcatgacatctaaaaatggtaagccttgccaaagctatgtgtgtgtgtgtttgtgtgtgtctatatatgtgtgtgtatatatgtacatatataaataatagcagagtaacttagggcctgtctcaagtgactcttatctaaactataatgctgaccaacataaaaggtcaattacaactattagtgaattattgaatacaacttattgttcttccttccattagacatagccttagtgacaaaaaaattataaacaaggattaagttactaaatcacttggtcttagttggaaaaagattctttcttttgattctttttatagcaatgatgatgttacttaaatactactcaattgtgtaaagctttaagagaaggaggcagtatctgtgtacctaatgactctgcggggaagagggaaagatttcattaaaatgttacctgtagcttcatgcactctgcaaacaaagtcaaatgccagcttgtttcaaaattactgccattatatcctaacagtaaagcactcactggcaaatactagaggaaataataaacaatgatagctcttagcaattgaataatacattttatccacggatttgaaagttctttagaagcattaactaattaagtttcaccacatgcccacaaggtaggtattagttctctgttttatagatgtgctcatttagcatgagttacagcccacatttgtgggagtattggatgggaaaaatcccacggatcagattcactaggctgtgcagtaataacatggcagtgtcccaaatgattcccaggaggcattgaagaattaatgcacatccaaaacacctaatttaatagaaacttccgaaccaaggcaaactgaaccctaaaagatgtagaaattcacttctggctttccctgcatttaatgcttttgcactacaaaggaaacaatcagcaaaataaaatggaaacctatgaattgggaaaaaaatatttgcaaaccatacatctgataagggatcagtatccaagatttataaagaactcataccattcaatagtagaaaaacaaataacctgattttaaaacgggcagaggacttgaatagacatttctccaaagaagacagaaaaatgaccaataggtatataaaaaggtgctcagcgtcattaataatccgggaaatgtaactcaaaaccacaatgagatatcacctcacacctatgaggatggctattaccaaagagttaagagatagcaaacgttgacaaggatgtgaagaaaagagaagccttttacactattggtggaaatgtggattaacgtaaccattatcgaaagcagtatggagatttccaaataaattcaaaatagaattaccacaagacccagcaatccctcctctgggcatacgcccccaaaaatgaactcaccaccttgtaaacatatctgaactccacattcattgtaacgttattcacaatagccaagatatggaaacaatgtaagtgtccatcatcaacaaatagataaggaaacggtggtatacacagtctgccctccatgagttccacatctgtggattcaactaaccacagatgggaaacatttgagacaaaaactgcatctgtactgaacatgtacaggcttttttctcatcattattccctatataatgcagaaaaacaacttttataaaatttacattgtattagatattacaagtaatgtagatcttatgtcagagaattgaacatctgtggatttggtattcttgggaggtcctgaaaccaaacccctatagacactaaggtaggactgtatatacaatgaagtgttattcagccttagaaaagaaaaagatcctgccatttgccacaaaatggataaacctggaggccagtaagtgaaataggccaaacacagaaagaaaaatattgcctaatctcacttatatgtagaattaaaaaaaaaaagtgaaatatacagagatgagaataaaacagaggttaccaggggcacgggatgggaatgggggaaggaaatgggggatgtaggtcataggttgtgaggtagcagatctggaggatgtggtacaacatgaggactacagctaataaatgtgtgctgtatttgctgaatgggcagattttagctgctcttgacattaacaaacaaaaaaccatgggcaacgatgtgcaatgatggatatgtaaatctgatttgctctaggaaccatgttactatctatatgtatccataacatcatgttgtatatatcaaatatggacaataaattatattttaaatttaaagaaataaaaataaaagagtgaaataaaataaaatagaagccaaaagcttgccgggagaatgtttttcacaggctaattttatatatcacatataagtaaagatgaactccaacagaggtaggttattcagagccattaaatcacaaaatattagcaaaagaaagctgctaagaggtcatagaatggtacctccgttattttataggaggaaaagtgaggttcagaggataacatggcctgccagtgtccacacagtcagcccaatcttacataaaatgtgttaaaaacttgagtaaataaataaaaattttggttggtaaaagttcatttttctatatacaatttgctctaaattagtgtttggcaaattgtgacccatgggccaattttggactgtagcccatttttgtataggctgagagttaaaaccccttttttttgtttgtttgtttgtttgtttgtttgtttgtgtgagacagggtcttactctgttgcccaggttggagtgcagtgtcccgatcatggctcactgccccctcaatctcctggccttcagagatcctcatacctcagcctcccaaatagctgggaccacaggtacatgccaccatgcccagctagtttgttttatttttttgtagagacagaggctgtgttgcccaggatggtctcaatgatccacctgcctcagcctcccaaaatactgggactacagttgtgagccatagtgcctggcctttcacttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcacctgccactacgcccgcctaattttttgtatttttagtagagacggggtttcaccgttttagccgggatggtctcgatctcctgacctcgtgatccgcccgcctcggcctcccaaagtgctgggattacaggcgtgagccaccgcgcccggcctttttttttttttttttgagacagagtttcactcttgttgcacaggctggagtgcaatggtgcaatctcggctcatcacaacctctgtctcccgggttccagcgattctcctgcctcagcctcctgagtagctgggattacaggcatgcaccaccatgcccaactaattttttgtatttttagtagagacggggtttctccacgttggtcaggctggtcttgaactcccgacctcaggtgatccaccctccttggcctcccaaaatgctgggattacaggcgtgagccacagtgcctggccggcctttcacatttttatatggttgaaaagaaaacgtttttgattaatgaaaattatataaaattcaaatttccatgctcctaaataaaaagtgttattgaaacacagctatgaccatttgtttgctgactgtctacagcagccttcatgctacaatgacagtgagtagtggcaacagagaccacagcattcaaaagcctgaaatatttctatctgattcttcacagaaaacatttgctcaccccttctctaaatgacgtctgtgaagagatgtttaatatgttgatgtgtgtctgcaaacagcgtatcttttgtttataaattagacatacccagaacttgatttatatccttctgtgttttggttatacatccatgggcttatcaaactgtttcatcaaggataccaaatgtctgagaatttttcctaatttctcaatagtcgacacctccttttcaaaccatatttacgtcagtctttactgtctgtctcaaacactttcacatccattattccattaatctctcacatgaggagcccatggaaataattactattgctgcattacagagagggaaaccaggctccgagaattcgaaacactttcctaagagcactgttcagtcagcaagagattcctgccctgaccccagaacccaagtgctcctaagagaacagcactccacttgaaagatacaagataatcacagctgagattagagaagccaaaacataataaaggataatattataaaaacaatgacagtcctttcctgtgcatggttatctctggaaacataatcaggaataacttttgtctctggccaaagaagaagttaggaaagacttactattcttttgtttaaaatttataccatgcacatatattacttattcaacaaataaggttttcaaaagttgccaaactaagatgatcaagtgaaagcaactcccaccagtaagaattgcctctctctcaggaaagatttcacatagctccaatggttctcaaggaaaagagaatttccaattaaatgttaatcggaggtcagcatagcccttgccatgaaatccgttttgatgggccatttacttgtagcccaaagaaaatgatgaagcacatcactgctctttgacgccgtgccagctctggcaggaacctgatgaggagcttcatggggagtcctgcccaatccatctggagtcctactctttatttctttcctttgattcctttttactactaaatgctctgacttacagtaagatcacctatcaattacgttttcttaccagcagcaaattacctggctgtatattcacaatcattaagtgtttcttcatggaatgatattgcacaagagagttttctgcacatagctggcagacatgattttttaaaaataattcagacttggagttaaaatatcagagaaattctttactattctaagcttctgaaaacagtggtggatcatttagaatggatggatggatagatagataaatttagaatatatatccatttatctatctctagctagctagttagaatatcactaattgatcctgacatggagaattacaaaatttttaaaaaattatgattggatgaactattacagatcatctagtccaactgtcttaatcagtgaggaaactaccaccaaaggggattttgtccaatgtgaatcttgaaagtaaagattacatacacagtgaatgtatctgcaatctggccccaatctaccattttaatcttaccaccatgagctctctccttcatgcaaattatactttctgtccctcattctactcccaaaccagccatgttgtattacactatttttccttgttcttttaaataatatgaatgtcctttccttttaattttcatattctgatcctgtccactcttcaaggctctgcttccttgaattcttaatgaactttattagtgtccatttccagtggcacttatttttatacattcatcattctggtttttactgttttatatcagtatataaattataaatagtatatacattttttaaaccacagaaaagactatcaaataagggaaacttcttggcatctgaattttggtgaaacaatacaaatgaaaaaacagttgaactcatatactgtggtaaatcacctcagtgagttctcacaaaataaatgggtcttgatttatcggaagttttcttgttctgaaatcactgacaccccacttgaagagtaaaccaagtgacttcagaacttacaaagctaaaaaacctaaaggaccttctaggctgaacttccagccttacacataaaatatgaaggtctaaaaaagataaagcgacttacgcagcattaagactcgggtcttctggctctttgtgcccatacatccccgtttgatcatattgcttccctaacaattttttttagttggtgatgtccactgctaaaatgtaaatacatgttttgctgctttgctattgttatcatgtccatacatttttagaacaaaccataacttcattcaataacttagtctgaacatacctttggagtcctggattcttgtatgaattctttcagattttcagatctggccttcagcaagttgaggggaagcaaagtccaagtcacccagccctctctccagccactctaggctaaaacccctgttgtcgtatatttgtgcacctgttttctggatcacctcataagtttatgttcactcctattttattgcatgatggtttcatcatgattcaccaacaacaaagttaatttttgttgaatcattgattcaacaaatgttaccaaatgtcagttgctgtctcacacctaggacactgttgttacttctattattaaaaataatatgaataagaattatcattaagtaaatacttattgtacgtcaggtactataataggctctttacacacatcttctcagttagagttaaaggtctcacccaagctgtgggactgcaagtaagaatcaggatttaaacacaagtctgccatcatctgaagcctacgtcagcagagaagagcctttgcccttcaagggctcatgtctagtgttacagatcgctatcatgatgattaaattcacagggttcaagctattattcagataagtacaggtgtcgttgagcatggtggaaggaaacctaactcttctagggtagttagccaaatctttgagaaatatatgacatttgggcagaatcttaaaaaaatgactataagtttgttaagtagatgggagaaagagggctttgtgggtgaaggaaaccttatgggaaaaggcacacagtttttaaaaagtagcatatttcggggaataaaagcagtttggcatgactggaacatggctcctgctgaagccaaagaagcttggggcttgcaggccaagtaatgaagttgggatctcacctgtaagaaataatccccaaaggcttcgtaacaaagcagttgacatggtcaactattagatttagaaagctcacagcggtgtgaggtatgaattaaataagacttgggtggggtgaggcaagttaggaggatatcataacagcacaacagagagaaaagaagtaattaagatagtgatggtggaaataaaaacatattaaataaatgtttaggacacttaatcaactggaccttatgaccagttccatattaatagctgaagaaagaaaagaatttaagatgatgctcagatttctggcttaggtagtaagaagaatttttattccactaaagagggcaggtagaagcaaagttggtgaagaaagataatgagtccagtttcagaactgctgacttcggtgtacatgtggaacattcacatagagatgtcaagatgacagcccataccagaatggagcatcagatatgtctaggggagagattccaagtaggcagtcatcagagtacaggtggtaattaaagtcaaatgtttgttctacaaatatttactgaatgcctattctgtgccagaaactgttttagatgctgaggatacagcagttgacaaaacaggtaaaaaaaaaaaaaaaaaaaaaaaaaaaagtctagctttcttggaaccaacattctagtgaaggttacactttagagcatacaagcaaatccacgataacaaatttacgttaagttccagaaaggaaaggcgtagagtgctattaaaaaggaatagcaggggccatgtaatctagactgagttggggagtaggagatggtcagagcctctctgaaatatgggcatttaaactgaaacgaaagcctgataaagggttagctaagaaaaatcaccccaagtgggaacagcatatgtgaagaccccaaaacgagaaacagttttgtattcaagatactgaaaaggtcagtgtggttgggacatctcacatgtacccaggatgagaggtagaaaggggttagttcaaagagatctacttatgcagagaaaatgtataacttgagacacaatatcaatcaatcaatcaatcaatcatcagagtgtggaatgcaggaagtcaacgtttaataaaagaggcaggggaagtaaagcctacaaaagaaacctagattttgaccatttccagcacagtatggtatctactaatgagcccctttctcccaattaatataaatatatgagtcattatatatggctaatttgtccaccagaaatgttctcttctggggagtaggaagaggaatccacaaaacactttgatgaaactaaagaactcatggaatgaataaacaaaatgtgaaatagccatataagagaatactgtttaggtatgcaaaagaatgaaatactgatatgtactgcaagaatgacccttgaaagcaccacgttcagttaaagcagctagattcaaaaggccacatattgtatgattccaataatatgaaatgttcatagtaggcaaatcgttagagacaaagtagattaatggctgccaggtgctagggagaggggaaaatggggaatgactgctgaatgggtacaggttctcttttgcagtgctgaaagtgttctggaatttgataatggtggtagatgcacaactctacgaatatactgaaaaccagtacgttgtatgttttaaatgggtaaactttacggtatgtaaattatacatcaataaagttttttttaaatgtcatgggagacctccttgcatcctgttagtgtcaatatatgacacactaacatagagatagatctagagagcttgcttaggtaggattttaccagaattaattttgaaaaccgatattgtcttcaacgagttgtggctaaatgagttatgtctgtatttaacaatgactttggaaattcagtttcataagattaattttttacttggaaagaaactgaaaacgctttcagtaatccatcacaaatacatgaagatgacaagatccatgtgtcttatgaaacgttgccacttgctaccttataaaagtacagttaggaagtctcctccttcgtgctgaatgataagattgatcaaaaatgaggcagagttataacacattggggttttaatgaggttttgggttctatctcacataaaatattcatcaatgaactagaaggggtgttttgcactccatttattctgccagcactaacctacaagttcatttcattaagaagatagagaggggttaaattcatccaacattctgaagactgccaaggtaagatttaaaattttattatatttctagtttaagaaacctagtgacttatcaggatgctgaatccttataatggcaagtattcaggaagtattaaaaaaagtggacttatcaatttttcaactttcccttgatagtcaataatcaaagaatgaataattacctggaattcatatcaacctggggaacatagcttaacacatttattatggatgtttagagaaatgaagatacatatatacatatatatgtatatatgtgtatatatacatatatatatacacatatatacatacatgtatatatacacatatatatatacacacactatatatatacacacacgaatatatgatggagattccatcaaattaacgaactccttagaaaataagatgtgaataaatgaataaataaccaagcaaactaaataggaaagctgctcaagaatagcagattaaaaatatttatgaataaaaacactttagtatttgataggtccccacttacatctattatcaaatgtgatcctcatatctgctctatgaaatgagcagtgcagaaagaatagccccatttcacaaagggtcaaaatgaggcttggaaaagtaaggccactttatgtagactcacacttctaggaggtggcatattcagttttatatcaattcaaatcttctgacatcaagtccaatacattctgacatgacacaatattctatcattatttttactattattattgttatttttattattgtaggataaaaatatacacaaatgtcagatagaaagtaaataatggcataagatataacagaaatggtctataacaactgactagtggtccagataataatgtatcctagaaaaaataattgattttgttggttttgttgatttttgtcattgttttttgttcatttcacaaagaaaagtaaggcactgagatacatctatatacacaaaatgattgtctcccccacgatatggtcaattctcaactatccatggacttacaggaacaaagactatttagattttttttttttttagtctcttagaatttcaaattctcacatcagtagatatttccccttttaacaaaagcaaattgttttaaaaacccatgaattttctggcttttgttggttttcattcttctccaactagataaacatctcttaagcaaataatcattgcttcaatagagattattttattcatgattatgctttgtgctccaaaatttacgcaaaatatgaaggatgagaaatggcattagaagggagcaacagaaaaatagaaggaaaaaagactttttaaacaatgcttgcagaaagcagaataaattttctgtgaggtaaggctttccattgagtaacaactaaatataaactgaaattgaagtatggggccagaagccagttagggagttcaccaaacttggagctgattaatctccaatatggattctcaaataaatcaaggaactcattcttggaatgatttcaagtcatccttctctttggagggtagagtaaatgttattgagtatggaggaagggaagttgcaatcttaaggggtcactctatcatgttaaaaatcagcacaagcagggtgtcaaaagttgaaggcttttgagtcaccctatccaattgcagttgtcttagctctcaaatcaatacgcctataagtagccatgatatgatttaactgatagtgtcccagacagtgaaaaattcattactgtgacctgtgaagtgatttcacctatcccttatccaacagtagaggattgatcgccacagccaaaacctcagccactgcatacgatagtaagcacttatagtaagtagagtgaccccaatggtaatgtctattcaatgggcggaaagagctaggccctcccaaagtgcagtaaatctcattattcattgacttctccttaagcgttctgctgcttaactaatgaccgttttaattcttaattcatagggtgccttgacaatgtagttttattcttattattataactttgagttgtaataaatatatcgagttttctgtgttactaaaattacactgaaatatcattttaactatttatttttatttatttattattttttaatagagtctcaccctgtcttccaggatggaatacagtgccatcttggctcattgcaacctctgcctcccggttccagcgatcctcccacctcaccttcctaagtaggagtgcggaattataggcgtgcaccgtcacatgcctggctaattttttttttattttttgtggagatggggttttgccatgttagccagactggtctcaaacccctgacctcaagtgatctgcccaccccttcctcccaaagtgctggtattacaggtgtggtccctggccttttaacattttaacttatgaattattttcatacaagataatagtctttttaaaatgcagcttaagtttattctgtggtatattttgctcatatttttcttactagcagcttcaggggataagttggttttgaaggaaatgtattttctttgataacttggcaacatgcaaacctgttctctctctcacagacttcatgtaggaaacagtctttcactgttgcagactgtaaggaagaagaaccaaagagagtcatgggcgaagccccaaagaccctctttaagagtacatctgatcatgtcacatgtctctaaaattacacatactccaaactcctttttgcctgcagaatactttaaacattttaatgggccttcaaaggccttccaggaacttgtccttacctcctttttcaacctcagtttctactaccaacctacacaaattctgcatttcagaggtgtctaccgacttacaaccacttgaatatgccatactgtttcacatctccatgcctttgcacctgctatttccactactggaactgccatccttttcctagtttccacttttgataaactcctactcattctgaaagacagttcccatctgtatgagcttccctgagccacccaaacaacaacccactcccttgtacttgtgccaaccctatacctattatttatctcattgttgaatttattatacctcactgtcatactttgtccttaaatacatttttagtctgtctataagtttcttccaaacaagacctgtgtacctttcaaattcatattattagcaattagcacagttcctggcacacaaagatgttccataaaagtttctgaataaatctgaagtattcttgacctaaggaatgaaacagcatctcttcaagagtaatattttttaaaatatataataaaataatgccacatattaatgtatgtccaataggaaaattatgactttacatattctgtcctatcatccgacaagatagcttgaattttttacttgaaaaatatgaataacatgaatataaaaagtaaataatgggtttcattgaccaacatttaattctaaacagtgatcaagattttaagttaaatatatttctgtcctaatgtctcaagttgctaagaagatattgattatctggacaccaaaaaatagtttccagatgaaatctgtacatctatgtcctttgtattcgtaggcacagacacctactaggaagttaaatgtgtaaattcaggtgaatttccaaaacacacaaaacattctaattacttgggtcaatgggttgatagaaaccttagtcccaggactgatgagcaaacagaacattgaccttctcagactaaccgacatttgttgaagccttcagagtgggatattcaggtggggtgaattgggtacaaaccagtcatatgaacctggacaggggacttctttctgaactgcagctcctcttctgtaaaattaggggcctagatgatataccctagagtcttccaggtctcacaccctgtcaagctatggattgtttcaaattataataaatgacgagggaggttaagtgatatttactggtatatggcaaataagaggcctgcttctcaattcaacaatctcatttttcccctcgcctttgaagacaaaaaataaaaaataaaacaaattaaaaacaaaaataagatgcttttcttatatgcaacacatttaaaatgggtggacaaataaagcatttattctagttcattatagaaaatatattgaaaccactgtcactttgggtcattgtagaagatgtacatacttttgttatacatggaaatattaagcaactaacatattcatatttatataggatttacagttttccaaaacactcatgtgtaatgccttgtttaatctttgaaacaccgctgagagttaggaccctttgatttagacagaggatgggacagagaggttcagtgtactgcgtgaggtccagcaactaataaatgtagagctaagcttcaattgtcagtctctagattcaattcagcttcattctgttatcaatgcaacccctccctccagtcatattattcatgcagaggatgtggctaagtgagaagagaagagattggaaggctcatttatttattcaaaaactatttgccaggcacctactctatgccagacactctgctagatgccagggaatatcaaacctcacacgatccctgcccttctggacttctagatcttacacttccaggagagattaaagtggataaaacgaattgtatgccatgggcacatgttacaagtgggacataaagatataagcaaggaactatgggaacccattgaacaattcatcatgttcatgagaatcagagacagcctctggcatttagctaggccttgaagagggaggagtatttcaatagggagcatagcaagggaaggcgtgccaacatggaaagaagagcaggaatgacagcccggatggatgagagtgcaaagctcacccaggaaggtagttcttttggcctgtatggcaggagaaagactgagtgggcatcgttttgttcagagaaagccagaccagccctgaggcagcaaagtaaaatatcctctctatgtttttcattctccaagctttgccacagaggatgtttacttgctcttggcttcggaatatccttaagaacggttctcaaagtgtggtgcccaaatcaacagccttggtattatctggtaacttgtgagaaatacaaattctcaggctagtgtcacaaatttaccaaatcataaactctgagggtagggcccagaagtctgtgttttagcaagtactccaggagactgtgatgttcactcaaatttgagaatcactgctttgaaggacttccgcccatttgaatatccttataccaaaaaacgtcagttctaacccagaattaccaacacactcctgaaatctacaggctaactttgtatgctcatgtaagagaagcttgcaagatggactgtttgggaataaactaggaatttatgctgaggtggtgagtcatcactttttagggctactgaaagggagacttaagcacccattgttaatttgagtagatgccatctgtggccctactctccttggaataaacttctgttgtgacacagaacttactgttagccttctgtaacatcatatttcgaatggtgcactaatagaaattgtgaaatgctctttagggaacacctatgtcatatttaagcatgacagttacagaagagacggtgggcatatccatttctctgcagtctttgggtttggcttaaaactggttgtaattcagtttgataaatgatcaccaagctctctttatgtcatcactgtaactaggctaggagtggtgacgagaaataagtcatagctcttgtttttgaggcattcagtccatttctttagaataatcaaaaaatctcacttttcccaaatcatccccaggagtttctctggtccctacattttggtttcttcctggaatgctcagccagcctcgctttctgtgcccatcaaaatctgtcaaagccatgctccaacgccaccagttttcctcaactagatatgatctccttttaaacaatgcaggccaaataattatttttctcttacagagttttgtagccttctgagaacgcagtacagatctataatattaaaaatatccaaattagttcctgtatgtcctgtataaaaaccttgaagcaaataatttctaattaaaaatacaacagatcaaattttcattaaaccaaaataaataaataaaactctttcaatatatattcctcatttgaggcttttttttttttgagacggaatcatgctctatcgcccaggctggagtgcagtggcgctatctcagctcactgcaacctccgcctccccagttcaagtgattctcctgcctcagcctcctgagtagctgggattacaggtgcaagccaccatgcatggctaatttttgtgtatgggtttatttttcagtagagacggggtttcaccatgttggtctggctggtctagaactcctgacctcagttgatctacctgccttggcctcccaaaatgctgggattacaggcatgagccacagcacctggcctcatttgaagcttcttaaggtgagtgtgccactcagacttcacaaatatttaatgttgcctaacaagtatgtgaaggatttcaggattttgccactgtataaacaaataaataataaagttacttaagaattttaggcttggaagtaggcacaaaggaagctagtgttttgtggaagtttggaggccaagtaggagggctgggaataaactataggttatctggctgtgcttcccaggtccttcctaattagcattaatgggtaatacatagttgcagtgtcacacaggacagcagaatttttttgagataattgattgctactagaaatttttgagaaatagagtttatctgttgccaagaatggctaaaatctgatctggatctaaatgataaaaaaaataaataatctccatatcagcaacccaatagcactttgaatttacatatgattttctacaagatattttatttaagcataacaatagctctgtcctactctggtatcttgccacagatgggcattcaatgtatctttaagaagggacacaacaaatgatagccgagttaaggattagtcccattttatagatgaaaagcagaggcttacagtgattgaggaaaagtgacagagtcagaaatgttcaacgtgaagcagaagagaggcttcttgaacgtagtccgttcctttccccacaccaccctgcatcacagtttgacagacctgtgtaccactccttcccttacatgtagaaactggttatggttttcgtatattcaacagaaagagtgtcctcatgatatttctctgataaatgctagctatgtatagaaacccacagctaatcagccacttctgacagatcagtgtgaaaaaaaaaatagtcaactagattgatggaccacattttttacttttcagaggaatgtgacagttttccccctcattccttggagcaatgataaagaatccttccaattctgtatttgagcacaaggaacaaattttaggagtaataactcaatattaatatagtaaattttgctgtatagattatgaaacatcttcttaaagtcctattttgtatatggtgtataaaacatcgatgacataaattccactcaaaattctctgtgtgcagagacatctgctgcctggccaatatctattctcacttcctccttattaacacaatctctgtattgttgatagcaacaatgtgcccagctacatatcctagccacccttgtagataggtgttaaaatttaaacaattttaagagggacttcagagaagcagaaagcattccattgacaggcctttctttttttctacatctctatttctaaaactcagatgtgatggttggagctgcaatagacagacagacatctttagaccatgacttgaccttgaggatggaagctacagaataggaacgcagaatagaaggattgagaaaaactgagaggctgatgaaatcacaacatcaccataccagcctcttgacttctacatcaagggaaaattaattctatttagtttacaagtattacttagatttctgttactagttgacccatttaatcataactgatgagtcccccaaaatataagtaaaataaagagctagaaaattttgattaggactatattttgaaattaaagagctactgagtaatagatggacgagtgtcccatgctaatatggcctagaagaagaagatgattttccctaaataaggcaaccagaaatgaacgttatcaggagtctgagtcatgccagaaagaagatgatgatgtttgcaaacccgcataatgatgcaatagagatgggggaatgggaagaggtgaacacaagcatgaggattttagagcgaaaggtcagtgaagccataggaaaagaagctgtttgggactggaggggaagaataactagcactccagacacatgggccgagaaaagaaacgttacatgccagaaaagaaattccctcatccaggaggttcaggcaaaaaaaaaaaaaaaaaaaaaattcttttccttgcagtacctagcacaggactttttagaagggtatgcactcaataaatgtatgttaattaatgtacagccatccaaaaaatcagtgacggaagctcacctgggaagccttactctcaaaatactggataaaacacactgtttcatcccaatcctttcttagtatcctttaactgtcactaaacaacacctaaattataaggtgaaaagacacacacacacacacacacacacacacacacacacacacagagagagaattatagtaaagcagatacatgtagtcaaagcctcatagcacaaaaggaatgagaatttaaacacactcagcattcacttgtgaccactatttaaaacttcatgctccatatttacacatttgtttctctagtgcagtggttctcagccggggtgatctggcccccagggacattgagcaatgcctatatctctgattgttataactggggtgggaggaggggtgctactggcatccagtgggtagaggccagggatgctgttaaccaaccatcctgcaatgcacaggacagcctcccacctccaaaccaaagacttaagccatacatatccagtaacaatgccagctacttcaagattatggcatactctctccaatgttgacagtcttttagttcatgtaatatttttcagagtacccaacaagaaaacacctagcagtgtaggctcatgaaaatgtaatgtgtggtctgtaatccttgacgcgacctggcttccaatgtattttttgttcacaggaagcttgaaatgcataatagccacaattattaaatatatactaattggcaagtacaatgtgaaaaactttacaaagataaatcttggtgaatctacagaacattactgagggataggtattagtataaagtctcacggccaaggtcacagcacttataaacaacagaggtccccagtacatatcaacaatgggaaggttaatatgtaatcatacaatggttgctattctggatatctatgttctctgctgagttgaggttttttttttcctttacattcataaagacaataactttcttgcacagaatgcttcctgaaatgtactgtacatttctgaactttatttgatataacgtattgaacataatttaatcttcccttaacatgtcagggcggttatgatgaatatccacattgttctgtattagagcaaatgaaatattcagggcttcctgtcacttcactagatagtcccaatgcttttagagtttttctgtctgatttttatcatttttctttgtctgcctttctggcagagttggaactgcctctttttaactagagagaactattaaaaaaaaaaaacagagaactattagaactgtaaaacaagctcctaaaagaacctcccatagtgtagggggagaggggagggaggtgagaaggaagaagagctgagactatacaagcttctgggtatcaattttatctgcaccaaattccttttggctttatttcttggtttacaactgagttccaactacctgaatttgttaaatctatgagattcggactcatgtggtcttaaaatacaggtagtagacattttaatcataatttttaaaatcctacatttggctatagtataatgggatcttatgtatctaccaagctatgcatgtccactaacacttaaacccaaatttatcaataaaaccatatttcctagacatttccaaacaataattttagttttcaaacatgcagctcccatttttaaattgccaaaagatcaaaacactaataaaattttcagaagtaataagtgtggcaagataatatgaagttttaaaggcttttttactctgggctaaactatatttctgcaatgagtaccacgagactatttgggttttttttttcactctatcattgctcttttggaaaacagaaaggacctttatcagcactttgcaattgcagataaaaaacagtacactgacagagacgctgtgaagtttaactaggacaaaaatacaataggacacatcagtgattcttgaaaaatcacagaaaaaccatggtaaatgtgctacataatcaatcagtccactgtttaaaaaattacattgaaatagattttctatatagttttatacaaacaaaataggtggtaaaccggacccatgccttagcaggctgaaagctgatactgaacctgccagtggtcaggtacccagaacttggcatatcagactgctgcattgcttctgtagctcatcacttgcctctttcaactcaagatcagctgctggcttgtgagaacgttcccttgggtacctaaatgctgctaccagcagttttattacttctgccatgactttctgaagctgagcaagctgcagcctctgcacgaagatcctcatggagagcagagcaacgcagagtttggagcgtgctaaccagtaaacaaagttttagggtgcattagctttaccctagaaagcagggcacttggcttattttgaaataataggttagcttgagaataaataaaaattctgcttttcttttaaatcatagttttgcataacttaggttttcaatgaaaataatttatttgtccagtgcaataattagtatgaaattaccactgcacttaagatttttaaaaaacctcatttgctacatatcaaaatagttatcccattagaagctgaagacagagtgcctgaaaaggtgactgagtttttctctggaaattttataggctttccatttgttctaaaaaacaaacaaacaaacaaaaaaccataatttgatatattctagaaacccaggtgccaggccctttgcaaagtacacaggattcaaaggtaagtcatacatggcccctgccttccagggttagtggtccggccaggacgccaagctgcttccctatgtgccttgagtggatcatgggacaggacaaatcaggcttgaaagtcatcccaaaactgatggtttcagctgctgatgctagatttccacggataggaaaacatgagctcaacaatggacatcatctattctaaaatgatcccagaaaattataactactgagggtaagtttgtagcaatacattagtgtgacatcataaaaataaagtgttgatacatcttatggcatttcttctccctacatcccattaaaatacacaaaaacaaaaaatatgacctgacagaactatagcaatgaaaactaaactgataatatctaacaacagtttttcagcacccaggagaaatcagtactcatctgtataagatgagcatgtggcctcatccccagctgatgtgtatatacagggctagaaaagtagcagaaaccatcagtcgctcccactgtgtagctccctctccaacctgcagaaatcagaaatcttacatcccccttcccacatatattacaataagaaaatacaataaggaaatggttaactaagccatctaggatgattttctctctcccatgacatttgctttttccctaaagcagcattagtggattacccttatagaaaaagttgaagactgtaattcccagtggtacagaaattccaagtagggtcaaatggtatttctagttctagatcgttgaggaatcgccacactgacttccacaatggttgaactagtttacagtcccaccaacagtgtaaaagtgttcctatttctccacatcctctccagtacctgttgtttcctgactttttaatgatgccattctaactggtgtgagatggtatctcattgtggttttgatttgcatttctctgatggccagtgatgacgagcattttttcatgtgtcttttggctgcataaatgtctcctcttgagaaatatctgttcatatccttcatgatttataatcctttgggtatatatccattactgggtatatacccaaaggattataaatcatgctgctataaagacacacacacacgtatgtttattgtggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacacctcatgttctcactcataggtgggaattgaacaatgagaacacacggacacaagaaggggaacatcacacaccagggcctgttgtggggtggggggaggggggagggatagcattaggagatatacctcatgttaaatgatgagttaatgggtgcagcacaccaacacggcacatgtatacatatgtaacaaacctgcacgttgtgcacatgtaccctagaacttaaagtataaaaaaaaaaaaaaagaaagaaattccaagtaggacgtaatgtaaagttgttgagtgggcactagtgaagataggaagagctctgaccattgtatactctgtttttggaaaagtaagaactagaaaattttcaacttacaagggatgaaaaattatcttcttcagagccaaagaagtatcttctacattggaagcaggagatacttccttatttaggcagaaccatactaatagacctcctaaaaattagtgaagagctttgtacaaatctattacactctcatggaaattattggggaataagggaaaacagagaagcctcacttttggaaattccagggttggattcatgctcaaggaaaagtaaacatttgggggtgggggtggggcaaaaaaaaagcacaggctggacacatgctataaaattgaaataaggaaaagttgttctgaaagtgcagaagaaaaccctagttctttaaaaaaaaaataataatttaatattaagaaaaaaactgggaacgtctgttctgggttctcaagtaaatacatgaaatggtacgcttgttaaggttagggatgatgataagtgatgagataaaaagacaatttatggcaatatagtctaaaattattaagggacctggctgagaaaagcaaggtaacaaaatagccaaattaatcctaccctggaattggaaaagaacaaaactggcactataaaaaaattaaataggctgggcgctgtggctcacgcctgcaattccagcactttgggaggccaaggcgggcggatcacttgaggtcaggagtttgagaccagcctgaccaacagggtgaaaccccatctctactaaaaatacaaaacttagctgggcatggtggcatgggattaaaaataatcccagctacttgggagactgaggcaggagaattgcttgaactgggtggcagaggttgcagtgagctgagatctcaccactgcactccagcctgggtgacagagtgagactcggtctcagtaaaaattaaatcattgatgtaaagaggaaattctcccaagaatcagaaaaggtgaaagatatgaaagggaagataataaaaatagtaaatactggagatttatctttacaagtaatttttatccttaagaacaaatcttaagtagtggaatagaaataataatcaagaaaatatttcctaagctgaagactgactagagtctgagattaccatgttccagacaaaatgtaatcaatctagcaaataaaatgactgacatgttaaggttcaaccttctgctatccaaaaccaatgagagccagacctggtaaattccctggggcctctgcattcaagacaaacagacccagttcaaatcgtagctttactacttaaaagctgcataaatatgggcaagttacaatatcacgcttgccataaaattctacttcaagaagctttatcacatcaacacatcccactccctaatgaaaaatccctttcactgatctcctactgcatctgactcagcctgagtgggcttccttattcctcactccatattccacagtcttcattcaccagcgtatgtccaaaagaaatggtgaaagaaaagaaaaggaaaggtaagagaaagaaggaagtagcctcaaggtcattctccctggagtaatagcgactgccttcaaaagagagtcacagttaacttttaataaaatatctcaaatgatatgttattcatcctccagaggtaatatccttgtcttattgaaaaggcaggtttgctttggtagctgaacacttcctgtattagcttatttccaccattcattttcattacagattcattttcataaatctgaatcattgcaaaatccaaataaatagcctccaataacttcaataaccatattagccatctcatcaattcaacctctaaaatgctctttctcagggatgacttgaaagctacctaggtcagggtcagtctccaatacattcatttgctctgacaagctgatttccataggctaggaggtctgacttggatcctctacaaagaggagcccttgatagactcttttaaatacagcccaaactctgtctccagtttttacagattcagtgcctcaagctggggtttctacaactaatgcaagctttaaacagcttcttctcctctaagtatcattttcactatcaataaggacccagcctttatgctaagtctttttctaccaacattttcccttatttcattttgagtcagagtcttattgattaccagaaggaatagatcataattatactttttaaataattaaataatgatcgcaacaaatgcacaaatacttgtatgtttagtactgtttatctccaaagatcgttgggagacctggttctcaagaagcctgggttctcctctggattcttctaccaaatagctacagtagaggcaattcccttctcttttagggctttaagtaacaaagctaactggtgaaggagacaataccagaattctggttcatgatcatgcaatgttctttttaggtaggccaccagaactgagacagaaataacacactagcatgacttggaaaacttgcagacagaaaaagtaacaatcaagtaaggtaatttgtgtagaagtgctttgtaaatgcgtagttactaatacagttttatgtggttgtcaggcagttgtctataaaatgaaaagagtaccagatttagaattagaagatctgatgataattgtagtctagggaatatttgagtatcaattttcctacagacattaatggtacaatagtactctcttcgcagaattgttctgaaggtcaaatgtaataactttgtcaaagcacctactccagagggtagcacatagtagaatctcaataaatggggtccaaggctggtgggtgacttgttctcaggtcattcacatgccacagaacaggcctcctgtgaagcccataaaatcttaggcagatgagtaccctcagccaaacacactggtcaatcccatttacccttccatgtcatctctctgggggtagctttgcatcagtttatagctttcctgatttagggggctctcatgtcagagaagtcacttaaaagtcaaattattattatcattaaacatgaagaaacatgtccaagctgtcaaatatcaaacaggctctgatttctattcaacattattttctctctcagaacggtttccttccagctgcaatcaatatatatttttggcagaagagatgctaaagaaaaaaaaaaaatctcccagcttgtctccaaggatttcacttttgcacatacatagagatctgacaataatggtgacaacatccgtttgttctgtgtttgcaattagtctagcattttcacatgcattatataatcccattagacagacaggcaggtaatagtatccccatgttagataagaagcccctgaaggacatagtacacataagcttctccaatcctaccactagtaagtgataaagctgattgtgagtgtatggatgtgaagagtaaaaatgctcctacctttctcaagatacgtggaagaggaagtggttggaattatgaagttaagcaatgtggtcctcgttgtaatataccttaatatttcattttgtgtcaaccaaatgaatctatcatgagatataaaaagataccttaataataaaatgaagagacattataatccaacaaagttaccactgtgtggattagacaagtagtagcaactgagaagcattgagtgtgagcacttcctgttttaaatgagccacagacatgccaaatgagtgaaactcctccccagagttgttctaggaccttggcgcttctgattttagaggtcttatcagagcactaaaactaccaccagcattacttccctaatttatacaatgaggtttttaaaagtcaccaaaggcggggcacggtggctcacgcctgtaatcccagcactttgggaggccaaggagggtggatcacctgaggtcaggagttcaagaccaccctggttaaaatgatgaaaccctgtctctactaaaaatacaaaaaaaatacaaaaaaaaaaaaaagctgggcatggtggcatgcacctgtaatctcagctactcaggaggttgaagaggagaattgcttgaacctgggaggcggaggttgcagtgagctgggatcacgccattgcactccagcctgggcaacagagtgagactccgtctcacaacaacaactacaacaaaaagtcaccaaaaagccagccccaaatagtttgattatttattgttattccttctgcatggaataaagaatccagtacaaattgacgtaatgtctactatctagagttttactaacatttagtttttgtacagctaagtaatacctacccagtagagaagaactagaaaacacagaaaagcgcaaagaagaaaaacaaattatccagaaacctcatctggcgttcagtaagatttttagtgcattaatcctgaaaatccagcaaaatcaggaccatggtttatctaagggtaatgagaaataagatttctgtattagagagattgagctttttattgaaatacaggtagttacaaaatatttcttaaatgcatgttacacattagtaataggatggggcaggagagtgggtagagaataaaaaaataaattagacacagttgctctttatagacttttacctaaatatgaaaaaaatcaacttcatcatggttcatggaacaattataggaaaaggtaaggaaatgaagattgaactacagataagtcgaagcgagagaacagattgctatgccattaccataagtgataaacctgaaatcaataaaggatgtgccttcatataccccatggaatactatgcagccataaaaaagaatgagttcatatcctttgcagggacatggatgaagttgaaaaccttcattctcagcaagctaacacaaggacagaaaaccaaataccgcatgttctcataagtaggagttaaacaatgagaacacagggacacagggaggggaacgtcacacacgggggccttttgggggtggggggcaaggggagggagagcattaggacaaatacctaatgcatgcagggcttaaaacctagatgatgggttgataggtacagcaaacaaccatggcacatgtatacaaaccacatggcacatataacaaacctgcatgttctgcacatgtatcccagaacttaaagtaaaatttttaaaaaaagaatatgccttatctaaggtctcacatgtgggaccagcactcaaaaccgaattcaggatattcaattcaattagttatggaagaagacctttcatgaagaagacacaatcagtaatggtgaaattgaattgattctcaaagtttctagtagttttgtttgtttgttatgactgagtacatacatcaaattttaataccactaagaaataatccttagtacttatgcagttaaaacaaaaccaatataacttacctatgaagtagaagagagaaagatttttggaaatgaacataccccaaaacaatagctctcaatttgataacaatagctctcaatttgataacaataaaataaacattaaaaagtcatttaattttaaatacctttctttttcataatcaattaaggatgctttcttgagtttcatatctgttttcaactcagttttatatagctttgcttaatttaagaatttattttcagtctatgaactttctctacaaagcagcaaacagtttatcattttttgctatcactttcaaattcactagaaatatggatggatgctcatttgtagtcaaaacatttccagaaggatttacaagctttcttcccaggactttatacaatcatttttccagatgtaagttaaaacataaatacaagtgctgtgacttctattttagcactccacaaaatacaaatatactataaacaagtgccactatgaaacacagggctcacctattttttatagaacagggaccatagtctggctgttggacataggactgtaattatgagtaagaagatcaactattagaactggaaattaccatggaggtcttcaagtccaaagcctttgtttatgtctgaggaaactaagaaagggaaagaggctcatccaaagtgcatattcaatgcaaatgtcctgacagcctacagtgtaatgacctgcagcagaacttcataataagctcacttcaatctcaccaatactgtaattttgcttaatagtcaatcaaagagtaaatgtttagtgtgccaacaatatgattgacactacattagagattaaagaatacaatagtttagatggatggatagttggatagatagatgatagatagatagatagatagatagatagatagatagatagacataaagaacatcataatataatcttcacccaaaacaagtttattatgtggaagcaaaaggaaaaaaatcatgattcaacatgatacaattcacaaagtcatataatatcattcattcattgattaggcattgagtgagtacctactgtgtataatgcactctgctaagtgctgggattcagataacaattttttgagaatttcccaacctagtggtggagataatcttgtaaaacaactgtagtgaatgctttaatagaggatctatataatagcatagaagggagaaaagcttctggaaaggtcacagagggcttcacaggaaaaaacccacatgagcagagttttaaaggatgagtagaggctgggtgtggttgctcacacctgtaatcccagcagtttgggaggccaaagcgggtggatcacttgaagtcaggaattggagaccaggctggtcaatatggtgaaaccctgtctctaccaaaaatacaaaaaaaaaacttagccaggcttggtggcgtgtacctgtagtctcagctacccggaaggctgcggcaggagcatcactagaacccaggaggcggaggttgcactgagccgagatcgctgccactgcactccagcctgggcgacagagcgagactccgtaaaaaaaaaaaaaaaaaaaaaaaaaagtaggagattactatgcaaagagacggagtgaggggaagtatccctgatagaggggcaggcacagtgaaagacacagaggagtgaaacagcatagagtatctgcagaatggcagaatggcaagtgtggtagagaagacgggtataacaggaggcgagaggtcagaaagagtgagatattgacacattttgaacatcatgttatgttgttagtgctttatcctgaaggaaatgaaaagccaaggaggggttttaagctggaagaaaaatgttatcagacacacataatgaaaaggtaaaaattatcattagttttacttctgaaaatgtaatctagggatataataatgtatacatgcaaatggttagctataaagatgttcatcgttgtgatgtttgtaataaccagaaactaaaaacaccttaaatgtccaagaatggagaattggtttaataaatgttagtactttactaaaatggataaatgggtagaaatggcagattaagcacataccaaaaattccatcttccactctgaactccgaaaaaaaaaacggtagaataagtaactaaaagatgcaacaaaataagttatataaaattgaaaactgcatactctaagaatgaaaaaatttcttcatcgtggaaccagagcggcaacccacagctataagcggagacaaaactactattctacggggaactgggaaggaatataaacattgggtcaggattcttaatgggaatattcaatgggggacaaatatgactcctgcctagtaggagagtctgagataggctctccaaataaatgcagaagctgagattgcactgcctaccttcaaagagaagagttcttcccactctcctaggtctgtggccagaaatgtgccactctgagggcagaagcagaaattcggcttctgctggttttctgctggtacacagggtctgcgtggtacacagatgcaggacctgaaatttgactacccagaaacggcagaactcatcctgagatgctatcatgagacctggtttggagctgtgcatcgtgtaggtcccagaatttaaaaactgcagaactccctgcactactagagagcaatctccaaagaaaatgacacctcaaataagaatcctaaagcacatgaaaaagctcagcaatgggacataaagcaaccagatccaacaaacaggataatccatatccacgaaatagagaaaatagataaatctgaataagactttttaaaaggaggattagaaccctcagagaaaagaacagactaataaccatgataagaattgaaagaatcagcagttaggaaattagaataagcaaataagaaaaatgcaaaacgtgaaacacaaataaatatgctctaatatgtttcataggtattttaaaaattgttagagcataaaagaataggcaagcaaacaagataagatttttaaaaataaaatatggctattggaataagaatctcaatagatacgctaaatcgtatatgttagagtagaatattgtattagtgaaatggaagttaaaagattatgatagaaaatgcaaaacatgaaaaaatagaagagatgttattatggctaggacttttccagaaattgaacattgacatgagtgtgattgacagatggaacagctcttaaagtgtggtcccagcacagtggttcacgcctgtaatcccagcactttgggaagctgaggtgggcggatcatgaagtcaagagatcaagaccatcctggccaacataacaaaattccgtctctacagaaaatacaaaaatttagctgggcatggtggtggggacctatagtcccagctacttgggaaactgaggcaggagaatcgcttgaatccaggaggtggagattgcagggaggcagaggttgcagtgagccgaaattgtgccactacactctagcctggagacagagaaagactctgtcttaaaaaaaaaaaaaaaaaaaaaaaaaaaaaaattggtgtgatccagagaatcctggatgtccccagaaattctacaaggagtgcacaaggtcacagttatttttccaataatattaaattgttatttacctttttcattatcattttcttatgataatgtgttttccagaggctccatgacagatgatgacattgtgtaataaactgtgtcaacatacgaaagagctgcatgactcagtgaaccaatatttttcaaatgatcaatatatgatattaaagcatattccatcagcaaaacatccattcaaattacaaggtagctaatgtgaaagagcataaagagttaattgatatgactttgaattcccttttgtctctaatctttaagaaacaatcactggctgagttttgatgtagtgttaagaaaaatatccacaattatttaaaagaactattaaaatattcctccattttccaactatatcccatacgaggctggattttttagtatacctcaaccaaaacaatatttgccatatattgaatgcagaagtagattgacaatccagctgtcttttattaaggcagacattaaaagagacttataaaatataaaataatgctattcttcacactaattttttgttttcaaaaatatagttattttaataaaaatatattgcttatagtagcatgtaataattttagttacttatttttagtaaataactatttttgcattcctcagttttaatttttaataaggtaggtattaataaatataaatcaaataaaagcacattaaaatcttcaataattttgaagtatatagatcttctgagaccaaatgttttagagtaatcatcacacgtggacaatctttaacaacaatagtatttttgaaataataataataatgttgtgaataatataaattgccatacaataaaaaggccaggatatgatgtacatgtatccattgggatagatctacgggcagatcagcctttctacatataatatgagcacaataaatagaccagtgttcttggtttgttgattgcaaagtacttggactcacaaacagttaaagcactgaataaatgtttatagagtcccttaccttcaaagagtctgcagtctagtacatcaataagaatggttaaagcattatttttgttatcatagacatatatacaaagtataatggggacccgaaggatagtttgaatctcctcgagactcaaggaaaggcttcatgaaggggacagaaattgaattgcaaaggtgagtagatgttttccaggtacagtgaagatagataaaatgggagagcgatctgggctgagcagtaccaaatccatgacatctggctcagctggattgtagatggtaatctcagggaatcacctagatctatcttatttgtcagatttcatgtctatcctagcttggaaactggaatatcgtaagtacgaaaataggttttcaatgaataaatggaaggcatggaaagagagggaactgttgaggaagacaaagaccaggttatgaatgtttttacataccaagtaaaggaatttagattatcctgcagagctttgaagttagacagcaggaaaacattaaaagagagtgatgtgattgtttttgtgctttagaaaaaacatctctagtagtacagtaaaataatgttttgcaggggagaaaagtggagatcaggtgaacagttgggaaactagagattatatcccatttaccattgattctggattaggtaaacaggattcaaagatatcaattattaaagacaaaatatttgtggggctttcagcggaaattccatgtattggtcatgttctctaatcaccagttttctagcagtcaaaagttaacccaacgtttggtagacgcatgggactaataggcagaaacacccataaccatttaccagctgtgtgttttggggcaagtccataggcttcagttttttcttccactgtaagacggacatgaaatgccctttatgatatttacacactttctgtaaagatcacgtacaacgataaatgggataactctttataccttggaaatagtcttctagttaggggagaaactgaaggctgcggtgaagtggaggcattcaataaagcatcttgtgcttcttgaccaacacacacacacacacacacacacacatacacacacacacactcacaagaacattcagacatcatctaagaaatctgaatcccatggtcattgctaaaattatgtgattacaagtttagtttaaaggaataaataatttttcataattaactggatttaaataaaactatcaccatagcaaggaattcatacagacaaatttctttatttcactgatgaagaaactgagacccaaagacagagtgcggcttactcaacattaaagcaagttaacagccaagccagcactagagcgtagctctcttgacttccagtccaatagtcttctatagtaaactgcaggaatatgacaataaaaggaaataatacagaggctttatgtgtttcatagaatctcatagttgtgagaagagcctggggtgggtaggagtgggtgataaagtaaggcaactcctctgatacacacctcccagaccaaatgctttgagggcaactctggatttttataagtatttaaaaataagattttcctgttgtcataaataaataaagaaatcactaagttatctgaatgttctttttttttaaagtctggtatggacaaacctgaaaattccaagtagatgaacacacattaaaattgtcattctaggttgatatccatgcacccatctctacttacctcaaattcctgcacacgtattgccgtgcagcttggaaagatgcatacagcttttacccatgactaatcatcacattttaccacttcaaacacaggggacagatccgtgagaaggcacagttgtttatcaaaccgttgaagtgataacacaaacaagcttctttaaaagcaaaagagcacaagagtagactgtgtgggcttcgttttgttccctttattgacccatttgcttaaattttcataaatgtttcagttgttgaacattctgctgccaaggaattcatcaaggccatagaaatatgcagctcaggtacaaagatgaagtttggaactcttggcaagagctggccttgatccactgagtttccttgccttatctctcctgttcaactcaatttcagtggatattttatgagctcctactgtgtgctacattctaggcaagacacacttggaaatggagaaaaaaataaggcataaagtccaatccaaaaggcaataaaagaaatgcataagaaaggtgcagctgtagtggttttgcaatcacttcaagttggaggcttttagtgattgagtgatcacttcaagttgaagactctccctgggaaatgataatgttgaaccagtccttaataggaaattgaggattaaaagggcagtttttgtccaggaaatgagcaaatccaggtgatctaactccataggcttcctgacatgagaaggtgctctcctcactcatttactctttgcttatattagcaggttgtcttgaggagcattagaaaggggcaaccacaaagaggcctgtggtgctggcaagaaaaacgtaaagaacactgtaatacagagacaaatcagttaagtattataataaattgcccacatccataaaaactacatccagaaaccttttccttttttaaaaaattgtattttattttaggttctgggatacatgtgtagaacgtgcaggttggttacataggtaaacgtatgccatggtggtttgctgtacctgtcaacccatcacctaggtattaagccccccatgcattagccattagtcctgatgctctccctcctcctgcccccctgacaggctccagtgtgtgttgctcccctccctgtgtccatgtgttctcgctgttcagctcccacctatgagtgagaacatgtgatgtttggctttctgttcctgtgatagtctgctgatcattatggcttccaacttcatccatgcccctgcaaaggacatgatctcattccttttctatggctgcatagtattccatggtgtatatgtaccacatttcctatatccagtctatcattaatgggcatttgggtttgttccaagactttattattgtgaatagtgctgcattaagcatacatgtgcatgtatctttataatagaatgatctatatttcctttgggtatatacccagtaatgggattgttgagtcaaatagtatttctgtttctagatccttgaggaatcaccacactcagacagcttttcaaatcatctaattcttgactctaactcattcaaaagttattgctaagtgttttatgactagactctcttattgagtgattcctcctacatccaatgttgcaactcaaggaatttacattcatactcaggatttttttgtgccctatctcatgtaatccctagaacaacccatggggtagttattaaccttgtgacaaattattatgtaccatagacttgggtcagctgctttgtatctaatcaaaacaccatgaatgttaaaagtactgatgccaaagtctggccactgtaatccacaaaagcagcaaaaggcatgctatccactgactcaattcttgtgacacatatttagaaactatacagtccatccacaattgcattgttcattgctaaacacttattatattcagtaaactgggctaaaacaaaatgataaacaaatgactatgaatagtatgttagaaagaaaccctaggcctagagacctgcataaggcccatactctgtaattaaaggacggtttcgaacttctgagtactcattttcttctactgcataagggagatgagagcagtagattttgtgatccctaagttgctttccactgtaaaaaaaagtttttaattataatattaataagatacatgcagttagatgaataaaagtttctgtcaaatgattactctccaatctaaaaattctcaaaggtgaaaactgctcattcaaggaaagaatataacctgttactcagccttagttgaggaacaagactttaatggagaaatgctttttcccaaaagagaaaatgtactctaaactaggagagaactgtgtgtgtcccaggtttagccataaatgcagaagacagaagcccactggggtttacagtttctgtcacagcaagggtgtagagaaggataggttttaggccaaaccctttgcaagaacatcataccctttcctaagctttgcagcctttccatgtttttattctttttaccatcatctatctacctgtgtgatcatggtttttaatcctataaatagactgggcttcagtacttgtctttaggtgcagaaagaaaatgggcaaatgcagaaaccagtatcactttggagacagtcttagggatagagtaagtggtaggagcaaatcagttgagtgactaaagcctgtagatggcctgagcactggctagacctggatggtcccagtacactgcggcaacagggcctgcctgggatgcactgtggccaatgacagcaattacgtgaaagagtgtgggtataaaactcttattctgtccttcaaagtaagcaaaaaaaaaaaagtcctactttttttttcaagtgaggctaagaaaacaaaatttaagataatttacatagtgacataaatgataaaaccaagaatccttacattcattattttatgatataagaggattatataatttattatgcacactcagacatttttgagagtacaaggggatatcattaattatcaccccaaaacaatataaacagagacatatggctctcatccttaaaaccctgtgttcattatccaccatttcatctgctccatttttgtagcctaagaagggagcagaatacaggtttttatgcctgtcttatagatgaggaatctgttgctcagagagctgaagtgccttgtccaagatacacaaaaggtcaccttacaatatttgaagaataatgctcaaaggattcttaaagataggaaacattaaagaacaaactaggaatcaaaacacattattaaaatgttttcaagtcaacaattccctgatgtgcttcacgaggcactcaagaatagctaggcagatcagtggaaacaaccgaggtctgcacagcatggctcaccatttgcattggctgtgaatacttagcaaaatccactggtgcctatactcccctaatagggtcttaaacccaatacaccacaccaggtggtcagactcactcaggttgacatatcctaggtcaactgaaactggagagacacgcttttgacaaagcctgtccaaatggagaatgtagaggagaaagaagcctctactgggaacccatcacacagccaccaaaccagaagaccatatgagtattctcagtttcatttagcattaagttaaaataaaagcatgactcagttcttcctcccctcttgcgatgagtgcttggaatctgttggagcaacccctggcccagctcacatcactacaagacaaaaaagtaagtaagatggtatcacccaacatcacacttcctagacagaacaggagaacttcagagaaagagctgcagagtcctaggagcatagagttgaatgaaatctaagagaacaacaccaactcctctctttatgaaatggaaagaggccttaaaatcgtgtctgagtcacattgcaaattagtggtagagctggcaaattagaggtagacctcaagcttcctgttttgtggtccacagtgctttctaactctttccatgtaataatgtacgcaagtgaattagaatggattcattatatgtgagtttgtgggttgtactgtgtctccccaaaattcatatgttgaattcctcacctacagtaactcaaaatgtaaccatattttgagatagggcccttacacaggtaatcaagttaaaatgaggtcattagggtgggctttaatccagtatgattggcatcctcagaaaatggatatttacatgcaaatatacacacagggagaacactatggaaagatgaaggcagcagtgagggcaaggaatggcaaaaattgccaacaaacaacttgaagctaaggaagaggcatggaatggaacagactatccctaatatttctaagaaggatccatccttgctgatacctcagcctcagacttccagcctccagaatggggagaaaatacatttctgttattgaagccgctcagtttgtggtactttgttacagcagccctagaaaacgaattcggtgagtttgagatagaggcgcagtgttcctccagtgtctagtaagtcactcatctgccatatggatttgctcaccctgtagtgactgttgtcctaaccccagcctaaacatgtgccacaaagattgcttgactttacgtagcatgaaaagtccacacctcaacacatacaataaagacggcctgtcaaacagtgaccttcctccttcctcaccttccaaactattacctcccccaactcccacactgagagttaactgggcctagttctataggcaaaagtaagccccacattgataataactggtgaacttcagggttgagatgaccgtagccttccccctattcctgatctcacctatacagatgagtaggccaaagaaaaactcctgaggttgtgtcaggcaaacttgaggacataccgtgatgctgtcagagttctggcccagagcgttttatacatacacagggagagaatttttttcactttgaacagaatttccagttgtttcaatatgaatattttctaatcattttactagctagttcaatatattggtttttcttcttctaacagaaagatacaaaaggctccaaagaatagaaactctaaaattggaaactgaaaaaacaaaatagccatatgttctatgcctgagcagaatgctttggcaccaatggacgcaatgtgacctcaaccttttattatatttttcaatgcaagctgccccacccagagacatatgatgatgcaaaagacagatcctggcctgtcttccgtctcacacagagctggtaccctaagcggactcccaggcattagaagttctgaatttggcagtcctaatccatacgtctggggcaggctgactgagaatccattcatcagaagaggaaacactggagtcatttccagattaagtcctggcactatattctctacaaatagaaagtaattgtattggtagtgagtaagcctagccgggcttactgtctaaatgctttctaaagctactctatcataagtaaaacatcataagaacagttatacaatatagtcctcacttttgggttttcaattatacaagttgctatcacaacactcaatgacaaaatgactaacctctagttactatgagccttgactatgtgacaggctaaatgttccaaatgcttttcacttattattgtgtgctcatctttacaaaacccttgtgaggtaggtactcttactattcccacctcacaggtgaggaacacaggtaaagacatggttgagtaaattactcaaattcacccagctaataaatggcagatacagaatgtgaagccaagctgactgcagagctcatgcttagaaaccactatcctggtctgcttcttgcactgagggccaccattactgtcacttttttctctccaactctgaacttttttgaagtcagtgaggatccccttctcagctcttccacctgcatttaatgactgttgttgaaagactcaaactcgttcatgtccttatgctctaaccaggaaacaatttctccctccactcaactttctcagtttctcatcgatgacaatttttgcctggtagttgtttacataccttaaacctccctcctttccccacagcttatatatgtgcaaaattcatagctaagttatttctgcaatttccccgaagcccaccatattcccttgcatttagtaagaagttctccataaacatttacgggataaagaaaaacagggtcagtgcatggcggtaaagaatccagggccttcctgagagccagcccaggcccagcttatctttcgtaaggtccatttcaatgggcccttagacagtgctcactgggtaatgtggaagacctggaattcactccagagcagtggttctcaatctttaatatgcttcagagtcccctgaagaccttgctgggcctactccagagtttctgactcaggggttatgcgggtgaggcccaagaattttcattcttaagtagttccctggtgaggttaacagtgcagatttgggggccacacttttgagaatctccgctctggatcccagctttggagaataggaagtattttaagcgaaaaagaaatgagtagatagtgagaagctccttggtggagtaagggtatgcagcaaatagaggaggcacggaaggtcatatttagatgggaaatagaagcagcagggtaagtctgggatgcaagaatgtacaaagtgaggcacaggaagataggcagaaaatgtggagttgacacgaaagataagcagttctgctccaacttcagatcacaaagagatctagccaggcatggtggttcaatcctgtaatctcagcactttggcagggcaagacaggtggatcacttgaggtcaggagttcaagaccagcctggacaagatggcaaaagcccatctctacaaagaatacaaaaattagtcaggtgtggtggtgcatgcctgtaatcccagctactcaggaggtgggaggtcagaggtgggaggatggtttgagccctggagtttgaggctgcagtgagctgtgattgtgccaccgcactccaacctgggtgacagagcaggaccctttctcctcaccgtcccccaccccagcctgccaaccaaaaaaaaaaatcatagatagacatctagattcatcttctcatacagggaggccccagatcccgtccaccactgccaaccagggatcacacccaaaggccaaacaccttattattctaaagcttctaaatcacgatggctgctttttgtggcttctccatacagctgcacattatcaagggagccagctaaccaggccatggggcttcagacttgggagccgaggactttatgtttcagtggcagggaaggagagagtaattcttcctgagctggggcagcataaaatcctctcttctactccctgacaccaggtgtatgcctgatagtaaaacatcacattttaaaagtggaaataacaaaaacaaacattttatctggctcccatgttggtgaaagatttctatactaagggcttttttttcctttactggaaaaaatagcttatcgatgtttcgcattgcctcagtgtgaagaaagcagtttgtaaaagtcagaaacagataccgtagggagtcagaaatagatactgtcaagggaggaattttgttgggtcctcagaaaagtctggaagtggacaccactgttccaaaccttattttgaacaaagagctagaaaaagtggggaatgattagaagattaatgccataaccaggtgaaaaacaagatgactgctgccgaaggaaatggtgcaaagggcacaagggactatgcccaggacacaaggggaaagaggtccaaggagctggaagagctataaacccaacggactccagcaggaaagcaggtggtggtggccttcggttgggaggtggtagtggggggaggttatgaagaaaggagtttttgcaggggttattcaggtcatcacatggtgaaagccaaagaggtcagactgtgttgtgaggactggagcggacagaagaaaactttccgcaatgaaaaagaccagtgattgcacagcaggaaacccaataggaaacgtgagaggcataagaacagcccagccagacaagctgtggttcacaatgtgacttgcttcctctcttttaaccatagcatctacatttataaatgaatacattctattaagttttctctgagggtcctcctagctcccaaatccattaggaagtatattcttgcattcattcagtccacaagaacttaagcacttactatttgccaggtcattagatgctagactcataataataaacaaaagtgtccctacctataaagcccaggctcatgagcttccaggatcaaagaataggaatagttggaagctactctaaatgagactaaataatgtatttacataaagacatttagtaagggcctgtgctgggctcagctgaacaagtcttcaggttatttggttgttcaataatataggcagcttgggaatatacttgtaaacattttatttattcaatactgtttctgtctataagccacctggctcaatataatatagagcacagaattaatgtcttcttaaaaatgataaagggtcagaataagggaggccagttaggcctccactgcagaagataagaggtgaggaatgtgaactgagacagcagaaccaaagggatataacaatgtaaactagagacgataaaaggggtgacataaagtcagactaggtgaggaaagggctgccttaggaatgactaagtttccactctgagtgcctatgtagattgtggtgtcatttggcaaggtgagaaaagcagaagggagtgactgaggagaagacaaagagctcagctggagtcagtagagttcgaggtgctttggttctgaagtccaggagaaagttctagactggaagaatacaagtcgtgagattctaggcggcaggtgaagacaagaagtagatgatagtggctagattgaggcctctgccttgcctctaccaatctctaaaaatccctgtgaccagagggatttagaaatgaataaagaaagagcatgaaagagaaaaagtcagttaactggaagtcattttttaaagttttctattttttcctttcccaaatatcacccagatcctccttttttcaaggaaatatctttattcttgctttacagatgggcatacagggagcaatgatgtatgctcatcacccagatatttactccagaagctggctgaggtcataaaaatcatctagtcagccaacacctacatgcagaagaggaggaaaggcaacatgctgagggtcaccatagaatgactgcattttttaaaaatttgtgccccaagaaaaaaacacacatacaatgtttcatagacattccatagtgtcagattgggaagccattcttctctgcccaccctttttataaaaatggagatgttaagacagtgacaggtagaatggtttgcccatcattttctcatgagttgactgagtcagacagtcagaatctgggctcttgatttctcttttataataagtttccttagaccgggagaaatggtgacacacatctcaagttttatgtttcagtaattctcccagcagtggtctaaagaaccctcattaaccatatggcagccctggtacaagcaaggtaaacagcagacacccaatattatctgctataagcccctgaacgcacacagctggtgcacacacagtcatgcatgttttttccaatccccattgtttcccatgtaaattttgcatgaaaatttccgtccgggtcccaaatctgaggtcttgagataagaaaacctaaatctaaccctgactccagctccacctctgctgtttactaataactagcttgggagattctcttcacctctggatctcagtttcctcacctgtcaagtgagaggtttagactaaatgatttctaagattcattcctcctcaacattgtatgaggtcccaatagataacttatttaatatgaaatatcatcctctgagaattacagtgttatacaacaaagaatttggtctttgtcctgggcttctgggatggagactcgaaacctttgaaatttcccaaatcatcagagtgtctgtgattcatgctgggcccatgaaccacacctgagtttgagttaaggaggtgtctctggatgcgggctagtcctgccagaaagaccaaacatgtaattagagggttgcaactttgagccatgggtcagaaggagagggaagttgtaggttgacttcgttcatgtggccaatgactcaatcggtcatgcctaagtaataaaaccctaataaaaactctggaccttgaggctctggtgagcttccttgttggggaatgtatcaatgtgccagaagggtgacatgctgtcatggggagagggcataaaagctcaatatttgaaactcttagaaacctcactctatgtgtctcttcgtttggctgcttctgaatcgtatccctaataatagaactataatcctaatactttactgggttttgtgaattgttttaatgaattatctaacctgagagggtcatgggaaatccccttccaaatttgtattcagttggtgagcagtgaaagcagcccaaggaacccgaactggcagccagcgtctgaaatcagtgcaatcttgttggggattgcgtccttaacctgtggagtcagtgctaactctgagcggttagtgtcagatttgacttgcagcattacgtacaatatacctactagacaataattataatttatatgtgttctcagacaagtaaatggactctaaacaccttctacaagtgctccttggcttacagttactggtgtgctgtggtggcagcatcggtgttatgtgattataagagactagctactgatagtgttttcaaatcatggttatgttggtgtgatgaatgacataaaaaattgtttcaagatgtcaaagaggacacacttgtctgcaccagcacctcctaacagggcttaaaacagaaacatttccccgctctattaagcagctgttacaaagtttaaaaaaaaatttttttctagggggcagccatcattattcaggtgttgaataaagccctgcctaatatatcatctctttaaatgctactctgcggggcttatttttatcactctcaagcaattcaaatgttggtcatccagaaaattcatttctttctttccttcctaaaggcacaggcaacagaattgaaatcactgatgtaaactgagccaaaacagacttaggaatatctttctgttcggctgcaactcaacctccattccctgcgcaataggaagcatcaattaactgatcataaccagcagaagaaagaatatctggaattcttttgtgaaaggtcaacttaagttccagagtcgttctcatcctgtatgatgctgtaagagaccagcatctcccttccatgatacccagtccctgtattcctaagagtcatcttgggagtgcctgctctcgatgcaacatcttagaatcctctcccaaaggttatgaatcggtagttttaagtttgatcccattaacctgcatggttcaacccttccaggtaattctgacacaggcgatctgcagaaacactctctgttgcttttccccaaaggtcaccactgagagggcacatgctgtccaagctgcctgtgttaacggggttaaaacggaaatacgcatcagacccaccagaagatctgtgatacaatgttagtgagcagtgagtaatcatcacgagtgatttgttataaaaacagatctaaagctccttgactctgaacatgccaatcaagaccaactgatcagggtttgtttttttttcatttggaaaaaggtcaagcagctgcccgtttgcttttttctctccagggccattttaggaagttcatctgctctaaacagctgttctcaagtagaattgatccctgcagaaaaatgactgtgggaccacactccagaggtgacatatgttaaactatttttcagtttcagcttacctttgaaaagcatataagaatagcagtctctcttttcagtgattcaaaatcagggtttaaaagcgtattttgatgatcatcatcaaatttctataaagtgttatgtttataatgctctctttttagttgtcatgacttatatttagataacactttttctttatccattcaatatttttcagtctacaaagttcattcatatcatagtcttcattacaatccttcaagcaggcaaggaatctataataatattaacccagggcagatagtaataaacacaacgtggatgagggagactgaccttgttgttcaaatgtcaactcccctatttacttgtgttatgtggccttgggcatatttacctccttgtgcctcagtttcttcatctgtagaatgaagataatagtatccacatcatagtgttgttgtaaagattacaaagttagtatcttttttttttgagacagagtctcgttctgtcacccaggctggagtgcagtgacacgacctcagctcactgcaacctctgcctcccagttcacgccattctccagcctcagcctcccaagtagctgggattacaggggcccgccaccacgcccggctaatttttttgtatttttagtagagatggggtttcaccgtgttagtcaggatggttttgatctcttgacctcgtgatccgcccgcctcggcctcccaaagtgctgggattacaggcgtgagccactgtgcctggcctacaaagttaatatctctaaagtgtttagaacacagtaagcactataaaagtttgtgaaataaaattatactcaacaagcatttgagtgctcacaaccaaataacaaaggcacagggataaaagatttacaccccagttcctgttctccaagagctcgcaaagcagaactgagagggagacaaaaattcaaataactgtaaaacagtttcttaggtatcgtgagagagtagtgggggcacatcagacaaggggaaaggtagggaaggaggtgacagcaggtaccagcacggaggagagtataaatagatagcagaaatttcccaggaaaaccggaaggatggaagagggagagaatcggacttcaggctaagggtgcaatatttgagaaaaataataatacttccaaatctttcctatctattatatataaggactgtgataaaaagatttacttactttgtttttgaatcctgacaatagtattttaaggttgtcctcactgttatcattttttaaattaagaacatgggacttagaaaagcttacagtatatttctccaggagaatatactgtaagtggcagagcccatctgtctccatgactgacactgaacaggctgtctctcaggcactcctgagccctggaggcaaagcgtggcgcaatcagggatgttgtgaagaatggagaaggaaggagctagaaagagttggaaggtgaaaagaagggcttttcatgtgctgatttcgtattcatataggatagatgtgagcatgtcgattagctgagaagtcagtagagaggatgaaaatatcagcgtcttagaagtaggtgctgatgcagcatcccacaagacacaggaggtgacagcatctaggggaaaccttgactggcttaaaatgaaaggagagccaactcttgctctgaacaaagaagagagaaagacaggcacagaggcaagtttataaatgataaaaagggtcagaaagttggaaccgagactgaaatgtaggcttgtatgatcttagcgaggagagtcactgaagtcaatggaagacatcccacaccactccccatcaccacaaccccaaaaagtgtccagtttgggcacccaccattctatctcaccgacctcatgccccggttgttctgaatgtagtgccattgtttattaagatattaacttacatttgttcttctctttttcctgtgctatttgaagtgggttacttaaggtagtatttccttgactcaggtattttttcaataagaaaaacagaagttatttggagatcacaggtcttagaaaagactatactcagcaaggagatgtgtaaggctcagggatggaggtatatgagggaaagagatttcttaagaatatctatatgtaacaaaactgcacgttctgcacatgtaatcgagaacttaaagtacaaaaaaaagacaatgacttttttctctaatttttttttttttttttttttttttttttttgagacggagtgtccctctgtcacacaggctggagtgcagtggtgccatctcggctcactgcaagctccggcttctgggttcatgccattctcctgcctcagcctcccgagtagctgggactacaggcacccgccaccacaactggataatttttttgtatttttagtagagacggggtttcaccatcttagccaggatggtctccatctcctgacctcgtgatctgcccgccttggcctcccaaagtgctgggattacaggtgtgagtcaccgtgcccagccctctgatttatttttaataaaatagtctctcacatcaaaaaaaaaaaaaaaagaatctctagatgagacaaatatttgccttgggactaaaaacatatacacaggggtattaagaggaagcagggtggagacagtcagtagcattctggggagtgatggccatgtgacttgcctggggatctgaaccccaggcaaagggcagttcttggtggcagtgaagactctcacgccccacacatggcacatattccataacagtggccaatgaccacaaatgggttaaggctcataagacccaggcagaactttgactctgcctggtaggtgggataaggtccaatagtgactgacaaataattcaccaccaaggagaggtagtcaaagtcagaattgggttggcctaatttaaaggaaacaaagaacagctgctgtctctaaaggagctccggcccaggggcccagccatcaccaccatgtccacacccaaggttgtcccctgcagcaggctagggcatgcacccaaccctgcccctgtacctgtgcatgtgtaagtagcaggccccaccccccagctcctgcctccaccactattcttgtacccagaactggcccttgcagctgcctaggtgtgcatatctccagctcaggcccactactgcctacacacatgtagtcagcctgacccctgtcccaacccgcagctgacacctgccatcatgcatgtgtacactgccaacctctgccacaacatgtgcacatgcagtcagtcctagccccttcctttgctgccagcccttgccacgatgcacaagcttgccactgaccttggctgccacacacatgccttcagccagcaactgaccttggctgccacacacatgccttcagccagcaactgacctttgctgccacacacatgccttcagccagccgccacagctgagcacacgcacaccactgactatggtccccatcactttctgccccagccccttgccaccaaactcagagacactactgaggaccctcacagccatagcagacctcacacagctcttgccaccaagaacgacctaattgccaatgtcatggacccccagctttctgagccaatgagacaccacatccaccccttgacctggagctactgtatacttccattcatggtgccccacaccactacacctggtgccatggcacgccccagcatgcatccctctataaccaccccccaacctctgccacaggtgagggtcttctcttaccaaaaccagtctataaagtttggaaaaagaatgcacgcatcaaatgctacatttgtaaggctttgtaaggctacaagaattatgaagaatcagaggaatatgaaaccaaaggaacacaataaacttctaataagtgaccttaaagaattggacattgtctatggccataccactctgaatatgcccaatcctgtctgatctcagaagaattggagattcatgaattttataacaaagaattcaaaataattctctaaagaagctcagtaaaaaataaaacagtatagagatttctgaaaaactaaaaatactattactatataatccagcattttcaccaatggatatttattcaaagaaaaggaaatcagtatgtcaaaaggatacatgcacccccgtgtgtattgcagcagtattcacaatagcaaaaacatggaatcaacctaaaaattcatcagtggacaaacggataaataaaatgtgggatatatatataatgaaatactatctagccataaaaaaataaaattatgtcatttgcagcaacgtggactgaattggttggaggtgatgttaagtgaaataagccaatcacagaaagacatatgttctcactcatatgtgggagctaaacaagtcaatgtccaggatgtagagagtacaatgatagatatcagaagatggaaggggtatatggatgttggcgataaagtaaggttggttaataggtacaaacacatagatagatagaaggaatacattctaatgtttgataccagagtaaggtgactacaggtaacaacaatgtattatatatttcaaaatagctggaagggagaatttgaaatgttcccaacacatagaaatgataaatacttaaagtgatgtataccctaaatatcctgacttgatcattacacattctatgtatgtaacaaagtatcacatgcacctcatgaatatgtacaaatatgtatcgttttaaaagaagttcagcaaacaagagagcacaaaaaacagtttaaaaaattaggaaacaataaaagaacaaaattataagctcaacaaaatgatagaaaacattagaaaataaccaaacagaaattttggagctaaataatacaatgactgaacaacagaatggaatagagagcttgaagaagaatagatcatgcagaagaaataataagcaaactagaagacagattgttttatatcatatagtaagagtagaaaaaagaaaaaaaggaatgaaaattttatgtgatatataaaacaccatcaagagagctattttttgcataataggattttcagaagaacagagagagaaagggacagaaaaccattatttagaaaaataatggctaaaaacttcccacctggggaaagaaatgaacatgcaggtacatgaagctcaaaggaattcaaccaaattcaacccaaagaagagttcaccaagatacattacaataaaaaattaagaactaagaaagaactttaaaagcaggaagaaaaaaaaagcaaatcacatacaagtgaataccaataaggccattatagatttcttagtagaaaccttgcaagccaagtgagagtgatgatgtactcaaaatgtggaaagaaataaaactgccagccaaaaatacattacatagcaaagctgtctttcagaaaagagggagaaaaaagacattcacagacaaataaaagctgagggagttcatcaccactggaattgctttataagaaatgctaaagagacttatttgggatgaaacaaaaggcttactaattagtaacataaaaacatatgaaagcataaaactcactgaaaatgtaaatatatagtcaaaatcagaataccataatactgaaatggttgtgtgtaagttgcttatagtgccactataaagattgaaaggaaaaaaagtatttgaaataactacagctacattaacttgttaatggtgatatacaatataaaaagaaataaactgtgacatcaacaacataaaatgtggggaaatggtaaaaccataaagctttgcctgtgatcaaagtgggtatcagcttaaagtagacatacaggtataactataaaatgttttacataagcttcatggtaactacaaagcaaaaacttatagtagatgcagaaaagataagaaagaaatcaaaccacaacactacaaaaaaaaaaaaaaaaaaatcacccaatcacaaagtaagacagcaagagaggaaggaaggatctacaaaatatccagaaaatgattaatgaaatatcaatagtaaatccttatctatcaataattactttaaatgtaagtggactacatttgtcaatcaaaagacatagagtggataaattatttaaaaaagacaagacccaaatatatgctgctgacatgagactcatttcacctttaagaacatacacagactgaagatatttagtgcaaatggaaacttaaagagagcagaggtagcttttatattggaaaagctagacgttaagccaaaaactgttataagggacaaataaggtcattatataatgatgaaggggtcaatgcatcaagagtctaccacaatgataaatatataggtatccaacataagaacaccaaaacatataaagcaaatattaacagatccgaagggggaaataaacaggaatacaataatagaagtgggtgtcaatacccactttcaacaatggatagattatctagacaaaatatcaatcataaactattagacttgaattactcttcagtacaaatgagcctaacagccatttacagaacattctatccatcagcaacagaaaacacattcttcttaatggcacacggaacattgtcgagtatagattaaatgtggggtcacaaaacaaggctgtgtaaatgcaagaatattgaaatcatattaagtatcttttccaaccacaatggtatgaaactagaaaccaataaaaggagaaaaatctagaaaattcataaatatgtggaaattaaagtaaatacttctaaacaaccgatgagtcaaagaaaaaaatcaaaagtgaaattttaaactctcttaaatcaaacaaaaatggaaatacaacacactaaaaactatggatactgtaaaagcactcctaagtaggatgttggcagcagtgaatgcctacattaaaaagaagaaagaccttaaataaacaacttaacattctacctcaaaaaactagaaaaagaaaaagaaactaagtccaaagttagcagaagaaaaaaagtaataaagctcacagcagaaataaatcaaatagaaactagaactatttaaaaatcaaaactaagagttgagtttttgaaaaaataaaattaacaaacttttagcttgaatcactaagaatttaaaaaaagacacgagataaaaaacgaaagtggaaacattacaataaatgcctcagaaataaaaaggacatgaaggactatcatgaaaaattatctgtaaacaaatttgatagcctaagagaaatggaaaattcctagaaacatacaaccttctaagattgaatcacaaagaaagagaaatcatgaacatacaaataacacataaagagattaatgtagtaattaaaaacctctcaacaaagtaaagcccaggaccagatgccttgatggttgaattctaccagacatttaaggaataattaatatccatcctattcatctattttaaaaaatagaagtagagaaaatacatacaaacccattttatgaggccactattatcctgatatgaaggccggaaaaatatagcacaggaaaggaaaacaacaggccaatacctctgatgaacatcgatgcaaaaatcttcaataaaatactagtaaaccaagttttacaactcatctaaaaagttatacattgtgactatgtgagattatccctggggagcaaggttggtttaacataggtaaattaaccaatgtgatacaccactttaacaatataaaagattaaaaaccacatgatcaggccagatgcggtggctcacacctgtattcccagcactttggaagccaaggcaggcagatcgctagagctcaggcattcaagaccagcctggacaatgtggtgaaaccctgtctctactaaaaatacaaaaattagccaggtgtggtggtgtggttcctgtggtcctggctacctgggaggctgagctgggaggatcacttgagcctgcagagtggaagttgcagtgagctaagatcacaccactataatccagcagcctgggtgacagagtcagcagaccctgtctaaaaaaaaaaaaaaaaatcattttaataaatgcagaaaaagcatttgacaaagtttgacatcgtttcatgataaaaactcacaaaaaataggcatcaaagaaaatttactcaacatattataagccatttatgaatagtctacatgacaatcaatgggagaaaaccagaagcttttctctagggtctggcttaaggcaaggatgcctactctcaccacttctattcaacacagtattggaagtaccagcaagaataaccagaaaagaaaaaaaaaaataaaaggtatccaaatataaactatcctatttgcaggtgacatgatcctttatgtagaaaaccctaaagacttcacaacaaactcttagaatggttttagtaaagttgcaggattaaaaaaatacaaaaatcaattgtatatctttacactaaatattacctgtccaaaaaagaaatcaagaaaataagcccatttataatagcattaaaaaaatacaatggttagaaataaattcaaccaaagaggtgaaagatctgtatactgaaaaccataaggtgaaataaattgaagaagatacaaataaaagatatgtcttgttcatatattgaaatattaataatgttaaaatttttatactcaaagcaatatacagattcaacacaatccctcttataatttcacttttcatggaaattggaaaattaattctaaaatttttatggaacaacaaaagtccctgaatagccaaagcagtcctgtaaaagaaaaacaaagttggaggcatcacacttcccgatttcaaattatattaccaagataaaaacaatatagtactaccatgaaaaccgacacatagactaatggaatagaatagggaggccagaaataaacccaggcatatatagtcaactaatttctgaaaggggaagaaaatacaatgaagaaaggagagtctcttcaataaatgatgttgggaaatctatatatccacatcaaaacaataaaatcagaaccttatcttacactacaaaatactcaactcaatatgaattaaagatctaaacacagagccgtaaaactcctagaagaatacatgtgaaaaagacttactaatattttcctttgcagtgatttttattattgttttttggctgagacatcaagcatgggcaacaaaagaaaaaataaacaagtgtcactacattaaacaaaaaaatttctgcccagcaaagaaaacaataaacagaatggaaaagcagactaaagattgggagaaaatatttgtgaaccatgtatctgataaggagttaatatccaaaatataaggaactcacaactcaataacaaaaatcaaataactcacttttaaaataggtgagagacctgaatagacatttctccaaggaggacataaaaatataaaacaggtatgtgaaaaggtgctcaacgtcattacgatatgcaaatcaaaactacgatgagatatcacctcacacctgttaggatggttattattaaaaggacaagacataaaaaatgttggcaagggtggtgagaaaggagaacagttatacgttgttagtgggaatgtaaattggtgtagctattatgacgaacagtatgaaagttcctcaaaaaattaaaaatacaactatcacatgtcccagcaatccctcttctgggtatacacccaaaggaaatgaaatcagtactttatcaagatacctgcattcccatgttcacttcagcattattcacaatagccaagataatggaaacaatctacgtgttcatcaacagatgaatggaaaagaaattgtggtgtatatacatatatgtgtgtgtacatatatacacatacatatatatacatatacgtacatatatacatatatatgtacgtagagatggggtatatacgtatacgtacatatatatacatatatatgtacacagtaaaatagtatacagtaaaatagtatacagccttcaaaaaaggagaccctgctatttgcaacaacatggatgaacctggagaacattatgctaagtgaaataagccaggcacagagaggcatacactgtatcactcttatatgtggaaactaaaaaacagtcaaatacatagaaacagagagaggaatgctggttaccaaagttggaaggtggggagaaatggggaggtgaaggtcaaagggtaaagagttgcagttgtgtaggataagtagagatctagtgtacagcataaggactactgtgaataatatttgtacatatactaaaaatttgctaggggagtagattttaggtgttcttaacaaaaaaaaagataactatgtgagacgacagatgtgtcaactggcttgacagtagtaatcatttcactgtgtctatgtgtatcaaaacatcatgtaaccttaaatatatacaatcagaaaaaaagaaaacaaaagcatatttatctctgagttgatagattacaagtcatattcaacacattatttgctattccaaatacaaacctagcatttttcgttgtgtcttattcacattgttcctttcaccttgcccatgactttctctactctgcagactctgaatgtcccaaacttaccttctgtccataaataattcaaatgccacctcctagattaagacttcattctttgaggtggaaggtaagggagaaatgtccctttgtgttccattatcattttgcatgtacatatacgtgaattctgttaaactgcaggctcttagggaagatatcactcataccagaaactttcctatcacctactctgatgaccttcatgtatgtagtaggttcacaggaaatgtcttatgtcagttttttcagttaacaaactaactaataaaatgtgagaattcaacctgagatcagtgagctttacttacttaaggaattctagttcaggatttatcaatcaaatatttaaaattctattagaattttccctcactcaaagtatgattcctatggatgaggggttgtttacccagcagactaagttttgcctacttattgggtcaattagttggcgaggatgaggcactcactttctgcacgttttatatccttaagggctgggtgccagtggctaatgccagtgatactagtactttaggaggccatggagggtggatcacttaaggtcagaagttcaagaccagcctggccaacatggtgaaaccccatctctactaaaaatacaaaaattagccagtcatggtggcatgcaccagtaatcccagctacttgggaggctaaggcaggagaatcacttgaatccaggaggcagcggttgcactgagctgagatctcactactgcactccaacctgggtgacggagaaagattctgtttaatggtgggctatgaagctctctgcacatgtgtttttctgtgatgctaagctcagctttttttttttttttaatcatttcctaacagtaagcaatagtggaaaaccccatttgtacccaccagtatgttccagctgcatgatctctgttgtcttgttctgaattcttaccctttcctataagtgaggccagaaggtttttgcagagaagctctgagcaagtgactgatgctagcaattcttatcagattcactcattgagggcaccatgtgggcaatggctgcagagcttttcagtgtgtttgcacttctagaatcagcaaacagatgagggaggagcccagaacagctggtggagaaaataagagcaggtgggttcagagaaaaagggttgtttttctttcaaaagctagtacattgcaggcatgctatgaagggattgtggagtgggaagtgactgcagccaagagactgctggaacaagaggcacaaagcttgggtatgaagcctgacttcactacttactaaatgggtgaccttggcttagtcacccaatgaggctaattctctatttccttaccgtaatcagaagaaattattgttctgtaggctttatagcaatgttcttaaacttaaaggggctagcggtcttgttaaatgtgaattctagctcagtaggtctgtgtggggcatttctaacaagattcgggtgatacagatgtgctggtttgtatcattttatataacaaggccacactagattgaagaggagactaaatgaggtaagggatagggaaaagctttataaactgtaatgcattttttttaaaagtgattttatgattagcaataataaaaacaggtgctttctatttagtacagcatttcctaggattgtttgccccccacactaccctgaagatctgaacttctttttaagggcttccccaccctcccccgcctctcagttagttctcaatatggttggttccagcccaagggctgacttctcctgctgacagaagcaatgggatcagcattttccagaaggcagcaggctaatgtggtgatttagcaatgcaatgattccccaaaggttactagaggggctctgaggaaccttgtagaaaaacacacagctctcttaaatgaaagatggtctgagtctacaacaactcttcgaaggtatacattagacttgcattgcttttggaaacagaatagaaagaatttcacttcttgcaaactactttgcatttcttgtctctcccatcagcaatctgaggctcttgcatcagaagagaaatgcacattctctaaggggaaattattgatactgtcccaaatttctgatatacaagggcactcactgaaggtcaactcccatccccagtttagtattcaggaggcacttattatttcaacctggcagaaggctcaaatgttacttgcctgaaggagctggttatggcagaaagcaccctataatagggagaaggtggactgactagtcccaggagtgttgccttgcatatctgagatttgactgtgacagaagccactggtcaggagacatgggccatgaagatggagatgtactgtggcctcaccaaagttcatctccaacattctcactttcactgacttcactggcttccttgatgctttgcaaatatgccaagcacacgactccttagaggacttgcatttgctgttccctccatctgaaatgctgctctcccaaatagaccattgtttgctcattgctgctcccttgcctaattcaagtgcttgtgcaaatgttgcctcttcagtgaggtctttcatgacctacctaagtaaaattctaaattaatccgctaatgtctcctaaaatcccctgtccccttgcctgatcttttttttttcatgatacttgccaacatctgacataaaatgttctatttatttgatagtctctctcccatcacagaaggtaaacttcataaactcagacaactctattggcttttgttcactgctctatataaagcagtgcttagcacacaataagtctcaagaaatattggtgaattaacaaatcaatattttaatgaattaactaatcaattaataagagggttattaaagtattgaatctcagataatgtgcatgctcatcaaaactatatactatatatgacctcctctaacaaagttgtttactcaaaaatgtattgttctggactaggagataaatgaagtcagtataaccaagttttgtttatgtagctgtataagtttatacaggccctttcctagcctcagtcttttatcacaaaatacaggaattacaccaggttctaagtcccttctaaacaccaatatcatataataccaaaaataagaatagcaatggctgtatacacaacaacaataataaaaatatttactgagtgttaatatgcgtcagacattatcctgaggacacagaagccataaaagtgagtaaacatagacttcattcaattccattaaaccttactcactgacagtgggaagaagacaaaatacaaaaatttaatgaatcattaaatattaatccaaattcatacactgagcagaaatgatgaatttttatattcctgtcagctttataatttacctttggttctctggagatgtgaaacagttagatacttgccaatgatggtcaaatagcaacagatcttcccccaaaaggtgagaatcacctccatttttcaaaaagaaaccacaaaataccagtgagaagaccttagttgtcaatacacctcaccctttcagagtgctcatcacattgttcacttccattttcagtattagtcccctttgaccctttcagaaaagttccgtatgttaatgctttaaagagagttatatgtcatgaaagagttgtcttccctctttctgtataaagatatgggtgataactttgtcttagccactaaaaacctgccatcagtgtttcccgataaatccttataacccatttgcagctttcagttttgtttttccttcttattcctggtttctagtcctcacctatctccaaataccagccatgtctttttcctggcttcaagttttacatctctcagaggagggtttgggcaacacatcatccatgccatttgcaactctttcattttgttataccttagtgttttctgcaacaaggaaatctctttaaacttatctactcttccctttcctacacgatttcaagtcatagaaaaggaatgagtcagtggtaatcatggctctcaaaaagctatacttgaaacatcagcaccactgctaggtgtgaaaaattccaagtaataactattcggtcatggtggggtgcaatatatccacgcctacacgcttatttctattttataaaagaagagcacaatgatctaggacacgttacaaatattgcataatttctaaatgcaaatcaatcaaaatcaacacatctgttcctcttcagccacactagcagaaagtcaccactctaacaaaataagccatcacctgcagtacttggaaagaggtgcatttctcaatttatcctgagcttgacctcccattccaattaattttgtgtagtcaactctaatgaaatattagatcactcagtaagtattcagaagtagtgcagagacatgcaaaagccctgatgtaaggcttgatgcaagatcttgatgtaagttctctctccagcactctctgagcttctagttcctcatctttaggaggaaggcctgagagacaatgtcccatgctggagtaagttatttcatcatacctaatcatttcattgtatccttctcttaagagatattaacagatgaaaactgcaattacccttgctgaatccctgagatgctcccatcacctctaacacaagatagaacccaaatctctcctttctaagtggaaagaaaaactacagtacttcttacaaaatcacttcagatgcctgagggtggtaattagcacgtttccagagctctctctttttcaggttaagcaacgtcagttctcttaacctgccattaaagtgctcattttatatacatactctgtctatttttatgagcttcttctaaactgcagtccaaaaatggacacaatgctttaacaatatccaagtaatataacatataaacaaagatcacattcataaaaccagaaaattgggcttttcttagaaaaaattaaattgtagccacagttattgaaatttaaggctcactatatttaatgtgttcatataaagtaaaattagaattttacttagcaataaaacaaatccaaataaagtcctgtcacatcataataaaaagatacatttcatttttaaagatttgtcactgaaactgaggcaaggatggaagcaataactctgaccaccatatctccttgttttatgtttaactacttaacatgtttgagcagatacattattaaaggcatttgaggccacaaaagagtcaaacttccttgaaatgttagtactgtacaatatgaaaaccagaaataaaattctaaggcctccaacaacttatagaacccttcttggctaaaagcattccaaataaacctggaactctagtttaggccatgatgggaagaggggggtcggacatgcctcattatacattgctcctttggaattcaggcacaactgaccagcattaacattcaaacagagatcttaagattgacaaaatagactctttgtagcaataaaattccaacatgactggtagcaggccctgaaagaaattgaagtatgttactccaaaatatatttttttgacatattttgaaatggccctgtaaagctgtctcttgtaaggaaatctacattatgtagagaatcctcttcccttttctgatcttttccctagtccaggagataattcactaagaggagtctggcacctttttaagtctgataaaagctcagatgcctggtacctggaggtttcatttgcatgataaaaccccttggtttccacaaccctttatcttaacccagacactccttgctattgattccaggtgttcagataataactgtttcaagcaattgtcaatcagaaaatctttgaatctacctatgacctgggagccctgcccctttgagttgtcctgtctttccagatggaaccaacatacatcttacaggtattgactgatgacatgtctccctaaaacgtataaaaccaagccgtagcccgaccactctgggcacatgttcttggtatctcctctggctatgtcatgggttatggtcctcatatttggctcagaataaatttaatcaaatattttacacagtgaaactcttttcatcaacaagcagtagtaactttaaacaccacattaattatttttcaaagaattcatgtaaaaatattgtgctgacagaaaaacagcaaccaagagaattttaggcacctcccatatcaaatgaagttctacttgctgcgatctttactctgactgtggtatagcggcaagaaaactggtctcagagaccataattatagtcctgattttgtgattgagcaagacacatcttttatgaaaataattttattttatgaaaaaaggcatattatattcattatctgtaaagttagattattttttaaattatatatttaaagtatacaacatgatgttttcatatatagtgaaatgattactacagtcaagccaattaccatttccatcatctcagatagcatttttttgtaagagcacctaaaatctgctcttagcaaattcccagtatataatacaatacaatgttattaacaatagccctcattctgtacattagatcttcaaacttattcatcctacataactgaaactttttaccctccctcccttagcacctcccaccacaactctaataacctggtaaccaccattctactgtctatttctatgtattcgactttttaaaaaatattccacgtataagtgagatcatgcatactttcctttctgtgtctggcttatttcccttaatgggatgatctccaagttcatccatgttgtcacaaatgtcaggctctcctttcttaaaggctgaattgtagtttattatatatataccacagtttcttcatccatttacctttctatggacacttaggttgtttccatatcttggctattgtggataattctaaagttaggtaatggaactaaggtttctcctagctttgtgatcacaaacaaatgtgctataagtgttagagaaattcaccttgaaaatatacatagaactaaatacctacattatgtaagttgaaaactttcttatagccttcttatttaaaaagagaatgactaatagggtaatattcatgcccaaatgtaaaaaggccaggcacagtggatcacgcctgtaatcccagcattttgggagaatgagggaggtagattgcttgagtccaggagtttaagatcagcctgggcaacatggcgaaaccctagctttgcaaaaatacaaaaattagccaggtatggtggcatgcacctgtggtcctagctactcgggaggctgaggtggcaggatcactagaacccgggaggaggagattgcagtgagctgagactgcaccactgcactccagcctgagcaagggaaacagggcaagactctgttaaaaaataaaaatttaaatttaaaaaaaactagtctaagtcattttaggcaaaactttcagaaattttaaagagttgattacatataactatccaccttaattatttaaataacaatatatgttattagtattttctctacattgctcaggctttgagagttgcaggagattccaaactgattaccaaaagatggtatttcgttctatacctgacaaagtctgtttaatatttaaataaaacggtacataagaaacacttataatctataaagcattttaaatatgctgtttttatattccctctatcttttcagcaaagttaatcccttatcctataattttggaattgtgttttatcttccttatacaggcataccttacagatatagtgggttgggttccggacaaccacaataaagtgaatattgcaataaagcaagtgacacaaattttttggctactagtgcatagaaaagttatatttacatgatactacagtctattaagtgtataagagcattatgtctaaaaaataatgtacacaccttaatttgaaaacacatcattgctaaaaaattgctaacaatcatctgagccttcagcaattcgtaatctttttgctggtgaagaatctggccttgatgctcatggctgctgattgatcatgatggtagttgctgaagattgggatggctttagcagttcctcaaaatgagacaacactcaagtttgtcacatcgattgactctccctttcacaaaagttttttatagaatatgatactgtttgatagcattttacccacagtagaacttctttcaaaactggagtaaatcctctcaaaccctgtgatatggtttggttctgtgtccccacccaaatctcatcagtaattttaatccccataatcttcacatgtcaagggagaaacctagtgggaggtgattggattgtagggacagtttttcctccatgctgttctcattatagtgagagagttctcaggagatctgatggttttataagtgtttgacagttcctcctacaggattgcatgactgtgcccagctaatttttaaaaatttttttgtagagacaaggtctcactgtgttgcccaggctggtctcaaactcctggactgaagcaatcctcttgtctttgcctcccaaagcactgggattatagacataagccaaagtcttgaaaccttcaaagttattcatgaggattgaaatcaactccttccaaactactgttaatgttgatactttggcctactcttacgaatcataaatattcttaatatcatctcaaatgatgactcctttccagaagatgttcaatttactttgcccagatccatcagaggaatcattatctacagcaagtaagccttatgaaatatatttcttaaataaaaagacttgaaagtcataattactctttgatccatagctatttgatccatagctataggatggctgttgatcattcatggatcataactgtttgatccatggctgcagaatggctgttgtgttagcaggcataaaaacaacattaatctccttgtatttctccatgagaagtcttggatgaccaggtgcattgtaaatgtgcagtaatattttaaaagaaatctttctttttctgggcagtaagtctcaatagtgggcttaaaatattcagtaagccatcctttaaacaaatggcctttcatcaaggatttgttgttccatttatagaacacaggcagagtatatttaacataattctcaagggccctactattttcagaatggtgcatgagcattggcttccatttaaagtcaccagctgcattagcccctaacaaaaaagtgagcctgtcctttgaagctttgaagccagacattgacttctttctcactatgaaagttgtagttggtattttcttcaatagaagactatgaagtctccattgaaaatctgctgtttagtgtagccacctttgtcaattatctcagctagatatttttgtataacttgctgcagcttctacattagcacttgcagcttttccttgtgcactatgttacaaagatggcttctttccttaaacctcatgaaccaccctctgctagtttctaacttttattgtgcagcttcctcatctctctcagccttcacagaattgaagagagagccttgctctgtattaggctttggcttaaggaaatgttgtgactgatttgatcttctatccagatcactacaactttctcatcagcaataaggctgtttcatttccttatccttcctgtgttcactggagtagcactttcaatttctttcaataatttttcctttacatacaccacttggctaactgtttagggcaagtggcccagctttcagcgtatttcagccttcaatatgccttcctcactaagtttaatcattactagcttttgattttaagtgagagacatgtgactcttcctttcacttgaacatttaagggccattttagggtgactaattggcttaattttaatatcttcgtgtctcaggaaataggcctgagaagagggagaaagatggggaacagacagtcagtcagaacacacacaagaattaacaggtgaaattctgtttgagaagtcaattatgtctacaacactggaaacagattttggtgtgatatattctctagtaactttaaatttgtttctcttccttcagcagtcagaacacatacaacatttatggattaagttgttgtcttatgtgggcatggcttgtggcactcccaaaacaattacaataatagcatcaaatattacagatcaccatgaaagttataataatagaataacttaaaagactgtaagaattaccaaaatgtgacacaaagacctgaagtgagcacgtgctttagaaaaatggtgccaatagacttgctcaactctcggtttccacagagcttcaatatgcgacgcatgcaacatctgcaaagtacaatgacacgaggcatccctgtataatttttaagccatgttgctttctacactagatcaaccatgtcttataataggaattatcttaactacagtgattaacatagtgcctgattctttacaattattcattttttggttaaatgaaggaaaacaaacaaatttaaagtaactagagaatatatcacaacagaatgtgctttaggtgctgtagacacaattggtttctcatacagaatttcatctgttaatccttagcctccctttaaatacacacattccttccaaatacaatacaaaaatgtagtgaataggagacttcattagttccttttcagtggttaaaagatgaagttttggcattttctttaaaataattcattgaaattatatattcaaaatatgtatattatttgggcccactattggtaagacttatgatttaataatctaaactcaatgatatccttaaataaataataatctcataatttaaactctaataatcacatgcttttataaactggaaaaaagtctctggatcatcttttctttcgcccacctcatattaccaatgacgtaacagaagcacatgaggcaaagcgactttgccaaggtcacgttaagtcaccgactgaccgccgaacagcacccggatgaattccagatcacccggctccccgcccagtgccacttccttcctttctgtcctctccaatttactcatctagaactaactgaccaagcagaaacaattgggagtagtcaggcctctattaataacaacttgcttgtcatatagtacaatatcgtttacaaagcacttcccaaatactttctctccttgaatccccgccgcaagaaccccagatgcaagatatttacctccgcttacaacacactaaggcctagaaagataaaatgaaatgtccaaggtcacagagctaaacttgaaccctgacctttttacaacatatctagttttctatacataaatccacagcaatttttgttacagagatagaatcaaagaaaaagaattattcactataatcccattaagccaagattctaaggcgacttcaccaatagatttgtgaagtgtttattaatatagaagatgatttcaaaagaatgttaatactaaccagatgaataacccatgcaaaagtaacagatgaattgttgaggaaaaggacaagacagtcacagaaatgaatgtccagaaaatggattcacacatcaaggacaagaaaggccttcattacccatttatttcagtttccgcttttgagttgaggaaactgaaacatctctaacctcaggcctcaagaagcagaaatcccaggttatcttcaacaacaaaggttgtaatagttgtagctccagaaatgccaccctttgaactgatgcagaagtctcttttttgggactcacaaaaggtcctgagaagtgcaatctcagtcactaatgccaggggtgtaactaatgacaaggctgtacttagaatgcaaggaggtgttcagagctggcttcatgggagctgaccgagaatggcacatccagtctttgtcaagaaggaagagaaccagaagacaggtcacaacacagatacacaaataataataaagaatcatgctgttccccattgttcaagaatgagaacaatagctgggtgcggtggctcacgcctgtaatcccagcactttgggaggctgaggcaaatgaatcacgaggtcaggagatcgagaccatcctggccaacatggtgaaaccccgtctctactaaaaacacaaaaattagctgggtgtggtggcaggtgcctgtaatcccagctactctggaggctgaggcaggagaatcgcttgaacttgggaggtggagattgcaataagccaagattgtgccactgcacactagcctgacaacaaagcgagactccttctcaaaaaaaaaaaaaaaaaagaatgagaacaacagagaatgttttcttttctttttctttctcatttttagaaacagcacaggaatttcttccaccaaggtgcaggagaaagtttttatgccgagccagatttcccagggatgaggattgatgattctcttccatggacaacaggaagttcagtcatatggaatagcatccattattattattatttatttatttatttatttttgagacggagtctcgctctgtcacccaggctggagtgctgtggcgcgatctcggctcactgcaagctccgcctcctgggttcactccattcttctgcctcagcctcccaagtagctgggactacaggcgcctgccaccacacccggccaattttttgtatttttagtagagacgggatttcaccgtgttagccaggttggtctcgatctcctgacctcgtgatccacccacctcggcctcccaaagtgctgggattacaggtgtgaactgccttgtccagccaataggatccgttatttagagggctctaacagcctagggtgagagatgaaaggcgtttcaaaagtgaaagaaggaaatcttgaagcatgtgtgttacatgtacatcatccctgagactttagctactttatgcctcagatataatgaaaagtgctataaaaattaaataaacaaagattttatgttaatatattgagggctttatagtactcactcaatttaccttctattgtatacttaacatgtgccaagtcactgaaattacaaagcagaatgacatagtccctatagaattaactcaatttaccttctattatatgcttaacatgtgccaagccactgaaattacaaagaagaagacagcccttgccttcatgaaattcacagcctagaaaacaagctaggacccaaggaactatagtatagcacagaaagaaatcaacactacaggagagatttgaaggaccagggaaagaaggacttcttaccagaagaggatcaagcaaaagctttattgagaaaattacaatctaagcatttgtggaaataaaaagttaatatactttgggaagatattataatatcacttgcaagatgtattgtgctttgaatgagtaatgtaattattgttaatattatattactgataaagaactgacaattgaacaatatatttttatagttcttagctttcccataatataccatttgctaatcattaattaagtcatgaaaccatacatttaacagaatacattacattcttaagtgttcactgaagacaacattgtctgcctctccaaaatgtttaaattatatgtttatacatctgttgtgtactttcaaggcaatgtaaacacagaaatgtctcaaaaatatattgcaaaatgacacaccgaagcttcatccagacaactatcccctgaatttgctggctgatttgaagttcaatcaatactaacctgtacaaataagaagagccctgttcttctagcttaagaatggtagccctgctttcaaaagaagcaatgaaaactccaagccattctctctttatggcattacatgaacgagtttggagtcctgtatctgtatccaaagtacagctccttcatttaagttactgttttgaaagaacttcttagaggtctttaaaatcagtatgtccagatctctgagactcagagctactgattaaaatttcagtcatatcaaaaaataattgggcttttgggtgggggctcaatataatttagtggaaagtatattactatgagactcaagaaacctaagtttcagtcttgacttcaccaggattgagccaggttttcccagataaaatgaagaagctgaaaatcactttcaaattctcttctgaccaagttaagactctattatggtgctgggaaattattaagttttccagttataaattggccaggggattgttctggaaaattattgcttgaatagtgagagttaagacacatttccaatcatgagttttgaagaccgacttaatcacttccaccccctagagcctccagcacttgttaatatctttatgatggcatttaccatattgcatcttgaacactggtgtctgtcttccgtgatagcatggaaggttcatgaggtcagtctcttattcattatcctgttttgccaactcatggcaatatgcatggctcaggctatgtgtccaatgtatgcttgaaaagtggaagaacagacaaatgagaatgtcaaaggtaactttaaaaacctgtctggagatgaccttggtaattttcttaagccagtaactttttaaagctatttgcatggtgttttctcaagggaagaataccttaatgacccttacgtctgacagcctacagtatattggataaactgagggagctggccagggcactgctgagaactccccaaaatgctacatcaagcacttctgagttgagagtatctttccatggggttatttagtatttttggatgtaagtatttagtatttaatattatttagtattttgtattttatcctttcaagtaaggataaaatattgaacactggcttttactttcattcctacttgaaacataattaaaagtacaataaatggatgcaggtgtgtttatatgttttgcataattctttaaagatggaacaaaagagagagaagaaaacaacaacaacaaaattttagaactggaaaaccagctggtgaagatatatttttcagatctgagaaagctgaggtcctaagtcagcagtggagaaagccaacaggcaactaacttggattgcacaatcttcaaaagtttagacagtggtagcaccagatttgtctagaagtgagctgaaggagaaaagggtaaattatgcaaaaatggtggaaaggttgtttttaggacggtattataacctcaaatcctctcccaaacatcaagcatctagccaactgctctccacaatcccaggagaagactagatatttattctttgtagtggatagagcagaaactctctgcatagtggacagagtgaataccacactgaaaatcaggagattaagtgaacatttctacggatttccaaaacccacaggaccctcacagccaggtctttcccattcaggcaagagaatggaagagtcttctttgaggaatcttggaaacgtaagaggtaagacctaaagatacggacctcaggagctccacagtgaaaagcccaccaacatcactctacaactaagatcattgacaacaagccccacccatgaacacagagcttccagtcacctttttagccccctacacccacttttaaatatgaacaggtaaccaaatataaaaatatcttcgggaaatctctaacatgaaagatagaaatgaaaacaaacaaaaagcttactggaaacagaggttatagagggagattaaaacttctttaaaaatgtaaatcccgtccgggagggaggtgggggccagcccctgcccggccagccgccccgtccgggagggaggtggggggcagcccccacccagccagccgccccatccgggaggtggggggcatctccgcccagccgccgtcccgtccgggaggtggggggcgcctctgcccggccgccccttctgggaagtgaggagcccctctgcccggccgccaccccgtctgggaggtgtacccaacagctcattgagaacgggccatgatgaagatggcggttttgtcgaatagaaaagggggaaatgtggggaaaagatagagaaatcagattgttgctgtgtctgtgtagaaagaagtagacataggagactccattttgttctgtactaagaaaaattcttctgccttgggatgctgttgatctatgaccttaccccccaacccggtgctctctgaaacatgtaccgtgtccactcagggttaaatggattaagggctgtgcaagatgtgctttgttaaacagatgcttgaaggcagcatgctccttaagagtcatcaccactccctaatctcaagtacccagggacacaaacactgcggaagttcccagggtcctctgcctaggaaaaccagagacctttgttcacttgtttatctgctgaccttccctccactattgtcctatgaccctgccaaatccccctctgcgagaaacacccaagaacgatcaaaaaaaaaaaaaaaaaaaaaatgtaaatcataattattctcagcaaagtattagaaaatatcgcatctgtgaaataagacggcataatataaaactgaacaattaaagaaaacagacaaataagcctcttggaaattaaaaatctgataccagaaattaaagaaaacatctaagaaaaagattaaaagataaacttgagcccataatctagaaaatagagaaaagacaaaagaggtagagaacaggaaataaaacatatgaaaaatagaaacctatgaaaaataatccaaaatataaacaagtaagatttccagaataccagaacaaaacaacaataacaaaaaaaagagagtaggagatcattaagaaaatattttcaaaaactaaattattttcaattttctagagattaaagaattaaagaaaaaaattctagaattaaagaagagtttccacagtaaatacacagcataatgagtgaaaatgaaactataagaaggcaaattactatcaattttcaaaacactgagaaaaaagaatagacactaaaagttttcagagaaaaaaaaatcaagcatgtacaaaaaataagaaatcagaatgttagaatgatatcagaccagaacaacaaaactggcagaaaaaaagatgttgtaatggtgtaatttaagttctgaagaaaacttattttaaatctagaattctatacctaaccacacgattgttcaaatatgaggaaaaatgaagatattttccgatatgaaaaggctcagaaattttactgtgtatccttttttttttaggaagctgttggagaatgtattccaccaaaataagagagtgaactaatacagaggatgcaggagaacaagagatccaagcagagacctgcaaaaattttctagggtgatggaaaaagagaccctgggaccaaagcaatgcacagaaaaagggtgcacatagcacccagtcatcaggttctgagggatattacttcacgatgaaattgatagaatatctgtgcatctgagtgtcttcagatgagattcagataactggcagggacttggagttaaatatagtacaaagtatgtagaaagctgggcacgtaaaaacaagacagttatcaaccacagaaaaaaaacaaaatcttatgacaaaagtaatcatagtttaatttgtcttagtcatgaaagtatttacataatcataatcatgcaactactaaatactgatctaacaaaaataacaatgtaacagccttggaaagatggtgagatggaaaggaggcatgttgtggtaagaatgtgataaagggagagacttgaaagctatttccttggtgggacgctgagaaattaagaggtagtaagaagagaatattgtttagcatatgaaggtaaatatcaacaagagtcgaaagtgattgtagaggaaaaaatgggagagaggacaagaaagtactatatttcacaatatactttgtataactgtgacaaaaatagcaagtaaaaacagaaaaagaaagaagaaatcacctcaaatgttatgcatgagagattgtttttatactgcttttgctctaaaagcatttctgatggaattgagtatcacaggagattgcagtgtgttccccaacatcctcccatctttactaagacacgattcactggggtcagttgagattaaaagaggttgctcagagacaagacaaggctgtcgttgccatctgtctaactgcaccttatggttattagatgaaaatcatctgctgaccttcatcttcaaaatcttgttcataaatcttttaccaatcaagctgagaccttccctgtacaaggtgctttctagacttcaaccattgatcacgatgatgcagtttggtatgatgtgtcttcctggagcagttttaagtgtttgattcaaaagtgaaatctttgtggagctgccatactttacagcactacactgagctacaactaaaggcacacattgcaagtgtggtgcttgaatttcatttaaacaattaagcaaactcgaatccatcagactcagcaaaaccccatggcgatgatttcgtaccagagcagttctgagatacttaaaataataatatctacattttattgaatgcttattatatgccaggtagtgtggtaaatacttacactatcttatttagtagtaaaaacaactctataaatagctactattattatctccattatatagataaggaaatccaggattatggagattaggacccttgcccaatgtctttggctaggaattaggaaaacaaaaatcaagaccagaattggattcagaaactgttcttttagaactctgtcttcgctaaggaagggtcatcataatatcaaaaatatgccattgaaagtgatgggtgagtttggagacaaacatatttctgaagtgagtcttcatatatttaagcatagatgagtttgagaaaattcatatagcacagttgcaaaatgcacgtatattagtacttgcatagtttttagtctgttataattctgagtcttatttatagatcttaaggaaataatttttttttttttttttttttttgagacggaatctcgctctgtcgcccaggctggagtgcagcggcgcaatctcggctcactgcaagctccgcctcccgggttcacgccattctcctgcctcagcctcccgagtagctgggactacaggcgcccgccactacgtccggctaattttttgtatttttagtagagacggggtttcatcgttttagccgggatggtctcgatctcctgacctcgtgatccgcccgcctcggcctcccaaagtgctgggattacaggcgtgagccaccgcgcccggccaaggaaataatttttaagcctgacacttttcgaaaggttattttcaaaaggaactttaccctagaatactagtctataagtttcaacgctagaattttagagagttgagagccaaaagtgaacagaaatgaaactcattgttccattaagcaagagaagtgtgttagcagcagagactggcaaaaatcagagtgaaatactgggtcactgcatttcttctggccctgacagtgttcttgtacgtatatcttgctttgcacagtagatgtgttcttgaaaagctagtgaataattaaagctttgtaagtagaattgtattctagaagacctaggaatctaattttttaaagatgattacagtagtcaatgtttttgaaatgtaaatgaaatcatcacctacattacataatttgtaacaggcttccacaatttgcttccaacctttcttccttatatgattcatcatctactgtgtcctgtcccaacccttacatggttcatgaggaaagagtgtcagtactatattcagcacctaaaacagtgtccagcacaataaatggacactggatgaatgaactaagcaatccattaatcttctcctggctactacatgtatatcaatgtctctctacctttgcatataatatttcatcagcctagaatgattttccaatgttttcattttatcccttctgcaagagtgagttcaaatgccaactccttcctagatgtcaaattcctctctatattcccaaaagattacatttagatatttagtgtaataggggataattgaaaccttgtcttagtccttggttcctagcctctaatgcctagccagagcaatccacacagacaatgtgatggtaaaagtaaatttaatctaaattttcacatgtattgccagctgtcagttcttcctaggtttctctttatgcatatcttcaaaagctaatttgtgaggtgttcttgaggtcagtaactgcatggtttttcatgtctagccccagtaacaagcaatgtgcatggcacagataaatggatacgtccaagcatggatccttgtattaattaattaaccagtgtggttgtggataatgctgggctaattgtctatacgtgatatcactgactcttttaagctatggaattccctcatgagaatgctatccctgatcccttattctgatatttctgaataaccagcaaaatacacatctatttctagattgaattcccaagtgcaagagaatcttagactagattgtctacaccaggttttctcaaagatctagactagcagcatcaacaccttctgggaacttgtagaaaagtaaactcaaaagcccgggctaaccctgggttcactgaatcagaaaccctaggggtggggcccagtgatctgtgtttttgtacacacttaagttggaaaactggtcagaaagttgtccttacgattctgacataaacaatgcaatgtttcctggacccagccaacaacgtcaacatccctgttaaaatagtcaggttctttcttctgaagaaattagacttcattgtaagccagataatgggaaaaaaatagtaaaactatgatttaaaaaatcagtataggaatcaattgatgtcactgccactcagtttttattgcataatttaaaacgagtatatcttaactacattgttttaaactgcataccacagctgcatggcattctctggttccaaacagataaaaatgagcaaaataaaactaggtaagatgaagaggaatcttagggattttaaggaaagaatccagccccatacagaagcagaggaagtagtaagcctaagggtcaaatgctaacaacaagaataacaacagtagcagctgtaattattaagtactaattttaagcttggttctttatatatattttcctcgtttgtctcattaacctagaaagagcgtcattgtacaaattaggaagcaaggatacagaaatatatcttacccaagttacagagactaaaaagttgttagttgtgtgtttgatttcaagtcttacgatctttctaccacaccactgagctgcccaggtaaacagaacagttattcaatgtgagggttagaaaaagaagctgcaacccaatgcttaattaagcccctaggggtggaagccaacttaaggcacataagagcagtgggttctttcttgaacccacctgataacaggcaggaaggcccagtgattcctcaagtctgtatcttattggcccagggcttgagtgagactaagcctgcagagattgggtattctgaaggttaataaaatctgtacatacacagtgggactagtttttcagtaacaaaggaaggttgattggcttataagactatactaaagtatgccttgggtgttaagtagtggttaagctcatagactctgaagccagtctgcaacttactagctgtgtgacctgggcaaattacttaacatctctatgcttgacttttctcatccctgaaatagggatgacaatagtgcctgcctcattgggtttttatgaggcttaagtgagtcaatatatgtaaagtacagtgcctaaacatagtaaaagctgcaaaagcattatttcaaaagactcagttatctttccaaatgtcctttcaatgtttgacatgaataaagcatgaaagcatgaagaataaagagcttttttaagtttagctggatctgtttaagtttataactgaacccaacacctattacagtttttttccccataaagcatagaaagaaaatctgctttatgggaaaaaaactgtaataaaatatgtgaaaaaggataaaactccacttataattcaatcgtcattatccaaatattgtcactttttgcataatacaatctactatttgccaatgaccaaattttacattataattagtgcatatatccacatgtactatttttataattaccattatgtcataaacacttctgattataacccatgttcataaacatgttaatggctgttagatatttccctttcttttattcttcgcataatcaagaaattcagtttattaaccatgaaacccttagaccttggatagctttcatctggtggtagaaaatgcttcttctatctaaaatgatcagtagccaatcaaacattggaagacatagttattggtttttaaattgtttgaaggcaatgaaggattgagtgcaattgttttttagtaatatattactaatgattgagaactaaagaaaatcagacttcctatcaataatgtcagtaaaacactcagcccttggactgtttgtcattattctgttagtctttcttttttttttttttttttttttttagcaagaaggtgctggttagggctggcagagagaagaaaaccatatccaccaaatcaacttcacatatgactgttgtataaataaactcatcttaattgtaaagaggacacatatgagggtgaagaaaagacgttataaaaacataatgtacaatctgctaagcaaaaatgccatcaagttcgccaaaagagataggagagaacaagcagctgatcataaatctttaaacagaatgtatccactgtagttcctatataaacacttcacaaatgctggttctttcaatcccagaagtgaaaagaatcttgcctctaatccactcttgttttgcagatgaagaacaaggccatagaaagaaagccacgagctcaaactgaagatggggcgggaattaggattcaaatccaggtctccggatccccaagacagcgtcttttccacaaggccactgcagccatccatcaatttagacatgaacctgttacctatgtggtcacaatcatgccatatacaaactttagccaagtagcacttttttcctcttagtgctttctcactcagaatcaaattaattcctcaataaagttataaatccaacaacttcagttgcacaattcacagcattaaaaagctagctcaaacccacactgagtccttaaaatttgatgtggtaattatgatcaccctgtttattttctgtagaagttaagcctaaagaggatcaagaaagaatacaaacaagcttaaaataacaatttctttgtaacaagaaaataaaaatcaataatgggcaaaccgagttaaaaaaaaaaaagagagagaggtttagtacactgaggttcatccatggaatagaagaacgagaacctgatcccagatcttctagcatttaatagattagattagaataatctaagtagtctgttagattaatacattagaatattagttatatttcattggaacatgcaccatgtgtattttatgcctcagtgtatcaccagagtatacaatgtcataattccaccagtgtgcatactacagttagaaaagctcagccttagaacagctaacaaacagcaggttctaaggaaatactgcttattgaatcaatcaaccaatggtctcattttaaaagactggcactgattggtctgtgctattgctttagttgtctccttcatgtttacgttattgttattgagggtcttgctatatttgcataatcgtttgttttttatgctgatgcaaatcaaagcccatagtaaaaaagtactcatttcatctcatgttaagttatttgtaggcttgaaaataaagagtgatttacatgaaaacctttatcttgatacatagcaaatatttctcttttaaatcccagaagaaagaagtaaaccaaattcaattttaaatagtgctagaaatgttgaacatgttttgaaatgaaggaaaagcctttagataaaatgtgtaaatagtctaattttaaattttccagatttaaacaattagaatgatcatataataaatcttatataatagtcttgtttgtagagtatctaaccccaatttattataatatgtgaaagagactaagggcaaaaaaaaaaaaaaaaaagaaaaacaagaaaaacaacccaacacattttgaagcaggaagcatatctagatttttcagttcccaagtatctgaaaagaaatttcccaaattacctgtgttgaggtttgttcaatctgttagagtgctatcagtactggaggattcgaggaaaacctgtttcacgtgggtgataattgtagaagtgaatgaggtagggagagattggcattgctgcctcttcctgcctgcttggtaaaggactctttggtgcatttagttatcttctgaacagcctctgaaagtttctggattctttttctgcagtctagtccctttgggttgcttctcaggctaatggccaatccacaaacaagaaagaaacaaaaacctaaccacagaatggcagcatgcctttacttctatcacgtagtttaaagtcccactttcaattatgtgtgctttttcaatcattagtaatggggcttgtttcaggtaaaaagccaggcagagtatgcgctaaagaaaaaagaaaagatctgtgaaggggcaacaggtgtcctttgggacttctgcctaggtgccatcagcagcatcgcagcagttaaataccacggcctccctgggtgggagtctcacattcccaaagacaaggagacagagactatttcaaaaagtaactggagagatgagaaagctaaaattagaactattgacatagatccttaaaaaatcctaccgtgctctgcatgcaaggatgctaataaggagatgaggaagatgatgctggggaaaatggcatgtcatcttagcctcaaactcttgccatctattttgcatatctattttcaatcccaagtctgtagtacagaaatgaaatctctcttctacacacactctcttaacactaaagagggtggtaataaaagacaaggcccaggcagtagaagtcctatagtgctcctgataaagaacacatgtatgtgttatagtttcctagtaaccatcttggagcttatcgatggattcataattgaggacatacatcatcacctgagtgtttcttaaatatctgacttgcaggtattacaggatgtctggtggttctgagatgtaccccgattaagaccattgttagtggccagaatttacacagtttatgttttaaacccatccaaggtgtaatacttgactcaatatatctccatccccaaacccataagatgtagagacaaattcaggtgttggagacgttactattaaaactgtagaataagcacacaagaaatcccttttggtaaagtgaagtttttgtgggagttaatgaagggtgatttattgagtgtcgtgcagtatacttgctgctaaaactacaaaaatggcagaggaccaatttctaccatccaggatctcacagtctagtgtaaagagagatacagctaaaaatgatgaaagtcagattataattctaaagagttctaaatactttattagcatgagttttatttcataatcatgatattatggtacagcacttgggatgggtataagaatttttattttgcagagaaacagaggtaagatgagttgcctaagtcatttagtctttatgatcctttgttttgttatctataaaataaagttaaaatgccaaatcacagggttttaagggagattgtatatattaaaagccttttgaaaaagtacaaagtgtttcacgaacgttatttatgggtgtaaatatgtgacaaatcaggaaacccaatattaagagatgcaataaaccattattggtcaatcagtagcacaaaacaccaaacctaataaggttggtacttcaaaaacttaaaagcacaaaagaaaaaggataagggaatggcaagtaggttggcctcccccagacctattactgagggtaacaagcctcataataacctaaagcaagaaacaggttaggcaggtagctagtcaggtggaatagcttttatagtagatacatagcttgagttcaaatgttctcccacacaataattttgtttaaataaaccaaaggggaaacaaaaggcaggaattattgctgtggaatgttaagtgcctctttggagctcattaatcactgtaagactttatattctagcctcccggataacctactagaactctgaaagatgaatggagaagacacataaaatgctagaaatcaacagctcttgatcctgttcatatatccctacattgtaagcttttagagggcaagtcaataaactatttatacctctgtcccccacatttaataatgtgcctggaacaatgtggcaactcggtattttaaattaaatgaactggaccccctttgatatttaagaatcttgagacccaaagaggaaaagatttgtccaaatttacaccatgacaggtggagtaagaaactgtatttcctacactcagtgactatacatcatgattttactgaattatgttttacttatctcactatactggctcagtcttttattattgttgttgttattgtttaaccacaaaatggctcttcttaaaatcgctttccagttctgatatactaatgattgcatagacatttcctttctctgctgcagagtaaatcatcctggcttcagagaaatgactgttctataccttaagtgtgttggttcatggccctgactgaactctgatggctggtatgaaatctagaacaaagaattgaatcttccttggaaatacatgtgcaggtctctcttgagagagtgggtcaaattactcccttccatgttctggaatcacactgatgtttctgggagccctcctggtagctaagtttcccacacttctcccaacttacaatcttctggatccatgaagttggcctaaaaaaactaattaaggctatccaacgcatataattcgaatccctactatgcaaacttaaatattctacctgagatagacacttaggtggttgctggaatgttaaaggctcagattttgcccacgagaaggttaatatattagtgaagatagaagagtgaaattgtcaagttcagagattgcatcttagttttctttcacattctcagaaataagcacattgggtacatatcagatgctcaataaatatttgtttaaataaaaagcacaaaaattacaatgttgactgtaagaaacgcagtatgtgagggacaaacgagtacttaggtcataggaatctcaaaagggttgaacagagaggtatgacaatagaaaaggataaaactatattcactctgtttagaagtgccttgatttaagtagtcaaatatcatcacattaccatgagttaacagcagactttgtcaggagcttaaaatgaatgtagagaataaatatttagggtaattgggggttgaaagtaagtgattggaggatgagcagcaagggtatttaaaagtaagtttgttttctgatctaactatgagttagatcacgcagtttctttttcatttcatttttgttgtatccaaaaacaaccagaagacctagaacatgatcacatatccatgagccttcataatgattagacagataatatcaaatcttctctactgaggtgcctggagtggtgtcattcattctcaggtgcaatcagttccctgagatctacaccagtgcttcttaaatgttaaagtgcatagaaatgaccattagattttgttgaaatccagatttgatttggtagatgtggtgtagggactgagattctgcatttctaacaagctcccaggtgatgcaaatgctgctggtctgtggaccaccagcagtaatgccctacatcagtggttaactctggccatccattagcatcacttgggagccatttaaaactacttatgcccagatcccaccccagaactaattaaactcacattattaggggtatggcctaagcatctttacatttgaaaagctctacaggtgtttctataggtagtatgccagcttgaggctggaaatctacctagacaaagaaaaatgtgatataggtgggggtcagtgggaggtgagagtgtgtgtgtgtgtgtgagagagagagagagaggagaggagaggagaggagaggaaaggggaggggagaataggggagaaaggagggaagaggaaaggaggggaggggaggagaggaaggaggggaggggaggagaggaagggagggagggggaaggaagaaagggaggaagggaaaagggagggagaaagggaggaagggaaagggagggaagagggaaagaaggaaggaagaaaggaaggaaggaagaaaggaaggaaggaaagaaggaaggaaggaaggaggaaaggaaggaaaaagcctgtttcctcactccaaatcatgcttctcaaacattaatgtgcatacaaattgcctaggtactttgtcaaaattctaattctgactcaatagacctggagtaaatatggagattctgcagttctaaaaaatttgtctgcaaaccacattttgactatcaagagtctaaatcagtggtttccaaacactgctgtacatagggacctctaaaggaaacatatatgcttttttcttccaccccaatattctaatttcattggtatgcggtgccatctcaggatgagtatgttcagaaagtatgtcaggtgattctagtgtgcagcaaactttgtgaaccactcctctaaatactaaacattttaactcatttaagaatctcaagcccttaagatacgcaaggcacaaattccgtcagagctgctcggactgcgtaccaacccaaatctttgagacaatgttaagtacatggtgcacaaaaatcgctgaaattagatcatgaattgaacctcaggtcaactgatgtattttcctctcttctttaccctgtatgacagggagtgatgcaaagttgtaaataaggaagcaaaaataaattgatcttatttgtaaatagctgaagttcaactttctggatgctggacaaatgctctaagaaaggctgtcaaatgctagaggtaatgtgaaagttgtcaagtgttggcgatgggattcaagattaaacaggccattagatctgggtatgggatagagaactcttgaaccctcaactgagtcacgcaatatgactctatctttaaagagtttctactagaaaagtattatatatacatacatttgagaatgtcttcctagaattagatttgaatctgttgggggaagaagtttgtacacggcagcataaaatgtgaaagatgcaccaattacagtattgcacaaatacacatttctcttaatacactctttttggctggaataaaaatttcaagttagctaccatcgttagctgtgccatttgcaccaacttagaaagtgaggccaatgtataagtaattagccatttttaatctgattgccaagcagctaacacagcttcattaagaaagtccaggaactaacatgcataaagactttcatcatgttttttttttttttcagaggcaattatgggacctctgcaaaatgaccacaatgttggcctacagcaaaagtcttcgttgcctttggatcagtgctgtgattcactatatcattgctgtctggattgacatagaacttctgaactgattcttttcggatgtatttctgagattctttctcctttctgaattcaaaagactgaaagaacagctagaactctactgttagcaatatgatcattaaaccacctggaatgctaagtgacacgtagcatgttttatgggcaacgaaggaaaataaaagattactgccgagagatatagcctctttttatgattgaacaggaattagtatacacattggaggcaaaactgttaccaagaacctttgtcaaataactaaatttagtgaccaaataccaggtgtcatctaagcaagaaaaactgtttcatagtaaaatgatattctttttctgttgttaaccttatgtcccagaaatacttagtcagctagaatattacaaacctttatatgttaaggactgcctttttattttaaaatggagtataatagagttaataatatatgcctcaaatatacttatagacatggattctctcatatgtgtacatcattgtcagacgtggagatgcccatcaatgtatcataagaataatctgcctgaactgaaaattgcctgctagtcttaatccatgttgattcagctctttttatactataaatgcttgcctaggttcaaatactttaaatctaccaattaaatacttaaaacactttattgaacatagaactgctatcattcaacactccagtttcattaatcagcccagaaataggtaactcaccaccattccctgatcctaagtacattaccacagtgactgacattcctggtttaaaaataaaatcttgtttcaaatatagcttcccgagttctgggtaatgaatatagtttcataaaagttgacatcatttcttctgatttcgccagaattaaatacatccagtatgcctcctggatatctgaccaccatatcactcaaggctctcacaacctggtgggcgttttaaggagaaggagaaacagacctgcatagatggggttaaatccaaaagatatctaatcttgtggttagaatagtcgttgtgtttatgtgtgttcaatatgccattcagaagttgatttttacagttcatttatcagttggcatgcatacattatgcagatttgcttatgaggagaacattaatatgtacatgtccagaactagtaaatgcattatgcttggaagccaagcagtactcccatacactgttcttcttagaggtcagttctaacgcatgctgttccaaatagacccaatttctctgctgatatatattcaaaatgcagtaggatgtggtcatacacacccagaaataccatcttcatgaggtgggggtggtgaaattcaaacattttttttttagcaatgcattattggatatcaggtacaaacgtgcctgtcagcaattctaaagcaaatgaaatagatttatttgagtccatccattatacagaaaagatattgctttactaacacatacctcctcctcctcctccattttggggggactctccccacctccccccaaaaaactcatcacagttcactacgcaactgatggagtattaaacactgtcttccaagctgtgggagttaaaaagaagtcgccttcctgccacacttccccagtgctgcaatggacatagcatctcctcctctatcgacctagtatgatgctcgctccccaagcactgcagtcccctcgccgaggattgccttggccacacgcacatgcagcgggaagtcccccgatagggacaaccacatacctttgctctccatttcggtccctttcgagtgctgggaagttcaatggaagttggccggaagatgtgggcccgcttcagattcccaaatctgggaagccaatctgatgatttcgcccgtacttccttccttcccctcaggcttcctgaaagatgggatttcttaaaccttgaagctgcaatcagccaccaaaggacacttaggagcagcagcagattgcctctacaggggatacgttgcgacgcgcatctgatactgaaatgcatgcacagtgcccgctcagatttttttttttttttttttacctgggtctggaagctgcaggcaggagctgtcctccgagcgtggtgctgcaggtgtagtgacagatcatcccactttgctctctggatgcacagcagatttgcatgggcgctggcac

SEQ ID NO: 2013 - DNA, 83689 bp, Homo sapiens
tctatgagtgtaccaccattggaagaaagtgagcagaggtgtttttccttcgtgttttctgtcctctccttggagctccttttccattcaatgccacatacatttgcctcccattatgctgccagttaaatgatgcataggtattgtatccattttcctctatcctctccttcagcttacagtcattgttaaattctttctgcaaaggaaaaacagaatcttttattcctatggtgattgtacttgatttcatttgatacaagccatccagagaactccagtccaaggattctgtttgtagttgccatttgtacctaagttgtgcacttaatacataatgtcaacaatagaaaagtaaatctcagaaccacaaaacacattctgtttgaaagcacatgatacattttaattgatcatcatagccactttttgaaagcccttttaaaaagctgatgtgctttgaatattatatggtttaagtgcctagagtgattgtcaagaagtagacatctcactaacaatatttgtgatgagtcagtaataaagaatagtgttataatgcttcttttacagtaataaccaggggccccatgggaaaaaatagaactgaaggaaagatatgggcttgtcaagtttgcaaactttacctacaaatccataataaatacacacacacattcataagaaagcagagcttatagcaaaaccacaatagttctgcataaccaaaagggggggatgtctttcttccaaatatcaaatttcttaatttaatgaaattatttgcaatattctatagcttggaattttgacagattttgctcgtgaactctagggattgaaaactaggacatggaattcctcgttttgtgaactactatgttgaagaaattatgagcatggtgaatagcaatgcctacattgtatcttaaggacttggatcctgggaagttccatcccatagccatagagctttggttttgttcaggaggccaattggatttaaggagacattcctggacaaggcttcgctctcactcactccacaaatccaggttcttactctggagttaataacaaagaggaagtagctcaatgatctcaagactctggctttagaagtagcctccgcagtgcctcacgcctgtaatcccagcactttgggaggctgaggcaggcgaatcacaaggtcaggagttcaagaccagcctggccaacatggtgaaaccccgtctatactaaaaatagaaaaaattagccaggcgtattggtgggcgcctgtaatctcagctactcggcaggctgaggcaggagagtagtttgaagctgggatgcggaggttgcagtgagccgagatcattccactgcactgcagcctgggcaacagaacgagactccgtctcaaaacaaaacaaaacaaaaacaaacagaaaaagagaagtagcttcttttcttatactcaaactaaagtagttaagaagctaaggaattggagcacttgccctctggttctatcttcttcatccaaagcaagggccccgtgggcatagttcagttgaggactgtacttggcagtttctctcaccttgagactttttgaaatttctacaaaattccaaattcctgaaaatgtatatgtttatatacctaggtgtctgtaggatttatcacagtttagaacattatcagaaccataagaagcagatgtattctatgttaatgctaccagctcaagttatctgtcctgaaattttttagtcttaaatgcttctcttctataaagtaatatttaaatataacattcaaatgatgatttaactggctgaaagtaagaaggaaaggtaaattatttaaggtaaggattttgataaaacaaaaataattctgtatttgaaaggaatataaatccttagtgtggatttacttttattctctttatctcagtctgtctaaaactatatacttttcaaagcagagtaatttttaaaatatggataattatgttcatttcaatcaataaatggggtacagtttagagactaatgaaggactgagattgtttgaggtgatttcatatttcagatgaagctaggtatacaaaagtgggagtgtatgcttaatgttaattttcctccccaaaattaatttatagagtaatgtttcttaaattgaagtgcacatgtatcagcctttttatttcagatgttttaaatatttgggccaaaggtaccaaatctctagaggaggggcctcaaaatatatgttgttgacaggatctaagcaaatcataagcagttatgtataaaaagaaaattcaggctacagcaaggactcaaaagcagggttcagggagtttttttaaaagaagtttggattttttccagctacctgaaaattttctttggtccttaaatcatgctctatgaagacctattctatttaattcagttttatactttatttactgaatcccatcagtcaggagaaaactcaaaatacaatagataaattgcttagagaatgaataatgaaaatataagaaaggtatacagtttccaaaaaggaatagaggaagataattcaagagaatagatataaaactggtttaatcagtcagtctgaatctttgcccaagtcagatttttaggagggcttacggaattgatggatactgtatgaaacaaaaaatgaaggtaggaattacaagagttgtcacctaatatacagaattatattagatatgcacttataaattttgatgttagttctattccactctgagcagaatattgaacttgaataaatttttcgtttaatttgaacaaaccataatttttcattattcctagtagaaatgtaaagttacacaaaaaagaatgttatggttagagaatgagtttctttctgagacaggctggaagtggaaagtatgttctgtaattggctgagcttctaccagaggttaggtttatgcagtgtataactgtgctctgtatggttctaagtgctgaacaaatagtgggggacaagactgacctcactctctccaaggtcacaatctattgggagaagacagtgaacaacaaacacattaatgagagaaatctcagataagtgccactgcagataatagaaagccaccggactctactttaaataaagaatttgaatgaaataattcacagagcttagagctcaagatgaagcataagcacagtccatgagctgtgttggggcagaagaaaaaaagaggagaaatgtgaagaaaagtattaaatatttttatgtcagagtttatttgaaagttatccatttctccttgatgtcatgtttttaaataagtatattttatcaattaaaagtatttaaaatcttttatattcattaaaattatttacattttcttccttaatctaaattagtgttagctggctttaggacgttgggtctagactaagtatgtgtgttgttatctcttcaaagaatatgtacctggttctcttccccaataattctgatatagtagatcaaggaagaacctggacatgtttaatgaaaacattaaacatgcctcaaaagagattatgatgtgaacccctaaatggaaccactttttataatggtctgttattcctctgggttcattaggggagcaatggtaatggagaaattttactaaaattcctctgacccccatgcaaaaaaaagcatttgccctagtcccagggaccaactcaaagcatgcctgactccccagttaaaagtggacctgatattagtaaaatacaaggctactctacatccagaccagcggttctcaaattgtggttactgcaccagcagcatcaggaacacctgggaccatgtgagaaatggaaattgaactgcaccacagacttattgaatcagaaaatatggctgtgggtcccattattctgtcttttaataagcccttccactgattctgatgcatactcaagtttaagagctgctggttctaaatggtcactaaatggttctaaatggttctctcagccttatgctaatcaacaaagtaagtttatttacaaatttaaagtgaaattcctttttgattacataaaaatgtaaaaatgacacaggatctgtttacaaaagtaaaaattatttaaaagatttgtgtcacaggttttatttctggccatatataatattacatgtcctccaaaaaattaaattaaaatttttccaagtttatagttgccttcaatacactccccttcagtagaatccagagaaaaaaatgaaattcagttagcatccccttgatctgtctctgggagggacacaataagatggatccacatgcacaaactaatatactcctgtcatcattcaaatgacagctaagagattgaaacctagttcccaactttattatagggctgctttgctatagctgatcctttcatacatgtaacaaccaatcatgctgtaattatttcatatttgttaacatttcccctaaatatattataaattatttgaagtcaaggcccatttctatacttctttcttatgcatctttgatatgtcaaacaatatctggcatatagtagatgttgatatgattgattgatgcatttttttctaaggacttgagcaggataaattgtctcactgcttgtaatttaattattattacaattgcaattataaaacaactatttggcattttaagtgagatcttaaatttctaagaaattggtttaaaagagtttgatccaagattgcagaagtggtattccaaatacttaacacctggtatggaatataggcatggatgtgcccaaagcactgcagggatacctgctccacaaggaccctattgcaaagaatatttcccacatatatatatatgattttgaggcataatttgaattaaaggttattgtctaggtaaataaaattctagagttgattgaacaacaagcaaaatggtgtttcttgacacatttccccatttcagattttaacaaaatgcaaaacatctgagcccttgtttcatcttcagccgtaacgcatatataatacatgggtttctactcaattcaagatctttgtttttagtgttttttctccaagttgtcttcattttccatgccaatctgaccggatgcttccgtgagagcctgacttggttagcagtttagaacattcacagacaaatgccagcagcagcctgtgtggtagactaatgggtgaacaacagaggagattacagaattggaagagctgctttgccagcccttgaaacagtggtgactaacccactgtggctctatttactagcaatagaaggataacaaagctattcggtgtctggaggaaactttccaaaactatggtaatggtttactggagtggatttgaaaacaaaagcagaatacttactgagccatagagtttccccttcttgttcatggctaagtaatagttgctgttaatggctttgacggcaacaactccgatttctactgatgttatctccaggatgcctaaaacatacaattttaaaaggctaaataaagaatcctaaatatatttggaagaaaagtaaaatcaaaagaaactattgagttgttttttgtgtggttctaaaaacaaaaggcacaaaacattggtaaacaaacaagcaaacaagcaaatctttttcaatgtgtcttaaaacccggcaagtatttccagcaaatatatagaaaaaagtaataaggctttaaaagaattccccttcattttactctgagcatacatagaaaatattgttttaattaaaatgcttcctttgctaactctgcattttcaaccctataaatattgaaacaactctactcatcttagcctagatttcaaaataacttatcagagcccatatctgtactatggtattaaattaaatctgtagcacatgtcaataatatgccagattacctcaatctctaaaaacagtgataaactatttcttcttgctaggatatagataatctaaatctcttggctacatttaactgatagattcatttttggcaaatgtgttgacattctgagatacagggagactaatcccaacatctgcactgtccctgaaatagcagaattactgctctgtgttgggggaaaatccataaacatggatttttaaggtttttttttttcctaggaaaaatggaaaatcgagggaagtagtaagaggtagacaagagctccttttccccttatacacaagtttcgattgctgcatctaaagataattttctcggaaaagtttgtagatcacaatagggaagtcagtttatcgtctactaaaagtgcccacccattttagtttaagaagacctagggaactaaaactacttatttcataactctcagcagtttgttcagggtagagaagtagcatcgtgattagcatgtggcctctggagccaaaatgtctgggttcaactcctggctctacatttattagtgaattaccataggagaagtcactgaagtgtcccatgactcaattttatttgcaaaatgggcaacataatagtacctccctcataattttgttgtgaatattaaatgagatagtacctataaaattattagaatttgcctggagcttagtatcttcttaattatcatcagagggtagtttttctccaacagtgctagattttggaaattcttcaatgggctatgtaaatcctgaacaatacatacaaattcccattggcttaatacatgaaatctgaaagttgagcatattatcatttgtcatgtatcatgagaaacaccatccccaatgcagtctacagattatatgttttcactcttcccatagagatagagtggcttagcttattctcgagagatgaataccttctttcctattccttcacaggttagccttatggaggccaatagaaatgcttgagtttcccctgttgccaagttgacataaccagagactttgccaagactacatgtcagagacccttctgtccatgtatctgtaggaagtctctgacctaacacagcactccttttcatcaaaagagatatatctcactctatttgcaagccaaaaccaaggaaagattgtgaaggatgaaggagacattatttgtgtttttttacatccatttcccttatgctggtagtttccctaaggtacacacacacacacacacacacgcacatttatttgcatattctgaaaaatattttcttaattcacacaatagccctctaaggatactgttgttagtctcgattacaaatataaaaacggaagatacttaggttatttaactcacacacacacaggtggtaaggtgataaaggtcggtaataatggatgttaacacttaagcctctgacttttagactctattgctccccatctctgactactttgcctctccatcacatcttcctcctctttcccattcctacaagggaaccctgttgcaaaccatctgacaaaatgactcatcaagataattttctttaatgacttaatgtgctgttcctcccaaggatgatggcatgccatagaggataacgtctgaatcttagagaacaaaatctaacatactttatttatgtcataagcagaagatacagagcagagcaggaggtagaattcaggggcaaaagattaggcagctgcttacattgtctggccaaaagacaagaaagtactgtcagtaaactgcaagatattctcttatgtatacttttgaaactgaaaattaatagaacaaagaggaatgaaggatgattttaagcaaaaaataaaccaatatttgtgaaggtgcatgcaacgtcctgggattaaactatactaacagactgagctatagtaatagtataagatacaactgaatttttgacccgttatttctgaggatgaactgcaagtggtattgtagattatatttagcttagatacccctttgtttctttctgctttacctgaaatgggagcacaatattcaaagactcaatcaaccattttttttccactttgcaactagtttaggcaagcttaaaaaggtttagctattatttttatattattatttagttattgtttcaaaatagagggaagacataggtgatttaatatcctttcgaattttgaaaataattttgggacgcagcgtatggtcaggtaagttataatttgatcatcttgtgagtaatggacaatgactgcacctattataaacatctgtgaatgtgaaaggggagttctgaaggactgaagcctagaggacttctttactttttgtaaggaatcactccagtttttctgttctttggtgaggatgatcaagtttgcctatcaaattatttttggaaaggagctccagaattttgtttgaggattgttggatcagtagcttatagttctatatgtgtatattttgaatcaaaactaaatgccagttaaaagagcctcctggaggaaagtgagttaagggcatactggatctccccgtgtttcttacaagtttatgactctacaattaccttaacattaaaagctataaaaaaaggtttttttttttttaactcaaagaaacacctgaaaattatattattaatgaaaggacacatgaattatatttcccattcatgtaaaacagatattttgtaaatttataggcatattcttgtagtgaaattctattatttatattaagttgtaactatattagtttttatgtcccttaaaacatgaatagcccaggtagtattgtgaatctatttaagggtctttggacaatttagttcaatcacttaggaagacctaggaggagaagggtacgcttttagaaaatgaaaatataaagtcaaatacgtaatggcttttctattgataagtctatgtactattgggaataaaagacaaacacagataattacaataaaacatgttacatggcagtaagtgatgacttaagatgatgacaaggggactatggggcaaaggtaaaggcaggtcatactggctggggttccacgatcaaattattgttggagatgagacctgaactgagtcatgaaggttaagaagtgtccaggggaaggctgggaagggtgggaaggcaagagcaaattattaaggtaaaacagtatggtgttttcaaatatcataagaggtttgatttaccaactggagtacaaggaacaagtcaggaagctgggaaaagtgaagttgggagataatgagactcagtttagtaaacatcttgtgcagattctaagaattttggcaactaggaaggattttgtctacaaatataaaattgtttaaagaatacattagaaataaagtaatatttagcaaatttcttcagtaaatagtagcaatctataaagcttattttagattatatttaaaatcttaaaaaataaagtttgatagtcaacattacaaaagcgattatgacaaaaatcagttcatattactttgcgaatgttccctcatgatgcatcatcaccttagtaatggagaaaattttgtgacttgataatctctgagtggaaataacttagaagtcacaattttcgtgtaaatgcatttttttcttttaatactcatatatataattgtttgggctggtaatgttttgatgagtgactaaatagttaatctgagaaggtggccattcacaagcatctttcccagctgctgcttctcattcttctccagaagaggagcatctgacctattgtccccctagcaatcatgttggacaaaggcttcttctgttttggtgctattagaatgaaaaagctattggtctggagggtaagtttctcactaaatatttttccataaacacaaaaggagaaagtatatggcaaataaaacttgtatttaatagaatggatatagacaaggaaaactagatgtgaaaaataagtgcaaaatccttctatccactcctagataaatagaacataaatatacaatggaattctatagactgagtaaattaattcagctaatgtgtattaagcaccagtgtgcagggtaggtgttagctctcattctgaaggttacaaaggcaaacaagatgtggtccttgcctcaaggagttttaaagctcaataaaataaagacccaaataagtaatgacaatacaaaaaaaaaaaaaaaccagaaagaaaatatattaagtgtggtatgagagataaaatatgttatacattactttaaatagtgaagccatcctgaagaagacagctggtgtttgaggtgacttttcaagagcagggttttaataggggggatttgggaagttgagaaggaacattccagggagagaaagtgcatgcataaaaacaggcttggagagagaaagagctcaagtgcttgagccacatttctccccacctcccccaatggcactttgaggtggccactagctaaaactaaaggttctgcttcattgagtggtagtggtgcttttctgggtgaggaatgtactttccaaaaaaaaattattgtgaaacgtggaaagtctcattaattcagaatcagtcacatctatttttctctaaacattttaacttgaaattgattataatgctatatagttttatagttttaatcaaggtgctgaaacatatcatagttagcacaatgtaagacacaaatactaacctctctaaatgaaacctctctctcccaagaattgttgtcagtgtcctaagttcatctattatatcctagcacagaaggacttagggagctccttggggttgttatcacattttcactaatacctctgggattatgtggccataccatagtgtgagtctaaatggctctaaatgtggttttacctctctttaaaaatgaaacaaagttaaatgaagtgaagcctcaaaacattatgggaactgtaatgtcccatggaccaatattggaactgggccacacagcgggaggcaagccataggcaagcgagagcgaggtttcaactgtatttagccactctccatcactagcattactgcctgagcactgcctcttatcagatcagtggcagcattagattctcacaggagtgcgaaccctactgtgaacaatgcaaggaagggatctaggttgcacactccatatgagaatctaactaatacctgataatctggggtggaacagtttcatctacaaaccatctcctcattccctttcgtgtaaaaaattgtcttccacgaaaccagtctctgctgccaaaaaggttggggaccgctggcctatagctcatagggttgcaaagaatctcagagagtgggtgctaaatatatatttactgtgtgctcaatcagaatagtggcaagttaaccaaccttctataccaatagttctcaaatatgaacgtgcatcagaatcatctggaagacttgcttaaagacagattgctgggatttttgacttagtaattctagattggagtagagaattagaattcctggcatatttccaaacagtgctgattctgcttttccaaggaccacacactgttctatacaatatgattcagagacaaagcacagctttgatgcaaaaaagcattgacagaacgtgtgcatagaagcagaaccacagacaggaatacacacaagtaatagcggcagcttaacaacaagaaaaattttaaacaatgtggaaaattagtaacctcatttttgaacaggtatgggatttttaacatctacataactatggtattgtgaatttgggatttgtgtacagatatactgcattgttgttgatagtcatcagaatctttattttcttctccattttaaaagtgtggaaatgttggtggaaacttaagtgccttcaactactcataagaattttatgggctttttcaaagggctaactgtgttaacaccaagaattaaaggactatatggcccccttaaatatatgcacatggtcaagaaattgtctcaaagcaatagggctccactttatccttcaccctacacccagtgttgaaagcatgtattaatacttgctctagaatgatctcattgccattaaaaggagggtactagactgggctaatcagtaatctatgtctagtccacctcctaccattatacactctggttgcctttttagtataatgtatttgagttatttagtttctctatcttccacagttctgtcaatacgcttgacatgcatttggaattacagatagaaatgagatctgaatttgcagaaaatcctttctatctctggataagatgatatatctttcacagtatgctaaataccaaaatgacattttacattctcacctgataattcaagtcataggataaatacagtgcctagcttagccttattgatgagtacagtggcagatcccaaaacacttgtcaatttaagactatatttaaccaatattgtcattcagccattgtcattgatctaacattaaaagtatcagaaacttacaatgcaatatagggacaatattcttaagtggtaaattaattgttaaagtgtgttaaagatcaatttcttactgcatttttattacaaatgaaatatgactccagatctttcacagtgatcataagtgaacaaatatttgcagatgaccatctaataggtttcttcacaacactgtgctagatcaatagatttggtaaacttgactttttttttctaattttttcctcactggtagagattttttaaatgtatttaacattatggaaatatttcaggaaataattacttatcaatattgtaataatgtcatgttttcaaacattatcctctctgttcttaggatacattcacagtgagacacaaatgacacgtgtctaggacagaaatggatttgtaattcttgagaactgttcataataagtgctgatataaattgaattcacaaagtgtgaaatgattctatcgctagttttgggtaaaataaagatctagaaaagcttgtgttcccctggagatagaaactctacccttattcccaactaccagcaatccagcaaacaaacaaaaaaacaacaactactggaaacacttacatgtttgagtcatttgctgtgacccaagataactgacttttgatcccattttgcaatgggataaattgcgggaaatggtacaagacagaaaagttaagaaaagaagcctgaacgattacgttagaaaagtcctgcacaattcatttgaatggtaacaaagccatgagcaaggcagagagtaattcttcccgataggtaaacatttctgtatcagaaaacatatttctatataaagttttatgtagcaatttattggtttttctttcccctcatttcctttagtagataactcaacccttcaaaaattctgaaaagttcgaaatcctggctttttgccagagcatcatggccacatcccacttttgtctctattcttatctaatgcatttcatattttaaggaaaatcccaagggaatctttgtgtggtttgtgtcttctcgcgagcattggaaggacagaaagtctgccagtctgtacagaaagtttcatatactgaccatgcaaaaataaggcacaatcattgcaatgttatcacttctgggaaaatatatccagaatgcaaaataatgttagaaacatgttatgcatcagtagaagccaacttactacctagattagatctattatgatacagaagctttggcaagcatgtcaactgtcatatttttccccaaagtactaagttattttacattattttgagatatcttctatgttcaatcaaaacctctgatcaatctaatttgagctaaaattactaaatttaaaaaatacttgttattttagtgagaaaagttcagatcatttaaggcttggtcttagcaaattgtagagtcagagaagatttcgaagaaatctagatattgtctgtttcatatccaattctctttcgtaatagatgacattgggaaatccagagagattgagggacttacctgtaaaggttacttagagccttaagtaaatacttagtctacctcaccatgaggctcctgctaacatttacaaacagttggcagccaggcaaagattttatatcttgttcattacacagaaacaattcattctatttgggcttggccactgcattttatttataaagagagaaaaaaaattaagccacataaagggttagaggagttactgcatggcatattttaataaatgatcaacatgttaatatagacatttaccctaaagacattgctataaactgtctaccacatttactcaggtttttatgaatttctttaatataactaattataatatagagtatcttttctcctcaatttaaggaaaataataaaatgggtcagtagagcacatcttgatattgggtttcctgtaagaaaaagtcttacttgatgcattaaagtgttcacaaatttgctaatcatgaacagccctgagtagttttaaatacttaatatggaataagtttgaggggttcaagctgtaggctcactttgaacatgtgtattgtaaatttgacaagcttccaacatggtatagaataatacataattggcctcttaattccttcaaagattatttccatgattacttagtgggtaatcataatacttataagaaatatatattccactgtgtggtatgtgaattttgatttgattgtgcagaaagacaatttatctatttatgtatacttgacaaatggcaacattgattcatttgccataactatatatttatgtaactcaggggcctccaaccactgggccatggactggtactggtccatggcctggtaggaaccaggctgcacagcaggaagtggccggtggtgagtgagtgaagctccatctgtatttgcagccactccacagctactgcccatcagtcgttactgcctgatctctgcctcccatcagatcagcagcagcattagattctcataggagctcgaacactattgtgaactgcatatgtgagggactgggttgcatgcttcttatgacaatctaatgcctgatgatctgaggtgaagctgaggtggtgatgctagcactgaggagcagatgcaaatatagatgaacgttagcagacagatttgactgcacagagaccatcataaatcagttgcttacagactcatatcaaaaccctatctgtgctgcatctggtgtcaggctttaagtcagaatctagcacttaatttagtccatgtatggcccatccattattgtatttaccacttccacccatgcttctttcctgcactgtgcacttgtttcagtcacagttttggtaagccctcaagctaacccagccaaaatgagtaaaaaacaaacatcactggagtgcttctttgaaggagggaaagacccagtgatgcaacagcggaagacttctaagactgcctacaaaaattcagcatttaaaagaaaataacaagagtcccacttaaattatgggttcactgcaacaggtgattcacattcattctgcaagcctgctttgtataatatgtgatgactggctatccaaaaaagccataaaacctttaaaacttcttcaccacatgcagattaagcaccctgtgtcaaaagtcaagttcaagtctttggaggttttctttttttttctttttctctactttttttttctttttgaggtagggtctcactctgtcacccaggctggagtgcagtggcacaacctctgcctcccggactcaagtgatccttccatctcagtatccctagtagctggaaccacaggcatgtgccgccatgcctgatttttgtattttttgtatatatggggtttcaccatgttgctcaggctggtctcaaactcctggcctcaagcaatccacccacctaggcctcccaaagtgccagtccattttgaagtttttcaaaagaaaaaaaaaaagatgaacatgaagaacagaagcaaacattgaaggacaccacttcatcaaatgtgtctaaactgagagcatcattcttagtggctaaccacattgctacagctaagagaccctttactattggtgaagagttgatccttcctgctgctaaggacatttgtcatgaacttacagaagaggctgcagttcaaaagttggcacatgttcctctttcagctagcaccataactagaccaattgatgaaatagcaggggatatcagggcacaattgttagagaggactaatgagtcaccatggtatgtagtctaggttgatgtgtctattgatgttgacaaggcaacaatgcttgttttagtgcaatatatttttcaggaggatgtgcatgaggatttgttatgtgcacttttgttggcaatcaacaccacagctgcataaacattcaagtctttgaatgaatatatatcaagaaaactgaattggtcattttgtgtcagtatatgcatagacagagtagctgccgtgactaaaatggctttctgatttcactgctcgggtcaaagaggtcgcttctgaatgtgagtctatgcactgtgtcatctacagagaaatgctggctagccaaaaaatgtcacttgaacttaacaacattttgcaggatgtgattaaaattatcaaccacattaaagtacatgctcttaactcatgtctgtttgcacagttctgtgaggagacagacagagagcacacacatcttctcttttttttgagacagaatctcactctgttgcccaggccagagtgcagtggcacgatctcagttcaccacaacctctgcctcctgggttccagtgattctcctgcctcagcctcccaagtagctgagattatagggtgcccatcaccatgcccggctaatttttgtggttttagtagagacagggtttctccatgttggccaggctggcattgaactcctgacctcaagtgatctgcccgccttagcctcccaaagtgctgggattacaggtgtgagccactgcgcccagctacatcttcccttatacacagaagtgagatggctttttaaaggtagatccctggccagagtttttgagttatgagaactactccagagatttttagaacaacaatcaccactggcagcacatttcagtgacacagaatgggtcccaaaacttgcctatttgtgtgacatattcaacctagtcaacaaactcaatctgtcacttcaggggagaatgagaactgtgttcaagtcagcaaaagggtctgcattaaaagccaaagtagaattatgggggtgatgagtgaacattgggatttctgatatgttttaaacattagctgtgatttataaagaggctgagccagggccttctttctcacagctggtacatgatcacttacctcagctttcaaaagcatttgagtattactcaaaagaccccaaactgggaagaaatggatccatgacccatttatgaataagccaggtgaatggactttgtccatgttagaaaaggatcaactgcttgagatcacaaatgacagtggactttaaaatatatttgagacaacttcaaatctccatatgttctggattaaagtcaaggcagaatatcttgtaattgccacaaaagcaccaaagagcctgcttcaatttccaacattctatctttgtgaagcagggttttctgcagtgacagcaaccaaaatgagattatggagtagatgggactatctagttgcaggaaaacaagctcagggctcccactgattctacattatggtgagttgtataattatgttattatatattacaatgtaataataataatagaaataaagtacgcaataaaagtaatgtgactgaatccccctgacaccatctccttcaccggtccatggaaacattgtcttccacaaaatcagtccctggtgccaaaaaagttggggaacactgctataacttataatattggcaataaagatttttggcttctgctgtaaaggagatgtttaatcaatatgttttggaaggtcctggctttctggactacagatcaccccctttgggatgattaccaagactgaagtggttctttatccctaaagtccatggaaatgtcctatttttgccacaactcacacttggcaaagaaagaaaacagaacccataggttggaaatacaagaagagagcatcacacatcatttctgactactaaatacaatgtgactactagtaaagcatgcagccagtattttgtaggaaatgttagagaaagtactttcatagaaattagtttaaagggttttcctggtgcttaaaaattgtattttaagaaagtaattaaacaaatattagaactcagcatgaaaatctgacattatagtacagataacatgggaaaagcaacactgggctagagatggtctaagaacaggtactattaccttaaccacatgtggggagggagcattactcattctttagtaagatgcaactaaggattgatattagaatccaacatatatgcattattgttttttgtaattaaatgtgggaaatggattgttaggtaagatgtttttctaaagctcatgaaacacttttattaagtcttgagttaacaaactatctataaagaaattcctagagaggatgagtgcaatctggcacattatgatctgtttcctcttgatagaaaagaccagaaattatcccattatcctgttttactttttaaaaatgcttacattgttttaaagtagtatgttcttgagaaagtgctcatgccctttaagaaaaaacatgatctatctgatccaatttgaaaatgaaaactgatgggtaagggacacattttatgtgggaattggtgctacaaaatcaacaggaaacattaagagagttttaaaaatgcaaagagaatagtaagtggataaaaataatgtatatccctatctatctacctatctatctacacacaaacaagtgttatttcatactcctcttggtgtcttagtaaatgattctaaatggaatatgttgaaatttcattatttaagaatagatgatagattaaaactactatgtacttgagttctcatgcacataaaatattgctgggatccagattaaaggacaagggacataaagggaaaggcaaaagctaaaagttaaaagagaagaaacactgaaaaaaaagaaaattattgaactgacttgactttgtatatattacattattaaatgcattattaaaatatatatccaagccatgttaactgtaaatgtctaactttcctcgtcaaattttatctgaaactgtcaaaacttttaaaacttagaagaagaatattgagaaaaacattaccttaaacttctttttaacgtacctgggttcagctagataaaaccgcacaatatcatatcttgaagaaatgtttttatttacatttattcgtcaaaatctgaaggcattccttccagaagaaagactctcttaatattatttattgcatataatgaattgtaagaaggactttaaattgattttctcaaatctgactagcttataaagtgttgtcagataattattaaattcaactgaaataaaataatttataataatgcatgatgattaaaatgttggtacataaatatgagacagggaaaaacaaaggctggaaaagactggacaaatttgaaaacaacttttcaacttgccaccaaaatggcaaaacctaattctaggtaaagtggttgactttttcaagtcagattaataaattaatgtaaacatctataaggaataagcaacatccaacagtttcatactattcaatttcttttgcaaatgtttcctctttttttgctaattcttaaagatcaggaaaaaaactgtgtgtaacataatttcaatgtagattattccttggtaaaattcaaagtaaaccctgtttatttgtttttatataaggatcttataaatgatatccaaatagacatcaaatttagtgtcataataagtgggcgaaggatatgagcagacacaaaagaaggcatttatgcagccaaaagacacatgaaaaaatgctcatcatcactggccatcagagaaatgcaaatcaaaaccacagtgagataccatctcacacgagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggattatcaatcatgctgctataaagacacatgcacacgtatgtttattgcggcactattcacaatagcaaagacttggaaccaacgcaaatgtccaacaatgatagactggattaaaaaaatgtggcacatatacaccatggaatactatgcagccatcaaaaatgatgagttcatgtcctttgtagggacatggatgaagctggaaaccatcattctcagcaaactatcacaaggacaaaaaaccaaacactgcatgttctcactcataggtgggaattgaacaatgagaacatttggacacaggaagggaacatcacacaccagggcctggggaggggggagggatagcattaggacatatacctaatgtaaatgacgagttaatgggtgcagcacaccaacatggcacatgtatacatatgttacaaacctgcacgttgtgcacatgtaccctaaaacttaaagtataatacaaaattttaaaaaaaagaaaagatatatttgaagtctctatatttcaacaaaatagactcaaattcagtacccatcatacagcatatatttcacagtcactattattcaataggtatgtatatgaatagatacacatctatcttatacaaaaacaggtcaaaaagcatttaaaaataaaaataaaacttaaccaaaacagaaataaataaaaatagacatgcccttaaaaagcttgagaaacttaattaaactctggcaaaccatggaaatggaactcaggaatagaactctattaagcaatttttccttatgtatagattatagctactgtgtagctgagcctatttcttaatgcactgatacaagaactaggtatcttttagtttagaggagaaatgtttagtgtgcagatttcaaactctttcaacattctgatctctgatcatgtagtacaattgagaagtatgatgaagaggatggcatatttagcttgaagttaaaagagatccaacttgcccttagtttattacgtatttattgttgagacagggtctcactctgtcacccatgctggagtgcagttccatgatcatggctcattacagcttcaacctcccaggctcaagcgatcctcccaactctgcctcccaagtagctgggactacaggcacaaaccaccatgcccagctaatttttttttttttaatattgtttgtagagacagaggtctcactatgttgcctaagctgttctcaatctcccaggatcaagcaatcctcccatctcagcctcccaaagtgttgagaccacccttagtttattgaaagcatacttctttcttcatatggacctcatctgcctctcttacctgatgctgtactaccagcaccgggatcatatttcatatgtatatatgtaaacaaattaataaatttatctgaagaaactcatgtgaaaagtacttgtttcaacttggcaaactcattttttcctagaaaaaggaaagaagaaagaagtgctcggtgttctttctgttcaattctcaagttgaaaggggacactacaggaaaagggaagctgttcctctgttggcaggtattccctatttaattgtgtctcaactctgcccagggtactcagtggggtaaaatcagaagcccttccagggtaggcaggactatagagcagcactccccacccactgccccaagttttcttcagtcttcagcgtggtttccagcctgaggctgaatcctcccattatttaacatatgcatattcaactcaaaataataaacgtgtaccatgagggactgactgctaaatgtatccctgtgaaaaatcacactgacaatatttgatgtttactgggtataaaagccatctacgaaacataagaaggatttcttgtgacttgtatgctataggaagagaactaataaaagagtcccaagcctaaaccagaattattctgctcagtctttttcttctaaattcacttgcttcaaccacaacaaaagccaaggaccactttggctcccttttcttacccaagtttgcagtcataataaccttttaaaaaaggtttttaaaaagagtcccttaaccacaaagtccaatatctcagtccacaccctggatattctttgtctcacaaacttggtcaaggatgttaaggtaataaggtccactgcaaacatccaaatataaacaactgcttgttgattctaaaatcctgatgagtgttttcatcttgagtgtttaacagctttctgacatggtaggatatcctatctttcttcctctagacaacaaacagctttctcatccctctttgccttctcagtcattcaacactttagctaaagggaggagcacaaattcttttctgtatgtggagacttaaagactactaggaagcacacaaccatttcacacccttcctctttcatcatcaccagctcctctttttattgtttctccaacttgcctgttgacaaagacagctgctaacaattgcatttgtggtactaggatatgcagtctaattgcataggcttgtggccaggggtcttgtccagttaagattgattttcaaaaggagagctacagagacatttccttagatgtcttcccactcacaaagttcaagggacattcatactatactcttaaatggctgcacttgaaaattgttttcatgttttgttttgtttttttcctttcacctttatgtaacccctccaaaaatcctggcatagatgttgagtgaagagagtactgctcattagaatcaacagttttcttttgttcagttgcccttgctggctaactactaaacaacgtaatcgcattggaaagtcagagatatttttgcctttgaaactgaagcaaaatggtgacacaaattctttaggtagcaaatttgctggcaaatttattacagacataaaaacatataaccagttgttttctttacaagatacttatttatcagattctgtacatttcccttaacccttacaattatcttatctatgagatcttaacccatactgacaatctcatgtatattcctaaaatacttttaaaaagtctaatggtcgggcatggtggctcactcttgtaatcccagcactttgggaagccaatgcaggaggattgcttgagcctaggaatttgagagcagcctgggcaccatagtgagaccgcgtcactacaaaacacacacagaaaaattagctgggcatggtgatgcatgcctgtggtcccagatgctcagaaggctgaggtaggaaaatcacttgagccaaggaggtagaggctgcagtgagctgtgattgcattactgcactccatctgagtgtcttttgcagcaacgtggatggaacaggaagctgttattttaagtgaaacaagtcagacacaaaaagacaaatatgtattctcactgataagtggagaggatacaaaattatctgggtatggcagcgcacacctgtagttgcagctactgaggaagctgagttgggaggatgtttgagcccaggagtttgaagctgcagtgagccacgattgcaccattacaatccagcctaggtgacagagtgagactctgtctctgaataaataaatagcctaagaagaggaaaaccttataagaaaaattatttcaagtggattccaacccagaataactagttgacgtatttgaagaattaataatgtagattgtgctcttactgttagtaaataggtgcatttcattgattccttttggttttaccaagtacagtcttttgttttgttttgaagtggagtctcactctgtctcccaggctggcctggctggagtgcgctagtgcaatctcagatcactgcaacctctgcctcccgagttcaagtgattcttctgcctcagcctcctgagtagctgggattacaggtgcatgccaccacacctggctaatttttgtatttttagtagacgcggggtttcaccatgtttgtcaggctggtctcaaacttctgacctcttgatcctcccgcctcggcaccccaaagtgctgggattacaggtgtgagccaccgtgcctggcctagtcttttctatatttgtagaagtagatctttctcattggctggcatagattggtgatagtttcttaacttggcatcactatctgctatttcatcaacacctccaacctaaactagaacgcatattcacatgaaaatttaaatgaaaaaaaatcacaaaaatgagcatgtacccaatataagaaacatttgctttgaaattgatggcttggaccttttaagtggttttggcaaaattaccatctggtctccaacacaaaacagctgttttaggtggcaaaatcttgtcaagctaaagctcccaacccttaagcacgggtaattggcaagaccttgttccagttcatctttagtccctactgaatctgggcaaacaactgtgaatttgcgctaaattcctcttcctataataggcagcctggcttcccatggagacacagagttttcagagccttagtgtcctcagggtatctgccagtacaaagctggtctaggataagccacattaatagcagtttcctcttttcattcataagctgtccttttatatttatgagctcattcttgtgagttaaatattttggatgtatttctgcaactttagtatttacccaatacttactcaaaaacagtaagttgtctaatcctttagtagtttttcaacattttcaaaagtattgcattttcaaaagaaagttaaaggagcattataaacaaggtgcaaggagacagtggcagttgagacttcgctttctcaacatatggcttatgttacaactgagcaagcccccagcttttatctctgggagctgtgaagttgactgcttataaggtctcaatgtctaattaatccttacttaaaattcacctaagtaagtataacagggataggaagttggtttctgttagcagttccacctttcaccctaccaaacatctgggaaatattcagtttaagatcagatccaagccttttggcattaactaccttaaaacattaagatatcaccagcaatttgcctctgtttcagaaaattaaaagcatatttgagatataaacatgagtgtgtcactaatattactggcaataattgagagctattcttttattataatgaggggaaaacagaggatattctcagatgaaataggtagagtaagtccaaatggtaacattactttcctaaaataactgtgtatgtaatgaatgctgaaggtaaagcatattaaatgctagtgttttctttcatggctgttgcactatttgttaggatagagagcatacatagcttatgtaagcaatataaagcctcatctgtctcttagaaaaatgtcaaaattacaatttaaactgttcaaaatataaactaagaattatcaacttcattgatcagacgtcattttttgtgagattattgactgtttgcttaaaattaaaaaaatggacgttttcttcagactttgtctcacaaacagtaatttgcattcatattcttaataattaatggtgagatcatggggaaaagacatcataagtaatgattcctggtaaaattatgatggttatgacttcatttatatactaaagctaatggtaaaaggagagagagacaaatgagaagtgcttttctgtggtttgaagacatagttctgaaaaatttctttgggagctaaatttaaatttctgacaagcctcttccttttgtccagatacaaattaagccagactagatagtgcttaaaatttttgtgcacttattttaggagctccttttttctggggccactccaccaagactttgcttattacatttttcactttggagctttgcttaacaattcagtctctttcttagaaactgtttgtaaacatctatcagtatccaaattcttacatccataaacttcatgtgattttaggctttattaaataattccattgataataagagaaagaggaaaaggaaactggaaatgtgactgtgcctttaattggagattgcaaaatttttctcaagcaattttcatgtttgattcaatgttttctaaaaaagcattgacatttaaaacattctttaaaaggtcattttaaagacatgtgagcaagttgtactgagggtgttgtatgtgcaattagggttctttcctctgtaaagccttgccaattccttagatgaatgagaatccatcagctcagttttcatcaccttttgtgtctctgagtctgacacaatgttgttgatcccattttgcatgcaaaatacatgtgggattgaaaattaaaagcagttaccagccggctgttaataacacataaccaaagatcatcgagagcagaaatcatgctagcatcatgctaaaaagaatgtctaacagtgccatgaatattgtggttactcaatacttagtgattggttgatatttaatgtggacacttttgggcttgagatggagacatgcaagctgtgttctgatggcagtgcagcagaatataaataacttgaagggaaaaaaaaaacctaccaattcctccctatctccccacctcttcagaaacaacgaatactattaaacccaatagatgtgtaaagcacaagtatgaaccccagttttccatttaaataatacaaagaggtgtttagcatcgtgttaaagtctctctctctctcttaatctttgggtagggattttgttggtagaagttccagctttggattggcaagttggaagctgtatgaatttgaaacagccagttaatgtctaggagtttccttcctcatctgtaaaataagttggttgccccagtgagtatcaaagacttttccagctttataattctatgatctatgaacaagagccaaaatcacaatttaggatttggcacctgattttatactatgctagtgccatggaactgcttatttcattaatctcacatgttgaatttctctatgtaacctggtttgactttgttgttttttcctttaaaggaaccaagcatactatccatttggcaactgagagtggttcttaaaagagcttttaattgggaaataaatgcaatgccagtggtacatatgtcctactgccctctagtggataaaaccatatcttccctagagtagttaacaagtttggttaaaatagcgcttctcaagctatacacatcacctggggtgacgccttagcttctgcattacaaactcccaggtgatttcagtgctgctggtcctaggaccacactttgagtagcatgagtttaagtgattttctttggtatataattactttaagtaaggaaggaaacatatttggcacaggatatgaaagaagtttctagttagcagaagatgcagaggaagaaaaagaaacagaaggaggggaaggaggaggaggagagaaaagggcaagagaatgagaaggagacggggaagaatatgaagaaggaattaaatccaccagattgaaagggctcatgtggcaaaactacatagttcttgatcactagcaatctctagaaagtttctatatctaggcttaataggacagtatatgcattaggacttacattgtgttcctcttatcttttattatattttagtaaattttaattaaaaagaagtcctgaccccccccaaaaaaattacaacttcttgaatcaaagttaagattttacaattctataattatgtaaacatacatattaaaatcagtctagagagaaaatactcactacttttgtgtattttattacagaagtaagctgtgttggtggaacactgagtatatatagctagatgcacttaactcttgcatagtgagatttcttcccagacagtagaatagtcaaagtttagcaacaaaaacctgtatgttcaaagcactgttctgagtactgagaatatagacctaagcaaggaagccaacccagcagtggcattttgtcatgagttaattccagagaagaagagaataaacaactatgttaaagtataacaaaatttatagaagattaatagtcatcccatttatggagcatcactatgtccttgaccctatgctaagcaaacatcggccattattttgatggccccattatattctccattatatacataaggaagctgaaactaaaagaggttaaagtcaaggtccaaactcatgtatgacatcaaaccttaaccactggattgtgttgcatttcattgattttcaaaatgttaactccagctaatcaacagatgaaggggaatccttcccctctgtgttccatattttcaacagctgcctctttagtgcaatggaaggagataatgtgaggctgccagtttgagtaataaataatgtgtgttggtgtctcagcatctcttcatttttattcgatctgtgaggagcgtggctgtaggaagaggcagcgggagggaaagcagaacctgagacttgtatctctgttttaagtttggttccctactctaccccttcagcgtagctttcatcctcttcagtagattaaatcttctggcccacaccctctttattttcagaaacaaatggtcacgtggggcaaaaggtgattctcttttgctgctacaactaggaggggcatcatttccttataataatggtaaatattacttcaaatttaccttcccagttttccacttccaggcaagcatcagttacttgtcttgaaactttgttatgccccatttttttattttgaatgaggatatagtgccctatccttatgtccacaaccttaggccttgtatccgttcctgttttgccatatcatctctgtactccagagtaagaatccattttaaaatactgcttcttctcattctttcatagaatattctaagtttgtttctggaatagtctcaggcattgtctacaaagaaatcttgaaatccaaaaccaacataaaggctctcccaggtcacttaaaaaaagaaatgtaagccaccttcttatcccaactacataggggaatatggttacttcccacagggaaattttttttttattatactttaagttctagggcacatgtgcacaacgttagaagcttaccaatggaaatgtctttagaggtcatattaaagaatgtcagtaatttggattggacacaataaatgtcctaatggttgaatgaattacctagcttaacacaactggtggttaagccagctgaaattcaaactcatgtttttttcaatatcagccaaatgctcttttcactagctctaaaaaaatgatactattgcagagtagttaccacctgatatggtaatgcctagcgaaagctggtgcctgacattgtttagtcagctgacaaataaagatacttgcataaacaagcccaggaaaggctcagtggaaattgatcatgaatgttgggagaaaatcatgagtaagcataagataaatccctgtatcacagaagaacttttccctttctttgtctcccttaatcattctcacttgaacattttcccctactaatgttaggattttaaaaagatataatattgtatttgatttaatttaatcttttccaagtacttccagactcaaaatttaacttcatcatgaaagagtgataaataacagcaagacaggaacatataaatctgaatagtctttttctaatcatcagttataaatgaaatttggttttcaaactaggcttacaggtaggaatatgtggctcataacataacaataatcactcataacaatgatcactcaccaagaggcattcatgcatcttttcttaatggtgagaagaaatgacctactctcccttcccttccctcaagcatgcccaagtagactggagatcttcagattttcctttttgtatcaagttaaactctagtggctgtattttccattctatttatagctagtgttctacttagtatgtatcttagtataaaacaaaaaacatactttcatattaagggtactaaacaaaagttctcttgggaattctactggtaacaatcattcagattttatgttcccaattctatgtgacaaatataatgtttggcatgttaaacatattcattgatttacaacctgagtgttattaagaaaggccaattacattctatttatttaggttaaattattttttagcacatggaagctaattatggaaaacacatcctttgtaccaattcatacaggagtcaagccatgattagagttgcctgtctagctttaatatactgctttccactttattgactatacagattgggaaagtacatattgaaaatgaaagacaatctgtaaacaaatgttatagaatatgctactttacctaggcatacccattttagtaactcatataaacattcatattattgaatatttaaaatatcagaatataattggtaaatattaataacagtaataacttcaacagaggtctaacaaataggacaattctatggattcaaatgtttgaccaactagaaagtaaaagggaagaaaactgaaataagataacataaaatatgtaccatttgaatcacaaatttgtagatgaataaggtagaattgttttatctttatcattgtatattaatgaacttgcatgtttttcatcatattttaaaaccaaattttcatcagtatttcattaatgtttttggagagctgtgctttttataactgctaatttttaagttctttgtaagtttgattctctttctttttttctaattcattttatctctttaatgagagttactcaaaatatataatttttgtctgaaaatgatttaaatagtctaagaaatactggtgtttttcaaaatttctttcatggtatttaaatgcataattttgtgctagtttatatattttattctcgtctttttgtggtttgatttcataatattcagagataatcagtttcaaatacttactgtgatcaaaattactgattgtcagattctatgtttgtcttctttgttttgttgtaatcatatcacttcatttccccacaccctcctcctccggggagaggtggagaagaactgtctcatggaaagatttctctaatgagtaccctaagtgacagaaagaccatatagagcaatgcttatacatttggactttggaaagctggagttcaaatcctgggtccacaaattatttaagcttgctaagcccagttttttcatctgtaatatgaaataaaaatagaatttagaactgtggtaagaattaaatgagatgatgccttaaaagtatatagaagaatgataaaagaatatggtaaaatgacagttacttttattaatctccttgttttgcatatttcagaagtcagcaacttttcatcttagttacgttccatctaaggtgaaatctagatagaggaagtgacatggaagacaaagagcgcttactaaccaatttggggaagtggcaaggcagaatggtaaacctgaaaataaccaaagatgagcctcaaattttcttagatcctatattccctgacagctgactcaaactgagaaagaggctatcttaaataagatagagtaccactatttctgccactactattataacaaattttaatcccaaaaataggctttaacatctagtggtttcacctgtgaatgttattacattttttttctaaaataggtaagcttatgttatattagtgatcccaatttattttgcaaaaaagtagcataactctgatactgaaatattaagataacacaaaaagaaagatactattgaatcctagataaaacattaattaattgaattccacagtctattatagaagatctcattatgatcaattgaggcatatcccaggaattcaaatgaagttcactcttagtaaactacaccgactgacgcaactagtatttaacattaactcactagtccaggttaatgcaatgtaacattaaacaaaaattagaaagataagtattaaaaagaggaaaccataccatcattaccttttgatgatagaactgcctagctaaaacacaaaaataatctactgaaaacatttatttcagtttgttgaattaaaagtactttaaatcaacatttttctatgcgtgaagcactattagaaaataaaatggtcagagatgccaaaaacagatttggacattaaaaagcatattagggcccagcgtggtggctcacgcctgtaatcccagcactttgggaggctgagacaggtggatcacgaggtcaggagatcgagaccatcctggctaacacagtgaaaacccgtctctactaaaaatacaaaaaattagccaggcgtagtggcatgcgcctgtagtcccagctacatgggaggctgacgcaggagaatcacttgaacccgggaggtggaggttgcagtgagttgaattgtgccactgcactccagcctgggcgacacagcgagactctgtctcagaaaaaaaaatgcatattacaattattatgtgtaatgatgacaaagtgaaaacaatctaaatgtccaaataaatgtatgtattaaataaattattattctaacatgtaattattatgtttccaccaacaatcatataacatgttagaaaaaggttaaaaatagcattaatgagttgaggaattgctaataatgtaagctttaaatttgatattttatgctcacaattctataaaagctaccatttaatatattatcttaaataacacatatagtttttacatatctgaaagaaggaagataatctaaaataatgattgcttctgtgtgatgacattattggttatttttattttctttgtactcttctgtattttctacaaccaatatttagtacttgtttttcagagtacaaaattgattttcagaaaatatgacaataatcaaatttgagggataccaaaagaaattatgaagctctgtgtagacctcctggtttagagtccctgcagtgaccggaggtcttctgccatttagaggagataaatgccatatctacattgaaagatgcggcacagatactattcaggttgacaaaagcatccgtccagcatgtttagcttcctaaggctttgatgtgtttaaaagatcagcaaagcttttcccttgtcttccctcatcacaacacaagttcaaagaaacatttattatgaaaaggctaaattctaacaaatgtatctccccagatttgaattacaatttaagtttctctataactttatcagaatttccccaacagctgagttaaagtactctattaattttcattagctgtttgtgattaatttgttctgttttaagtatcaaagtcaaaagaatgagacatgttattgttattgagcgaggaatgtaagaagataacagagaattaatgtagaaaagcaaactgtatctagattgagattgtctaactagctacttagtaatgaatttaaggcatgttaggaacatcagttagaatgtgggtaaatggtcatgtaaagccaaatccatgaatctgatttcctgttcatttaagaccaactatatttaattttaaacagcttctttccttttactattttttctaaaagcgatcaaagcacacaatgaatatgatttaaagagggtattttatgaaaatttccaaaatatctaatctgtctttaaatagagactaaaatccaaacacaaagaacattttaagctttatttaattatttttatttgaagtctttacatctcaggttctaaatgttgtacaaatatgaccagaatagttaaattattttagagttcagtagtaccagtaagtataaactaacccactactcaaaaaatgttacacatattataatttaattggcttttaacttttgaatgtagaaattatgataattgttctcacagtatattaaagacatttagagttgaggacaagagaaaaaccccacaaattaaaaaaacttttagcataaggcgttctgttggggataagagctttctttatataagtgggctttgttctggtatagcaagacaattttccttgcgtatttgcaaattatctaaaatgcaatgataaccttctatcaacactctatttgtgaaacagtaacctatgaggcccatactgagaaatttccacttctttttccactttgcaattctttgaatgatgtcttcttatcttcaaggtttcctctggccatttgacccctatctttaatgtcatgctttctgttctgtgctgttcagctcctcaccttcccacttttggttaaattcttcccttctttcagagtccttattatctcagacaaaggactggcacttcaggctatatgcccccattcttttcatgttcctatcaatgtccatctcttgcatcattcttatacattgctttaaattaaggtagaactttgctcatttctcttgagttgaactttctttctccactatttggttagttaataggacaggaaaacggtaagaaatcaagataatcaagatttatgagaggctgggagtgaagaactttagaaagtagcctcatctttgtcccagtgaccacttgccactactaagccaaagtggccatgaaattttccatttcgcacacatctaccactttggacagttaaggagaaatggagttaaagaagaaaggagtgtataaaaatgacgggagcagatgagactgaaatagcagtggaggggaaaagcaggagttggcatcaacacagaatttgggaggtgaatgaactgaaagtagcccaaagaataggaataacactcctttccctgtcccttcaagaattgcccaaaagttatacactttagtgagggttataagcctttgaaatctacccttgtatccataaagtgccaacattttagcttcttggtgtactttctttagctttttaaaaaagatacagcaccaacctaatagaaaaatattatgagatataataaaattttgaaagttcaatgacattatatgcagcatgaaaagaagtgtttaataataggacacagataaatgtttctttgttgtgatggctacaggtattgtcttttatcagtataattttaattttcattattctgacaatactgacttaaatgattgatagttgttggttttcactttaggacagcagagtgttacttaacatgaaattctgaaagaaaatgcttttgagaatttagactctggtggaataactttcttgatacacagctaacctttttttctaggaatttaaaatctaccgcctttggtaaactcagaaatgttgagaagaaaagagaattaggaatgtatgtgttgtcctttgctcaaaagaaaaaaaaaaaagaaaaaagaattgacagtcaaagaaagaatcaatccaaggtggaaggggagagacaaaacaaaagaaagaaagaaagaaaaaccatgtccatgtataaaccttagaaattaacatgagaaccacccccaagttaaggattggtttacatgatgacttgaaatatactttccatttaatatgagaaaaatatattctaatcaagtcttcctttgttcttattttttagcatttctagagtctatctgatttctcagttctagcgtaaaagtttgcatatgagttctaggtgaaataaatggcagtaaatgcttgttaatctaataactattatagcataatgttttacaatggaaaacattatgcttgcttctttcctacagatattatgcagattcattgaacatgtctttttgaaaatgtggtatacataaggaatgctgcattggataaaaattggtaaaatttcacttgtagggaatacttaggagcaagaatgtaaaaaaactacaccactccgttatacttcattaggtcatgtatctggtttactgaatacaatgaagaagaaatatgatatggtttattattttatatattcagatagataatagatagtctgagctatttccataattcactgccttgttattaaaaaaaaaacataaacctgatgagtgttttcaagtaggtaagttattttagtctattctttgaagcagagcaatgaaagctctataatgtccacataatagaccaacttactgtaatgtaataatcttggaggagatttaacacccattatctgaagacctaaaacctctagggaactgttatggttgctcagcactgctataggacctaaatgtaagaacagaaacatttctgaataagatccaaagtgactggggagaaatcatgggacagtgggttcatcatggaatttaaaatcagacagagctgaaccaggtctgccttatactcttttgattgatattgaacaaccctacttcatagaatttatgtaagtaatacattatttaaggtatggaaagtattcaacaaatagtggttattttatttctaaattccaactaatcttgtatgctttgcagaaataccatttggtgatgattgaaggtagagaggggaaagcaatattgtcttttctataatattctttaaaaagagtgtatgcatatcttgataacctcactctagcaataacatttgtgaatttaaaactatctggaagttagtaaatttttattctcagtccatgctaccacgtattccttaattagctgtctcctttataaaattatattattttagtcttaaatttgatcttcatgagtatcacaaacaaatcaatgcacacttatgaagtagcccttatgtattattaactataggatacaaagaagtagaagtcacactccagcatctagaccttacttttacttcagtcattgaaattcagtgtacattgtgttaggcacattctgtcaaaggacaaaacaatttgtgaaagttaataaatattagatatagatgtcacaaattcttttataacatataagtttctgaataaattgtatcaaaaataacttcaattggagttcaagggaacaaggattttggattaagaaatttatagaaagttttaggaaaaaaaaaaaaactaaccagaattcatttttcaaagtgctgtgtttactgattgccacgtataggttaagcactctagtaaaccacaggcaggaggaagacagagtacccttacataaagggaatgaaaatatttaggaagttcgttaccttgcccacactaaagttcatctacattaaaaaaaataagttgcttgctttgagatatttcagtaatttaagttggagaatgttgccgtctaaaggaaatccatgatgtctccaaatttggggatgtcagtctctctgttttacatgagtaaacagaatctagaacagtaagccaattctagcggagtaaagtgagtctctagattttattgcattgtctactagctccaaagcattaatcctcttccccaaatgcatcacatagtttggtaggatctcattagttatataataatttcctcaccattccatcaaagttccgaacttcaggaaagaagcatttccagagatgggtgcagattcaaatagaggtgggtgggtgtgtgttgcccttacatgaacaaataaaaataactcgtctagagtttatagttcatgacaggcattttgtttacaaaaataatttttcatttaaaagctctacttaaaaaatttttttgaatttaaatttccactttatgtacaagttaggtacaagtacttattccccactgaaatctatgctatgaatcctaaagtcttatcaaatgacaagaaaacaaagaatcattacaatcataacttatcttggatcccttaagtctaaagatccttaaagcctattgctaatattatagctcaaccataggaaatacgactgaagatcatgcattacctgattgtattatccagttttattcatgtttagcacaaactctctgatagctaattttacattaaaattctgtcttctaaaatgtgggacacataacattctagatgtttcatgctatgttgagggtatatgagatgcttctgaggtggcacatacaagtagtatgaaataacattaaatcataaaatgaaacacttcctgtttttcagttcttctggttatgtcaaggaaaatctcagtttattactaatatgtccttaacacctctggaaaacttgcttatctccctttccaacaaatgaaatctgaggcctcagacttagattcttttgccaaaacatagcatatagccacaatttaaccatggtatcttgtttttattatatttaattatgtgatcaccttctatttatggcaacagatattggctttccctttattagagtgatataataatttgtctttaaaaatacattaattttagtatacaaagtgagtcaatttgcaggaaaagaattaaggaaataataggatagggcctgacaaatatggcaacatttgtagtagtggtatgtgaatgactggtgttgagaaaatactgctaatgatggtttaacaacccaggaaagtaaaagctcttgctgaatgcagacagatcaaagcacaactctgattaaagaactagaggtgaacaaatgtgaatccagacataggggccaacagaacaagccaggttggatggccagagatctggtcagagtgcaagcaaagagacgtccatagagaacagagagacaggtgagactgaaaacacagaaaagctgtcagctccaagtctgaggcaagctgctagtccagcccaagtactttaatgcatcccattgccacagtccaattttatggattcatgcttgaatggggataaattcaggcagatgataataccatgtctgaataaagacaaactgttaggaaaatagcattttaagcaattgtatttgttactagggtactataaaaaccacaagatgtgtcatttgaaagttgttaaaaagattaaatgaatttttttattacaaaatttcaaacaaacagtaaaaatatcagatttgagatgagttatagttggggcaaaagttaaccttttttttttcctttaccaaaattagggttttactgttttgttttctctgtgtgtgtgtgtgtgtgtgtgtgtgtgtgtgtgttaaaccaactctctgacccacttctgcttccagggtcaaatattttgcatttccaatactcaggattgagagagtacaagttttccttcatgatgattttctgtggaacatttgctaataataactaagtttcagcattgttatgattttatagtatgtactgggtcagtggtttctaggggtcagtaaaagaaaggaagttttggaactttcaaaggatttcatttgaaaaaataacttttcgaatttggataatagcacttgtatattccttgtagtttccctgattcaaggcaataagcagtatatacaattacttgttagctcccttcttttcatgttgatagggaccacccatctgtggccttgggtgcctaaaaaactttagttattacaatcgagagtcacattagagattgtctgtaacttaaatcagcatatattatgtatatacactattttcaaatatatttggatatttttagtgacaaaataataaaatttattttaaagcatccacactagcttttcatcataatgtaggtataatgaccccatgtgggagtctgcaaaatatcttgaccttaaaaatagtcttcaaattccaaaacaaacaatatactgctggaaaataatgaatatagaatgagaaaatgggaagacttgatttgaagataccttgaggaaaaaaatcagtaaaataaaactgaacaaatagaatttaaccaagaatataatacttcagctaggttttatattttctgtttacaagactattaatgcattacaattttccattattattgaacttccattcatcttaaccaaagtgaatgaccattaccatcatcaatatctgacaatgtacaggatcattctctgcaacatgcttggggatctcttcacaaaaacaaccttattttgacctcaagctttcctcaaaatttctctccttttttttctttgcttcccttctcagaaatagaaagtttttccccattgtttcactgttcattccctttctcagctcaaaaaaaaaaaaaaaaaatcgaacttctacttgcctttcatcaggcaccaacaatgctgctcaatttcaactgtcttttctcatcttacccctccttgcatggcattcaacatagctgaccttctatacttggaaagttttctcatccatcttctgagatatcactctcttgatttttctcccatccctttagtacttctaagtcatttttctgttttcttctcttgctctactcagtatgaaaatattgggttgacgttggactcaggcctaagtgttctatgctgcctccacaggcacttctgtttcatgactttaaattcaatacatatgttgatgatgcccaaacatacatctccagccttgacctattctctaacctcataaacctctaatcacttaacggctgcccttgaaattctaatagtgatcttatctccaaaattaactgatttgtcctcctgaagctgttccttgtcccacagccttaatctcagcacaaaacaacaccacttactcttttcctcttatctatgtacctcccacccccatttacagtcaaacatgaacacttacttgttctgcctccaaaatgtcttgactctttcacttctctacagctccactgtcagtgctatccaaaaccatcatttttttctcatttgtatatttccttcatttttcccagtccccaaaataaagtgaattaaaaaaaacaaatataaaattatatcatgtttttcacttacatcaatccattcactagcttcccaaattaacatgtcaattaattttggagataacatcactacttagttagaataaatgtcagattttctagcatggcctacatgaccaggatctactttccaaacttctcccactactctctacttcacacaacattctccagcccacttggccttctttctttttcacacattgatttcattcttcagaactcatgcactctgcctgagctttatttccttgatttttgtatagcttactctacactttgtcattcaggtctcagtacatcgcctcataagtaaataatctgatacaaataatcggtctcaaagtagctccatcttgaactttttgcaataatagaaatgtttgataacttatgctatccaatatgtgagtgttgagcatttaaaatatgactaataatattgagaaacagaataattttatttagttttcttttactgtgtcaactaatttaaattaaaatagctatgcttggctagtgactactgaattgaataatgcagttctagcacagcatcttattttgtttcttaaaaaataaaattataaattataaatttcaaaaaatgaattaatatgcttttgaaaaatttatttctgttctctacagcataatcaccatgagggtggggatgtctttgttggtttgctttcatataatcagtacctagaggaaggccaagaacatagtaaatactcaataaatatttgtagaaaaaaatagataattgaatgaatggatgaatctatccctcatgaagttaagcatgagtcataatatctccctttcagactagtataactgcgtcctccctatgcttcctgggatgactcctgcctcactcgactctctccttcacgtcactgtcaaaagtgatcactctgagttacatatgggatcaagtcacactctcctgcctaaaacactttggtttttatgtcaccatcatgaagaaatgcgagcaaccctttataatatggtaacttttgcctagtctggctctgcccacctcatattttactcaagcaatattgatgtacttgccatttttcacacatcttagggcagtatgaatagaacttctttttgtttagcaaaactatatccatccttcaaaaactctgagggctgttctttgtgatgcttcgtccctggcaaatctttcttctcttgctaagaatcactcttttttggggggcaccttttatactttgcccaaatattgattgccacatgaataaatcatacaggacagcatggactgacctactttgcaattttagcacagagcaaaaggtctagctatagcacaaaataagtgctcaatcaatacttgctaattaaactcatctcatgcccttatagtaggattccattgtgctggtggaggggacccaatggctctgtctcaaggtttttattgttcctatagaaaaactattattttcttttttaccatttgtcttatatagaacaactgtttttagtgtctataatatgattttctttatgttgggaacatgctatatttttatttaatttagaaggtcagtataggagtcttacacacaatccctctggaatatgtcttttcctaagactgccacgatttgctataaaatgtaaatagaatgtgtctgggcaaaaatgtttgacaatatgtggatggttaacagaagctcctgaggattctacctgccatctctctataccatgaatgaagtagttaataaggcacaagtagacttgcaacttttttttaaaagaaatgtctcatatgttctgaaaagttgtgcatataaaggtgggttaacagtgagttattaaaaatataatttgcttttgtgaaaccactggcaatagtaggatgaaatattccataagtattaaacaaagttaacactaataaaacttactaatgggatagtcttgccatacttccttgccatagtaacacaacttactaatggagtagtctcacctagttctgaaaacagaactagggacagaagaaagggcacttaacatgggatctggattttataatcattttgacactaattgtgcatatttgtgttcaccagaccttctgagttgtaaagaaagttcagtgcaagtttctatcactcccatcccagataaggtggaacttccagccttcccattatctctagaggttcttaggagcaggttcctagacttagcaaataaaaatacagaattcccaattaaatttgaatttaagatatataacgaatggctttttattttaagtgtatttatattacatgcaatattttggacatatttataaaaagaatctgttatttatctgaagtccatatttaattggaagccatttaatagaaatccatatttaatttttatctggcagctctacatggggagaattctgggaagtggtgacttatgtttcccctcatcacctctgattctaaattctggcttaccctaaatgctcaatcttatgtgtccactacaattctgatttcattttctatgactcttcttccttatgctctgcactagttgcatggtgaaccagggtttctcttctttaatgtttccttccaaaactcgttcaagaaatttatgaacacagcagactttgcttaacatttgcagctaaaaagagactatagatctgtccagcttaaataatttaagattaaattaaagttgtgtttattttctaggatactttggttacattctctgcccctctcccactttctactttgagcaaatttctcataggcacttgtctctataatcttttgcctcattctgttttgtttcacctcctatttcttcagccatctcatctgtcttgctgcttaccccagcagccagataattattaaattcatatggaaagcaatttagctatcttttttttaccaccactttacaaattaaggtctttgtggtcttaatacttttaacaatgataattcttgcctaagaaaatgggaaagcattttctttatatatatatatatatatatatatatatatatatatatatatatatcagaatatatatatatatcagaatatatatatatgtgtgtgtgtatatatctctatatatgccattttatttgctctgctaggctttagtctcttattttgaaatcactaagttagatatggccaaagtgtacatgacatatcagtttgactcatacttcattttgaaaatagcttgatattctacttttgctaaggctaaatatattcatagaaaactaaaaaaactctttgggaatatctatcaataacttaaaaattttgaatactcttagacctaaacagttggcttctagacaagtatttgaaagtaataaagttgagtagttaaggtcatagtctttggattcctacagacctgggttcaaatcctagttttgccatctaaagttatgaaaagtctaagtctcatttgtttagtagtttgttatttggatgtactgtattgaatcatgtgagtgtctatttttctagaatatatttggaaaagtatactcaatagtgtatggctcagtgtaataatttatgacaaaagatgaacaacaggttcattccttttttaaaattaaacaaacacacacacacacgcacacacacatacacatctagagttgaaattgtccacgtcaaaaactgagataataagaatatcaaacaggattattgtgaatattttaactattgatatgtatctcttctaaatatatataataaatgtatattatctattatatacataaatggttaagtaaactaagatataactagaagtcagaatataagaatcttaaactaatacatatgaatattttaatgatatgaaaaagtatccatgagaaaagcctaaacccaggataaaatgtactgtatacagtatgatgtctcctcagattatccatttaatgtgtaattatataatcatagatacagggaaaaaaataaaaagaaattcaccaaaatagaacaacaggtacttctaggtagtagaattatgagtagctattttaatacctctttatctacatatttctaacaatgggcatgcaatactattagcaataaaaaagtaatgtttacatgtataaacatatgtatgcataacatatacatacatacaacacataggtgtgtgtatatatataatatacatatatgtccttaagttttatatattattgctgtgtattattttaaagaaatgtatccaatttaaaatgatgtatcaaatttttttaaataaaaatgttttattctatccatcattcatttcatgaaaaaaaaaatcagtatctaggtttagcaaagagattattaaattactatggctcattcttggttttgttccatgtattagatagcactttggttatttctttaaaagaatgtgattttggtaacttccaggttgaaagtttccaagttcagaaaacttgtttttatttgtatcatttggtagcttagtaaataatgcccgctgataattattatatttcacatggctaagaattttaaaagtacttaaagtaggtaaatatctattaattaaaattaaccttcttgggtaagactgcttactctggcattgttaaatgaagaaaagtgagctaattaagtttagcccgcattaaaatttgaattttattgtgtctaaaaatactcttattctcttatcctttttctttaggaagaagatgctaatctatggcagaatttcttatttatctcattcaaaatacactaatcagatacaaaagacatgctttaaacacatgacagtatgtgtcaattttcttatataaataagtggtttgatttctcacccaacaataaacagataataagatagatagacacataattggcaaaatgagtcagcagttcattctcatatttttgataattagagattatattgagatgtcctatatcaataacagatgtcaccttctctgatttatcccatttgatagaatctttttttaacagttcagtggttttccaaagatttaaaaatagaaatatctctgacgatttgagaactataagtaaaactaaagttaaatgttagatcaaaaataccgtttaattaaacaaagaaacatgctactctgtaaacttttcctctgaaaaccagaaatcaatgctttccaagtcagtcccatcgttggaatcttatctgtaaggaagaagacttccagattacctgtgactactttctatactaacatttctattaatattttactaccattattagtttgaaccctatgaatttccattcttgcaggataaatttggagagatggagtcaatagtttatgattcagtgtaataatttttgccaaaagataaacaacagttacattccttttttaaattacacacacacgtgcacacacatctagagttaaatatttactgatttatatcttgatttttacgtttaaggtctggattttccaagtgtgaaattctaatactactaatactactactactaattttaatactactaactcagtagtaaaagaaactaataaatatttatagaatcaatcagttatgccattatcagtgattccatctcagactaagtagggccaaaaattaattagaagcatagtccatgaaagaggagcacatttggggatgcactgcatgggtgaccatcattcagcactgggcacaacattgggactgataaagataacgccatgccacttacaccgttagcagggtgaggatttgagggactttcgatgcaattctttgattgaaatcttgtgctctgacagtagatttcaatggtttagtcaaagagttgcttgtacacaatgcaaaagctgccacagagggaactcatgcctggcccttcatacctctaaaaggggacaccaatacagaggtagcatgacccttaccagggccagggtacaagcctagctcttacattttaggaacaaaatatccactgtgcatttcgggaactccacctgactcctactcagctgctgacataactctgattgagacagctaatttttgagatcaacagtctaaagctcaaaaacatctatgaaagtatcttaaaacccacccctgtgctagtttagattggcaggagtacatgatttggacattctcctggggaaatgtctaagttctataattatgtttacccaggcttcttatgctgagaaaacattttccaggtacatttgattctaccaagagaacctttcaatttagaagatacctgagaagctctcattacggtatttgaaagtgctcccaggattccctctgtgactctttttcctcatcaataaaatattatttgtacctaacagaaggatttttctgagatttgaacgagttaattataatatgtcctcaataaatgctaacagaagttgtttttgacactattaaaaataaaaactttcagtcttcctaatattatatgctaggcttctcacaagaattgttgagatacgttcttagagaaaatgttttgtaatttaaaaaagatttcttagtatgacacaatgccatctgtaggtgcaatgaaaccaaatagtctctgtgttctcatttttattacagagacgcaactgatttcatagcgatcttatgatgattatgaatgagattatgcaggtaaatttcctagaacagtgtcttgtgaacactttcttcttagttaatattagattcccaatgcatagtccatagtccctcttcaatatccatgtaagaatccagtgccaggatatatttgtttatcgtctaaatgacctgtttgttattgttgttgttagttttcatgctttgcttgctgtgctttgtttttttgttgagaactatatggtttgttctgcgttttcttttttctttacatttcaataagcttggagctaaatgttatgatttatagcaatctccagtacagtttccaataaaactgttgtaactaaaccctcattatttagcttttattctcattttctcacttcattagttttgttttgtgtttgtatttttaaattgcgtcaagccccttggtaattatgtagaaataataaattttaaaaagtaaatcctgagggtacatttcaaatattatgagagctcaggtaccttctaatttaaaagattctcttaacaaaattagaatgtatctagaaactttttcctcagcaaaaatagctggtaagtaaggaaagtggtagaagttccaccatctctccctatttgctttaagattaagtgacctatctactaagccatcaatgggaagagaaaactcaataatttaatatgaaaaaagctggggggcgggggctcttcttttctctgctagaatacagccagacttgaaagagtagttccggtttatccagccagctaacatgcttccatttctgaaataaaataaatttgcaaaaagtgcacctattatgtcataagtaatttgaggattttttcctctatttttttctttcatattggtagcaatacaaccaagtaataatataaagatagagtaagatagtgaataataagctataactctctctggagttcttagtttaggtgaattaaaatatgatggatctaccttgcctttgaatatcaaaatgttcccttttcttaagagaatacaaacagactccttaacaaagaatatactagatccttaagttgcatctctagtaacacctttgtaagtaaaactcttaaatagaaagtagagagtggatggcatgttgaacactcatgtgttcttactaaaatgcttttgtctagcatatatgttgccttaatattataattaatggcatttctcacatggactaagaggaaggcatatttttaattaaaagtgcttattaaatcattaaaataatataatcagtagtatattatagttaatactctgttatatcttccctgtctctacaactatctcatactaaaggacagttatgtgggcttttttaggtcaaataatcaacttactcttacatctaattgcatctgaaaatcttcagagacactaattttgttcattgttacagcagaaccataagcatcaccgcgcagatgtaagtaaactttctatcctgctcagaaagtatccaaatagaacctgtcctcataccagggttaaaatctctaaaagcagtggtaggtgtgtttggctgttgcagcaagtcatgtgttggaatttgctccattaggaaagttataacacagctgaagttttaatactaaatttgtgatggataaaacccagtgctactgattcagctgctgcctaccctgagtcacactatctcctctccaagacacatgtaatataataacaatccaacaattagtgcacagtcctgcctgcttcttaaaacctcactcccagatgcagcttcgatcagatcttggttttattagctgtcttaattaactaccattataataccagttccctttttcattcatcaggctatctagctagacagtgttgatgtaaacacagagctttaaaaggcagtgactttattctcttcgcatgtacctagtctctaaattatgtgtgcacatagtgtatagaactatggtctaaaagccataaaaagaaagtacaatttacaagaacattcatttcacttgtatttagagttggaaaaatggggtaggaaagaagacaatttgattcaccaagtataaccattctctcctggacttttcaagatgtgtaaaatctcatcttaccaaaccactctgatgtatgtggcttcaaactagtattaaaaatgatcttcaaaaggcagtatataaagtcaaattatattccctttgtacataggttaaacatctttgttgtagacatgataaaagaacagatcaaacacaaagagaaaacagtataaggatctgatatgaaaagtctcaagtagaacagagagcttatagaggactctgagtatgcatatatatttctatgtatttataatatatatttaaatatctatgcaatatatatttacaatctattttaaatggtaccatttactaagaaagcagagaactaacaaacgtttcagactcatagtgcaaaacaaaggaagactaattgttagtgcacagaaggtaaaataaaaacagggagaatataatggtccatatttttccgcaatacttaaacaaaactaaaatgataaaagtaaaatacaatgcagcgtggaagagaggacctctttcatatgactctgcaggaatatgctgagaacagagtgtatttatatttaaagcgtcatgattcagtttcctattctgcatcttataaataaaataaattcagataaattatcctaagtggtactgtgggtcaaatgttcaaagtacattgcagcttttcccaaaagacttgatccactaatactttaacaagagagtgttggtcatacaattcttagtgtcaggaaaaagagcgaggtgaaattgttacaatttcccttaggaaataaatgatgggaatctaagcatttaattccagctccattcctaaactttcaccaactctattccagctcatagtccataggtcagccaacaggggcaataaaaaatattctttgccaactgcattttaacaaatttgagaatcaaaatcaattaaatagatgaccattagcaattcagttgagaatggcaggcttttcccactgaaagggagtggttcccgtgggtaatatctaaaggctcttacactctgttatcaacaaaaagttgggtatgtttcagtttatcagaaaaccaactcactttgtccccattgggtagtgaattaaacctaaattcaacttatctaagtctaaaataagtaattttattagctgatctacctaacactttattacacaatgcattcagtgttgtaaacatggtttttggcaatctcttactttagctcaggaacttagttggaaaacactagacaacatttggataatgacaatttcatcttgtcttctttggagagtaataatgtaaacaaaatgagctctttactggcagccaaatgcaatggagtttgtgtctgttccttttctaatatcggtgtcccagggctattttctgactatgtttctcaaggcagaaagactccacgcctttattcaatataagaatattgtacagcattatcaactttgtttctcagtcagactcttctagtgaaaagtgttactcaagaacatcattaatttatctgctatttttaaaagcagttctaaagttctggtgctttaatggagggagtgtccatgaaaaggtgtctaggatggttttagttgttaggaagggcaaggcagccttatcaaactgatgcagtattacccaactgccattctgaagaagccagaatgaggtgagagagaaaagaattacacacttcaaactaaccaggtgaccttacatccctttcccccagtacacttggctttcaaaaatctaatgtttcacttctttctgcttcaactgccaaaactgtttgaaaaaaagattattacaaaaaaaatatgtatgtgtaggtaagagatgccatttagatcaccgacactacctccaatttcctaagattttcataaaaaaaaaacaacattctaatgtaatttcgaaacatgatgagttatttttgtttagcaacaacaaaaccctaaagttggaaaaacttaatgttagaccagaaaggggccataccagtgatctacttcaacctttcttttacagaggaggaatcttaaaccctgaaagatcatgtttttgcacaaagtcacagcttcccagtgttgggctaagagcaagaagttatcttgtagttttgtcaggtttttttcttattagtttatagatataaaagttgatctatacataaatgactaataatgaactttctatcagagaaatggatggaattgagaattcacagttgaaactgtttaacacttaccaagtgacaaatatcaagtaatttaaccatcatgatagccttgagtgaggtacaattagtatccctgttttacattttactgagaggtaataggcacatgaggctcaataacttgtctacggtcacatacctcttaagtggtgaagccaggattcaaactcagcatctgatccagtgtccttgctcttaaccattatgctattttgcctctctttgtgaggtgcttaggtagtttagagacaaagatgccaattgggggcaaaattctcctgcttttcaacatcttggtgaatacagatttctccttatagctaagtatagccaaataagtgctttttcacttaaaaggccatcaggaccctcaagcttcctagtcttttctgccatgaaggttcttaggaagacctgttggaataatgcattcccctctgtctcctccagaacttaccaaacccaccacattataagatgatgcagagttcgtgccaggtaaagtagaaatcgtgtacccaagaggctgagtgactttaaagtcaggagtcttgaggggggcaagggcatttctggattagcttagactaatgttcttccaccctacttttgtttaggaacagaaagaatattatacataagaacattatggttaattgacaattaggaagattctacatggcagaagttccaacagataagatacgacatacacaagggagaagatctttaacgtatgttcattggctaatttcttcatagcacttctgcaggttaggatggcttccagtgccacaatgtatgttgaaattctgggtaaacattggcatgctttcccccagattcagtgggctgctgtcctggggcacataatcttaaattaagaattgttcttagacatagggaatttatgttcaagatttgaacctcttgactcttcattatttggcttaataagcacatatttgattaagaatacattaaataaaacagaagggctacatgagtcagaagctctaaaaaacaaaggacattatagaacacagacagctagctgctttcttgctctgctaataaaggtctccctccagactgtttatgtagtatgcacagagtgtcaactgatgtggattgtactgaaaactttcagacataattaaccccagtagcctcgtaatgcagtttcaccaataatccacagcccaggctgtaccccagaagaatctaacagctagctcaccccaggcttgcaacatttcatgaagaatctgtgattaaagccagacatgtagacagtaagaaaccatgtggtgcatattacctccgcacatcagttttaatggtacatgctctactcatgacaacataaaaagtcagtacattgtatctaaaattgatacatctactttagaagccaagagaaaaatggaaattagataattaataggattaccctcctaaaataaaaatctcagaataacattctccaataaagaccctctgcttttgtggtacatttgttctctatgtgatgcaatacatatacgcttatccttggcatacacaatggctcaagccttttagcagttgattatgtgcagtgttataccccaatgagagcctcctaacaagatctgaagtcagcaaagtcaaattatcatcttgtacttcttttgcaccatctaagcacctttggagagtgcttatatttaatttatgtgccagtaaagttttgaggattgctactaggtaatgctattaacttgcatatttttgcataaaagattttggaagaaaaagttatattggcacacagggaatgggatagcattgcaaaaatcacatgcatattcaaagataatgacatatgatattctgaatcctacagggaaatcaattcttaattactcttcctgacatttgtcattgcatagcattccaggaaaatcactgaatctcaaaaacttccacattacctggaagaaggaaaatgtgaattagataaatcttttctagaccaatcctgcagattgaatctgagggagggtgttgtacagtggacttttcagtctaatagactgggctaaagtgttaaattattagtggggtaacttcagtaaattggcttaatgtctcaaaatcttatttttcctcattataaaatggtgataatgccactttcttcagtggcttactgtagggaccttactggactggaaaatctctttttgaaaaattcatataaatttatgggatacaagtggaattttgttacatgtgtaatggtcaagtgagggctttgatggtacctatcatctgaataacatacatcatacccattatgtaatttctcatcatccactccaactttcaccccctaacccttccaagtctcatggtctatcattctactttctactggactagaaaatctaattccatcttgaaaatatgtgatccagggttagtcctgtgattgtttagaaaatgccaccttcctgaactgaatcaccttggaatacctatatccttttaagaaccctaagagttgcccttcaaatcatccccatcctgacagcactgaaaaacagaaacaaatttgcattgaccagtattcattcaatgctttggttcttgacgacagattatgacttcatggaatagcttttgccaaaatgcacttggagaattttgaagtccaagtgttacaattcatcatgccactgtaaaatgacagcttaatcacatcagaagaatctttaattaaaacaggtttcacttaattgtttaaaatatactccatcaagaaaagtagttttaaagggcaaaacatttaatgtgttaatgagttttcctacttatcctgacatttgatatcttctgatggcttttgatatgcccatttagttttccctgctaatctttaacactcccttccctagggcaatcattcattcaaccataagcatctgatccttgatccctgaacagaacagcaacatttgtaatttaagtcaaggccatcactttgaattccctgcagccacttctctagactacaggcttccttcaaagaatacctcttgtctacctcatggcttctcatacctacctctgtattaattttatatgtcatttcttttgcatcaacaattaggaatttttataggtacttatcagaatactagctgtcttgttttctaaatttaattgcaagactttaaagcatgggagctgaaatcttaatgtctctttatatgatgcctgcaaggatgtaattaatatttgcaaggcatgatgacaatcattaacactaccactaaaaagaagcaagtcacctgtagcaacacaatcaccaagtgaataattgtgaaagaatattaatggcctgactactttatcgaccaaatattctgtcctaatgatatttcaaaatttggatcttttaaagaggcctgctgctgcagaaagcataggtaaattctctaattttcctaacttcaacttctaacttttctgaatgaatgtcatccttgttatctcattgacccaataaagaattcaaaccaaagttcccagaaatgtctttgttaaaaggtactctgtatacttaaaaggaatagtaaacattttatatgataagagttgccttgcagcagcaactctcaaggttattcttcagtgctgaaatcttgactggaatgatgacaatcagagggtttgctagttcagctaaaagcagcttctgctgccccacagaagctccttgggtcttcttagcttgtagtttattgctttctgagttcaaacatttttaagctggagaaataacagctgagatttttcaggcactcatgagagctttctattttaatgctgaggcatttgaaggccactcaaggggtccacccatccttctcctccctagaggcaatgtcatagatatgagagcctgacagtccagtctctaagaactactgggtgcatggggatgacccacagtgttaattaggagagcaaagtttggtgcatcactctgaaacctcaatggggagtaagagttccactccagatgactgatcatcaaataagaatttggaaggggtcagagcatctggaattatctctgcagataatagctctgtttaggagctgagccagggaggagagagaagtctgtcttgcatagtctggcaagatttggaaacactgggcttctacagattctttatgccttacaaactcattattatatttcacttaataaatctgcatttgctattttctgtaagtttgcttgaaaattttccctgattttggtttgcctattcagcagttttgtagtctctacttcctaagcacctatataccattctcatttcctttcgtctgcatctgcaaaaggtctctttctcaaatccatatggacacaaagtcacctcctatcactctctcaactgctccctttaccagaaaggtgatctgtatttatttttcccaaacaaatctcatgtctttatgcctcctgcttctattccctgaagatcccttgaagagactatactctctaaaaagccatgccaaaccagataaaacacatagaagagagatgatatttcatgaaaatcggagtcaagcagacctagcttggcatcatggctctgctatttaccatctttgtgaacttggactagttactccttaattcttctgaaaaatgaaaataacatcatctgctccatgatgtgtgctactttccgtcttctattcacaatgtccccaatgtcttggagatagtccatatatcttttatcctttgctaaagagattccttcttgaaacttgaattgacaccattcctttcctagtattcttgctccaaacactcagacctaggcagggttaactcttctctctttttttgtacctctgctgccctgttattctagcactcactgtaatgttacaatttttgataaaattaactaggacatagggagaactcctataacccagcaaacagcacaaagcaacttactatatttcctcatatttgacaacactagtgttattcacaggagctagtcctgtattccttttgtcctcttatcccatatagagatatcatagagtatcaatggatactatatgttagagaacaaatactccctcagcatgacaaattgttgtaatcttatctgcccttatagatgctgcttccctcctctactcaaaatgtccctaatgtcttggagatatcctatatatcctttaccctctgctaaagaaatttcctcttggagaaatttgaattgacactattcagctctgagtgttcctaccctaaacactcagacctaggcagggttatctcttcccctctctttttgtgcctccactgccctgttattccagcacttactgtactgtatgattatgtgtttatgcgtctgtctctggttttagtgggagacagcaattattaattatgttgtccccaaaatatttcacggggcctggcatgtagtaagtactgaaagtagttgttgaataatgaatgtacttctaaatagtgtcctctgtaacttttccaatattctacaacaatatcaattttcctggagttagtttttgtgaaaaacaacagatgaatatgatttcctaggtattgcatgtcattaaaaagttttcattagcctcagacctctaaatttccttcactgaattcaccgttaatacagttttcaacttgcaatataaaacataactgctctttaagtgaaaacttgtattaaagccactggtaaatctcaattaaacacaatcatttttaatggctaattgtgaatgacacctggaaacttagataaatggaagaaatgaaatgggaattttaaccttcataaggaaatacaattatacttacagtgaagcaacaggactcagccattaggcattcttgaactcaacagtaattttcaaaacatagattggaaaatttaaagacatttcaaagctttatgctctaaattttctgttatttgtacaagcaaatttcacagagtttgaaacttcccatgaaatgtcttatacactcaagaagcaccaaaaaagatatgtttgttgaagggcaaaaatagagcatgaaggattcacccaccttaaatgtgactttccaataaggtcattgataatatctttcttcattgaaacagcctctttacaatatggaagaagtaactttcagcaacctggtatttgtcctatgtcattaagaaatctatttttaacttagaaggtgggcaatcactaactacatattcacgtgaaattattcattatttcatatacacttttggtctccacatacattttccttcatagttgatatctctcctataacctcagttacacaaataagatagccctggatcacatggtaatgaagcaacaagtttgcacctggtaataaacaagacttccttatatttgaattgcattgtagaattcactatatatttcagacactcacaacctcagggaccaccataaaaaaagaaagaaaacaccagggctgagatcctggctatccaccaaggctgaggtggctgagactttcaaaacccatctgagttacattttcttcttttgaaaattaaatttctaagaaaaaaagaaatagcatttcttactgtgactctttttaaagcaaaagtggaaaattactttttgatggagaaccaaagcccttagacgtattaagaaaacgtattggatgatatcctctgtgaggtgacaggcattgtcataatcaaaaaaatgataactcagcaatcttatgtatattaacaggaagatgcacatcttatatttagagaatctcatgacactcaatattaattgaatgcaattattctccaaatatagtcagattttcaattcctcagcctacaacagtttttgactgtcacaactgggagggaggtgttactggcattcagtaggtggagaccagggatgctgctagatgtgctacaaaacccagggcaggctcctaccacaaagaattacctggttcgaaatagtgctgtggctaacaaatctttatttaagattaatatgatagtgcagtggaaagattactgattagaaatcaaagaaagagaattctagtttaagtgaaatatgatgaggtttctcacatacataatgaagatactaccacatatgctacctaattgatggcgttatggtgaaaactaaataacatcatacatgtaaaatgatcctgtaaaccaaataaagtatcaaaatgaattgaaacacagtgtgaatcctttgagtttaaggaaaccaagatagaaatctgataatattatctgtgtaggtggttttcacatagaatatgtaaagattttaagtaagttatttaaacccaattacttctcatgcttactgaggagaaaccaaggcaaaatgagctaaaatgagagaataagagatatgagttaaaaaatatatagataaaaataggtatagccaaacactagaattggaaattaatggatactgtcaagtttccaattatagttattactgtaaaatgtcggcatggttgggagctgtctaaaataacaaagagtgtgatttgtggagagagattgaagtgacctaaatgacctctgaaagctccttccatacctaagacctccactcagactttataccccaagatgagctgtcaacaggctttggtaggttgtcttgtaggattccagactttgccacattcaggagctcactctttaatcagtcagctccttttggtctcctcatgtctcttttctggtggtcaatttcatcctcaaataatttgcaaaaaaaaaaaaaaaagagagaggtaaaaagctcctttttgttattgcttctttctttataaatcctgatgctgtaatgctatttaaaaatacatttagtaggaaactcaaaaccttcttcttgcacctcccctttcttgctccataaaattcctattgcagtctgagccatgactaacacgtacagtatgcttgcaatgaaaatggttttttcccctacatgccctaactccagattttcaatcttatgactctacgctttgattaagacttaggttgaaagtaagactctgttgtcatcccagtctcaggtcctttgccactgaagtccttgattggaagatctaaccttactgcatattacagttcatttcagtgtggagaaccacaaatagctaatgctactaaaaggggaaaatgcacatggttagaagggggagaactaaatacaaatatagttagccacaaatgtgattgtgtgtatctgggcaataagagtcagagaacatttggctcttccttcaaagtacaaaaatacatgtaaatatgagaagtgttaaaaataatatagttggggcaccactgaccacagttggaaaatttctgggcgcataaaattaagataaattatttcctccccatttattggtgttatatgaatcacctttgatttgatcttttgaaattgctcttctattattctgattataatattcccagattttagccaatccaatgttaaaagttcactctctcacctctatatcaattatttccttttttttttttttttttttttttgctgttttacttttccctccctcctcctaatggaaaccaattagaataatgagggcaaaaggttatatatacatctggtccctgcatttaacatcctgatttatcttttatgctttgttgagaacaatggtgaaaggtgggcaaggatacccccttgcatatattgtcaatgaaaattttttttaaaggcatcctgcattttcacaattttcacatatgtgacatctgaaataactcagacatggcaacattaaggaaagcattgcttcttagtttcatgtttaattgtcagagccaggaaagaaggaggtgaagaaagaaggcaggacttgtatgggctgacgctttaagggactaagctggggcaggcatggctttcattatatttaagtgaattagtctgtttcctttaaacaggagagattaacaagctaccaagggcctgctgtgggattctgacacttttagtggcttgtgacatatgatttgtgaatatcaatttgccttcaaaagcaaaaaagcaaatcttccattagtacaaggttcgccaaaagctgattctaggttagtttggttgaaattcattggaaaaagcgtttgctaagatggggattttatttgatagtgtctggataatttttaatttatactttagacttaaaaatggctacatatagatgtgggagtttaatatgaatactttctttaataaagataatatttcaagttctgaacttgggaactatgggaagattaaataaagaagaaaataaatgtcagcaaccctaagttaacttctcttaaaattttgctttctttgtaaaagagtatgtcttcaggcagtttggcatcaagacaaatatttctcaaactgcaagaaaataaaataaatagtgttcctcatatgtgagaaggttaaaaatctttgatattaaacaaataacaaaagaaatttcaaactgaaagaactgatagaaaatgaattcacactataaaagtattttttaaatgtttccatttatcatcctttgaaaagtaactactgaaaaaaatccatttttttcatctgtttcttttttagccatcaggagtttcaaaataaaagtggtcaggagccagacttttttaactgcaggtaaacatttgtagatggcaagaagagatctttttttgttctttatgtaggcaaactttgtcaagaaagcacagaatactctatggaagtttcctctagctataaagtttaatttgctgatgtagcatagtgactaatttgcctctgtctaattgaaggatttcaaattagactagttgcatcttatcaaagggcacaatagcttagtgattaagtgcacaggaactgaagccatactacctgggttcaaatcctagtctcatcaattattaactactcagtgaagttactcggcttctcagtagcttcaaattttcccatcagtacaataggataacctagtatccacactctaggattgttttgagcattaagtgagtgtacatataaagtacataggcctaagcattcaatatcattagttattattattttctcctattctaaaaacagaactgaaacaatatctaaaaccaggagctagatatcagtagttaagaccattcacccagtttgcattaatcattcaatgctgcctaagaaaattttgtatgctgttttttttttttttaagtctatctgttttttaaatgtaatgtgctaatacacaaagtaatttaaaaaaaacacagtggcacataaagaacacatatgttgattaaaactgaattgcctcaaaaccttgcccaagatcaacatagggaaacaaggatttttttatagttaatgtaacagactataaaaatatgactttaataacaacctattccaaattctaatttttccctttctagtccccagtctgcttcttcacaaaatgtcaatgttactaatttaaaattttactaattcaatcagagtgccagtcactaataaggacatgagagggtaggatggtctaggactgaggcaatatatttctattctatctataatcatagtcactaataggggaaaatatataataagacaattgatggatggcatttttcaatgagtaaaattggaagtatgcaattcagattctttaataataatttgatgccttctttggagcacaaaacattaggaaaaagatgtctttggctaagtgcctcatacaacatagcaccgcatataacaaataatttcaaacctccacacctccatgaagtcttttgggactgtgaaaaacccaaccacactactttaggttgttcagtacaataatcatctcagactaattagttatggccattgtcagtggttacatactgctaaattcagctgaaactataggtcaagcttattaaatgactttgaagcctttgatatgaagaaaaaatatttttaaaaatctgtacagaagaaaaatgcgtcagtgtgtattgtgctgtcaatttttttgttgttttgtttttttgagacagggtctcactcttgcccaggctagggttcagtggcaccatcagggctcactgcagcctcatcctaagtgaaagggatcctcccgcctcagactctcgagtagctaggactaccagcaagcaccatcatgattggctaatttttttttattttttgtagagatgaggtctccttatgttgtccagactgatctcaaattcctgggctgaagcaatcctcctgctttggtcttccaaagtgttgagattacaggtatgggccactgcttccagcccatgtggtcaattctttattaatattttcatattcatgtttcctatgactttacaggagatattccatgaattatatggaatatgaatctggtattatgtgtattttgtaggtataaagaaatgtcacttacatagacatgagcctataatttgtatactcatgaaacacccaaggtggacagagtcacagctttgactgtagtcccagttcactcgtctgagaaaaggtcatctacaggaactgaaactcaaataatctccacagctgaaggaaagaatttctcacaatagaggacttttttctcaataaaccataagacattaaagaactctttgagttcaaaagatggttcctgaggaaactatagaatctcgtcaatattccttcttcatgtttccagttttggaggctgggctgcaaattcaagtgatcactttgagggctaggttcccgccaacactcttggggttagacgcacatacgcataaattcctgtggcttaaaaaagaagaagggaagagctctcaatccctaaaagtttgtttacacgactgtcatttggtgtagcatccccagctcttcctcataaatagcagtggcggagcactctgacatggtgagaaaacagccagcttttgatgaatatcatatcttctcttccctccctccagctttagcacacacgcactcagacacttacaagagtgagctgaaaactgacctaatctcagatttatcagaaaatctctttcaccaaacagggagcatttaaacttaagcatgtgttttaacttactttaaaaattaccccctttttatagaatatactggaactttctccctttccagaatatgtgcaaaaatacaaaatgtgcaaacctggaatatgtgtatgaaattcattctgccaaatttttcagattatctcaagctcaaaagacctttgtcctttcctcccatcacctctacacttaatttagtgttactcttaattttattgttttttagagattattaaagttcagatttctatgtgtgaacatatttgcccccctcctccaccgccaactgtgtgcagtgcatctagaatgagacttttataattttcattttgagcaagcacactagttcattctgagcatgtggtccatagacccaagtttgagaaatatctattactgcctgttattactacctatttccaatctggctttcctctccttctccaagcctgttttctaaatgctcattagaaagaatcttcttataaagagaaataggtagggtatggatctcaaatcagaatgcacaactcttatctgtgggcattctatctctaagaaagtttcagaaacctcctggggattggaatgaacatatgcatttatttgcctagtctcagataatataagtaaaaatccttgaatggcactggggttggtagaattgatcctcatgtgctctttgtgctcaaggtaatcctgggtcacatttcttatctcgttcccttgcactggagccccattcctaattgcaccacctttcccaatatcacaaccatcatctctcttctcaaattactatagtcccagcactcagtagacaaagagtgttgaggagaaaaagaagtaagctccataacactctaaattagcagctgtttcagtcagcctcagctccataaaagctccattaccctaagacttgacaacaaaacatttgtctgctgtctctaacttcatagcccctattactatgagagaaacaaattttctgtaagaggaaatgccagttttagaatcttatttttttccaagccataaaaattcaagtgatgtaaacaaagatgttaataaattttaggagagttgtactatgtattatggaaacattttgagatgtgagaggcttaaaggtaggatgttaaaggaaatctacacatagtgagagaagatagatgataaaagatgttagtttcaaagagtaaatacacagtaatgtcaacataaatgttgaaaaatccttcagaatgtaccagttactgaaatttaattacatttgctatggtttgaatatttgtcccctccaaaattcattttgaaatttaatccccagtatggcaccaggaaccaaaaggtgattggttcatgaatgctctgccctcatgattggattaattcattgatggattaattgattaatggattataatgggagtagaactggcggctttataagaagagaaagaggaacctgaactaccacactcagcccctttgatgtgtgatgttctctgctgccacggtgccctgcagaaagtccacagtagcaagaataccctcaacagatgcggctccatgactttggacttctcagacttcagaagtataagaaacaaactttgtttcttataaattgcccagtttcaggtagtctcttacaagcaacagaaaatgaactaaggcaacactaattacccatttttaaaaattggtcttctctcacctttaaatataaaggggcttctttaaataggaaaggttcccattggtttagcgcctatcttcagaaaaggggcttttgggccaggttaatggaaaccctttaatcaagtcagattgaatgtatcgcccaaaggaaaaacaggctacttttatggataggttctgtatcaaacaaccaaagccctttgcttttgtagtgcctagcagtcaaggtattgtaagcaaataaactatattttaaaataacgttttaaaagcatatagtcaactaaatttgttatccctttagattcaactaaaatttgaggttccattataagcctgatactttcctagatacttttcatagattatttcatttaatcctcatagacggaatgagaaaacaaaagtttagagacatttctgactcacaccattcgttaagaggttagaacttacatctatttgagtccatgcttagtactatctaccacaagatagtgctttgtttttgtcaaattatccttaatttgggctgcacaaagttgtcttagattcctgtattacttttctagggccgatataacaaattactacaaagttgatggcttaaagcaacggaaatttattctctcacagttctggaggccagaactctaatatctgtttccctcggctgaaattaaggtgttggcagggctgtattccatctagaagctctccaggggacagcgtccattgcctgcctctttcagcttctggtgccacattccttggccacattccttggctcatggccttaccactatgttgaaagccaacagtgtagcatcttcaaatctctgcttccatcctcaaatcatcttctgccttctgtgtgtacatctaatctccctctgcttctctcttataaggacatttgtcatggtatatgaggcccacttgaataatccaggataatctcctcatctcaaaatccttaatttaatcacatctgcaaaactttaccatataaggtaatagtcacacattccagggattacagcctgatatttttgggtggccattattcagccttctgtatcctacctaaattaaagcccaaaatctcatttaagtaacagcagctcaaaaatctcaaattgtgtaatgtaaataatggaattcagatatggataagactctgggtatgatctatcctgggcaaaattattctccattactgagtccataaaactagaaaaaaagttatcagttcctaaaatgcaatggtagaacaagcgtagtataacagttataaacattcttattccaaaaggagaaaaatgtaaagaagaaagaagtcactggtcccaagcaatttcaaaatccagcagggtaaactccactaggtttcaaggcctgggaatcagcctctgtgacttgagggtcctgcctcagggcacatggctagagtctctgcttctatgcctctgcacttcctttgtacccaaggctctgcactcatggtgatcctttttctttaaagctatcatgtgtttgcagctgaatagttttatcaacttgcctgtagaattttgggagtctgacagccttccttcaacttgctctgtctttgtctattttagttccagctggcagtgtttctgctgatacaacattctcaaaaactctgtggtcctcccatgtatgtcacagggattcatgccatgagagggttctctacaaatctttcctaggtaacctcatctctattcctgacttctgctgaggtggctgagggaatccatccatcacatgtttcatttcttcagcactatcataaggttgtctagtcgtacccttagccttctcttcagagcatgctttcctaacagtgaatctcccaacttagcatcttttgcaatctggataggctgagaatttcccaaatcatcaagtgctattttgattctgcttaacagttcttttttcactttatctccttctttttgcattttactataaacaggaagaagaaaccaggctgatccttcaacactttgcttggaaatttcctcagctaaatatccaaattcatcacttacacgttctgtttttcatacaacgtagaacacagttcagctacatttctgtagctgaaaggattgcctttcttctagttttcaataacatattcttaatttccttctgagccctcaaaaaaagcactgttaatattaatatgtccaccagctttctgtttatgatgttatatgtattctctaaatgaggtaggcattctctactgtgcctcacacctcctcctaaatcctcaccttagcaccttttatcctcatatttctaacagaagtctgtttaaagaaatccaggtttctttatcatgtgcttcaaaatccatccagcttatgtccactgtccacgtcccaagccactttcacatttttaggttgagttacagcaggaccctgctctaagtaccatatctgtattggtttcttatggcttctgcaacaaattaccacaaagttggtgtcttagactaatataaatctattctctcaatgttctggggactagaaatccaatatcaatttttctgggcctagagcaaggtgtcagcagggccaaactcctctgtaggttctagggagacaatctgttcctttcctcttccagtctccttggctcatgactcctttgtccatcttcaaagacaacaacattgtatctttaaatctttctgtttccattttcaaaatgccttctgccttctgtgcttctacgtatgtctaatctccttgtgtctctcttataagggcacttgtgatggcattaagggcctacctggacaatgacaataatctcctcatttcaagatccttaacttgatcacatttgcaaaaactttacaaatacagtaacattcacaggttccaggattagaacctgatgtctttgggtgctcattattcagcataatatagctttatttcctaatataggtacactccaggaatctggtccttagtctgtgaaataaatatactaaactaaaatattttaataataatgtagttcaatacactcatattatagattaagtctctgaggccaagataaagtaaatgacctgcttaagatccacagtaaatgttttgacacagacaagaccactccctttactcccactctttacagcactttattcttcctctctaaaataattactaagaattgctcattttttaataaccaccaaattatccaagaatccataaacacaactctgaaactagaaataactgtctcatagtcagcaggaattttaaaggggataaagtaatttttaatccccactgaatgttatcagtagtaaccttaggaaaagtagagaaacatgaaaaatgattcacttcatgattacacatttttttaattcagaaattttaatgaatttaagtacttaacagtctcttaaataatgatagccctactaacttatttttcaggttctcagaattgtagaacttagaactaagtgaaattttaagagctaatttacttcaaccatcattttaggtaggtagcatattaatcacctttccagaccaggtgactgaactttgagagtctaagtaagttgaccaagatcatatggttaaaagcagttatttacctaataatatatagaaagaggacttattatatgccaaatactatcttaagtgcatgcatgtaaaagtcagtgaggtgtggttctcactctcaacaagttttctgtttatgaggaaactagatgggtaaacagtcaactaatcaagtgtggtattgcattataatgctaggtatatggtttttggaagcacaggttttgagaggacagcaggaaggtttcccagagatgacatctaagtgaaatttgaaaagaagaagagctgggaaagagggcagggacatcattccaggccgacctagcagtgtctggcaaggctgaacaggaagggacaaggcaggttctagaactgaaatcaacataaaatagctataatgggcactgtagtaacaaacgaggccagggagttggtagggagtaaatcatgagggtcttatatgacatgtgaaggaatatagagattacatgatattatatgacatatgacatgggatgtgatggaatgtagtagtatctaagagggaactagcttgtgtggatttgtgccttacatagaccacactgattaagactaggatggtcttgtgatagtacactgagactgaacaggtgttaataataaaatgccagaacaagagacatttactgggactgtcccaggcaagcaaagatagaagatcaccatcactaagactggcctaggttttatcctcaattatgttaactctataatgtcagtctggcacaataacttttaggcctaattttctcatctaaacatagtatgggtataacaacgatgatcttacccatattacaaaatttttttgagaatcaattgatgaaagcattaatctgctgaagtttttattattcaatgatttagggaatttttcacataatggaataattagtaacaacacaagcagtcatggcataaaagagtaatgagaactaacattgtcaaactcttacatggtgttaggtcctatatttaatacaactttacatttatagtatcatttgtaaatttatgactcattcttccaacagtggtgaggttggtttatctaaacttaaaagatgcagagaccaagacccagggagtaacttggctacgatcacacaactatgaagttttataaataacccagattctacaccaagaagtctgactcaagagctcatagtgtcagtaggggggtgtagtcgtatatatgctgtctgtatgtttctcctagtttgtttaaaaaacacttacatgtactccttttccagaaaaagaagtttagcatactttgtttctttttctgattatctaaaccaagtaaatctaagacaagttagaatacaaatgccaaaaaaaaaaaaaaaaaaaaaaaaaaacaaaaaacccacaactagagcaagaaatactgatgcttcaggtgttccttttggggatttgctggaaattacaaaacctcttcacagtgaaatatacatattaagaacttttgaagttccaagtattttaaattgtaaaataatgatcatttggcaaatcagaaatatgaagaataatgtcattttagtgaagagcagaagaactcttcttttccatgtccctagtataaaattagttcttttttcttttgattaagctacaatttcttgctacttactatatttagattgtcaattataatatagataatactcttttgaaatattcttccactttctttctttttttacttcaaaaagtaaaaatgaaaaaaaaaagtaaagggcaagtttaaataaaaatcatgtcaatgtaatattttgccagaaagtttagatccgcaaatgtaaggatacatttacagacttccctctcacatgataccaccttctactgtactttgctttgtctgtcagaagatgcccacctgcatgcaaactttgtttcctccctgtgatttcctgaaaacttcatgtttgactctgcacccacacacttatgtgccttcgtttagaatattcttccttctcttgttttatctctgtctagctggagtcccttatcctcagtgtgacctcctgatgtcatgcatctctccctcagttagagactgctgtttacttaaattctgccctgcttcttggcattgagtagaaactgccttatatgctcttccaactccctgtgatgatctcctctttctacttctagactacaaatgctttaagggtatgagccaaaaaggtcacagtaataggatgagaaacaaaaaacaactaccaagtttaataagaactaagtatctgtgataatgctgtctcgaaactgtaagttgaaatataagacttattctgaaatatttaaaaattaagaattacttttctttgttgccttttattctatagtcatcaaatctccacggttacctatttcgctattctttttttctttcttttaaccttttacagcttgtgtccttgaaaatattcatcttctattctttattttaagcaccttgttctctcctcaagttaccttcagttttcaaatacaggttgagtatcctttatctgaaatgcttgggatcagaaaggtttcagattttggaattttcagtttttgaaatatttgcatatacataatgtgatatcttggggatgggacccaagtctaaacacaaaactaatttgtggtttacatacacacagcctggaagtaattttttaaaatattttaaatcattttgttcatgaaacaaagtccatatacattgaaccatcagaaagcaaagatgtcactatcttagccgttgatgtaggtaatctgtggttgtttggcatcaccatcattcctgactctgaatttaaatgctactgataagcaatcattttcttacacttattcatacataagtacttaagagtaaacaacatgacataccactattacagtgaaaaaatcatgtgttgggggtaactaggcagcacagtagcatcaccagaatacctgtatcagctgttaagcaacagcagctgaagggggatgggagggtcttttttccccttggggatgctgaataaactgtgcccctgtgtttggactgtgatctgttatatgaggacaggtttggaattttctacttgtggcatcatgttggcactcaaaaagttttggactttggagcattttggatttgagaattttggattagaagtgctcaatctgtttcttctaccaatttcttaaagaaccaggcctctaactttttccccaaaacttcagaacagtatgaatattacaattccaaatcaaatttcaggtagttctattttgagacagagtctcgctctgtcgcccaggctggagtgctgtggcacaatctcggctcagtgcaagctctgcctcccgggttcacaccattctcctgcctcagcctccccagtagctgggaccacaggcgcccgccaccgcgcccggctaattttttgtatttttagtagagacggggtttcaccgtgttagccaggatggtcttgatctcctgacctcatgatctgccctcctcggcctccaaaagtgctgggattacagggtcagccactgcgcctggccgatatttccctttttaaacaaaaaccaagtatatttctccttcctgcctctttcctcaattccagcattgttaatttccacttcatcgaataatataattgttgctttcctgatgtttccccttgaaataagaggaagcatcgtatttactttttcttcatatagtatccttttgattaaggcttatgatgtgacaggcaccattaagctgtgtgtgtgtcaattcagatttcaaacttctgccacatccagcctcaatgtgccttctctgtacttcttgaatgaggcaccaaactctccctttgcagttcccttctcacctcttcaaaaggcttctctagcagtgctctttggggtagttcccttctcacctcttcaaaaggcttctctagcagtgctctttggggtagttcccagttgttttctattaaaacactgtacttgtgtcattgataacactcacttcaatttttcatcatatcacctcttggttaacgtttttgacattatctgtggagagtgtaagctctatgagagcagaaagaccaacttttttcaacaatgcatttattcgtgcctcacacactatctgacacaaagcaagcactcaaatttcagatgaatgaatcaatgaatgaatatacgatctcatttcatctttaccatgtagtaaaaaggtaggtattgttaatatccttgttttactgatgacaacttgcccaaagttatcaactcttacctcgcagtttgcctacaggtctgcggcttcaaagcctgctttcactccgggactatactttttatccctttgaatcaaagcccatacttttaatcactctatcatacctcctctttagcaggaactgggacttagctttccttactttgatagcctggctgcgatgacttctgtgggacttctcttagatcataggttctcatttcagttaatttaacatccagttgaatgccagggcttgggttatatttccctcacacctttcttgtcatgtcagccctttcgcagtgctactcattagcttgatctctttcctgagagttcaaaacccttgtcttcatcactccagcaaagcatctcctcctcctttcacagtatgtgtctaaacactctagggcctcttctctttttctacttttccctctggcttctaaaaaatttcattatgtgatctttaccgtctctcttgcttcctggacgtcagcatatttgagctctaaaacactatttttgttcatcaagtttttatactataatgtgattaacatcactagcacttttctttaatacttgtggaatcatatccttctgcagagatattcccaaaaaatgacacccaaaatctggtaattactgctatgaataccattataaaggtatcttactttagactatcaatagtatgtaaatcagtgtccatatgttaccatttaccccatgttacagaatattaattcttcttttaataattctatcagtaaattaaagttacttaaaatttggaaacaattgtaaaaacaagcttgacttttattattattaaaacataaatttaacatatgtcaatagtcagattctgcatatgatagacttaaatctaattcatcaatcagtgccaaaaaattcttagaagtatatgaaaacacttatggaattaattcagattctaactcctgttggtgtttcaaaaattcctagtaaaggcatacgtatttctatatttgtttcacctgacatacatatacctattttacattgtttcctgatttaaaaagttttattgagaacctaggttttatttttaaaagccacatatatttgacaggggtacacagagaagcttgataatctaagtgccattctggaagttgggaatatcaaagacctccaaatcagcattcatcttttttaaaataaatgaaaactaaagtagaaaaatataagtgttcaggctgggtatggtggctcacacccgtaatcccagccctttgggtggccgaggctggaggattgcttgagcccaggaatttgagacaagcctgggcaacatagtgagaccctgtctctacaaaacgaacaaacaaaaatcagcaaattatccaggcagggtggtacatgcctgcagttccaactgcttgggaggatcgcctgagcccagcaggttgaggctacagtaagctgtgatcatgagtgagaccctgtcttcaaaatcatcttcactttctttctttcatggtagcccagacaaaggcaaaaatgtgagaaaaatggcaaagtagctagtaagtgttatgtatgcaaataatttaaaagaaaataggaaaagcaggaagagttattgggagcaaaaatttaacttggaggaaaaatgcagaatgatgatctagtaatgggataatcagcactctgaagggggcttatcagtggtttgtccacttcacttacagcagagcttaaaagaaattgacctggaatgctgggataagaaggaattcactgcagaatcgaaatgagaagacggtcctgatggagtatattgaatttacaccattgaagatttttatgcaaaataaaaacaaaactatcagctttagatgctacgcatctgaaaatgtctaggcctctggccctgaatgtcaccttgggtgccaagtaatactaatgaatgactttccctgggcttaaaggtatgtagccagttcagaaaccagataaaagtaataaaaaaaaaaacacacacaaaaccaagaaggtgaaaataatggagtgaggaagggacgataaactattagggatttacaatggctcagaagcagggttgtcacagactaactcaaaacaaagctattagaaagaagtcaatgagccttgaattgtaaagactctatgaacatgtcaagttgtcctcaacacaggagcaaaaaaggttaaggatgaaataacatgtctgcttatcagtaaagcatgttaacacaaggtccttgaagaaaagtaataataattacagaaaaacattaaaaatacctttttaaaaaagttctaaatcttgcagcaatcccacactattcagaattagatggaatttaacccaccctattcagaattaggttctagttgtggtgcaattattaggtttagttgacaattctttgaaatttggggtatatcaagttaatcaatactttgccttctattagggttagatgattccttaagagctcaatgacatcattctttgcaggaagcatgccaaaactttgaaaattattcattaataatgcacatactgacagaatgggtataggtaaaggtggacaggtttaggttgaagaattattaggtgaactataaaataaggcaatgctttactgccagcactatgaatctatcagatagtaattggatgcacgtgttagcggcagtaaaaagtcactgtccagttgtccaccttacatgggaatctactctgagtgtcttctttgatgtattgtgccaattagaacacagcgttcaaagaaagaacacaattgatctgatttaaaaggaagggagcctttaaggtcattattttgtgggtgacctggctcccttttagatgtcttgaaactttctatttgtgtaaaatctatacaaattaagtactgggttttaaactgattctgtaaaacatcaacattttgtattcattaattcagtatcagagtgtcactagtggctttccaagatgcaggtatatttcctttcgcaaattttaaaagtacatttctaagctattctttgttgtactgactgactgacacagataaaggtaacatgcactgagaagaaagagtgccgattacaaaataatgttttaaatctgtgaaacaaagtaataaacacccttggtcaaatgtcaaatgtaaattatcttagatcattgcaatataccatgaaagatttaaatccttctgcataaatgacttgagacaaaatgaagttgattacttgtctatattgtgataaaactgtattaaaattacataaacatgaattgtatattccatcttactgtaaaataaaatagatttataatttctggaaggaaaattctaatattttacttatattaagcaaacatcaactataaatgttgacagatgttggaacagtaatactaaaaatgtcatctgaattactcttcattgcaaagttcacagaattaatgttaagatagattaaaatcactttgaactaatacacatatattactcttctttctgaagcataataaagaaatatcatttgcactacaatgtcagataagcatacagacattaaggcttaggaaagatgtagttattcacaggcagctcataaatgggaggaacattagttccatttcaaatgagctgtcaactttttttcaacattttggcttgtggaaagttagacatttggataataaatggggtttgcttctggacattaaagtaattgtatagaaatttaaagtgttcattcatgttctactatcagttctttaaattctaaagaaatgcactggaataaagcttttcactctaaactggatagcataaatgtagaagaaactatgaagacagtggagtttatttgatcctataagacacgcttcttctacttctttttcttttgttaaaattctgtgcctaaacatcattttgaaaacaactgcttttaaagagtcattcacacctttaggtaataggttactgaaatatccaagacctagaatttggtgtctctgaattctcatgctccaatacgggcatctgattcctgacaactgtttccttaggtttctcctcgtaggaggttataaatcaggtttatgaagaggaaactctcttgaattgtgcatttttaatagatttatgataaatccatcaaagtggagggtccatatggtaggaatgcagtaaaggtaacaggacaatgtcatgtaaacattaaatacagtgtcttccaccttcataaatcctcaatgctcgtgattaaatgctgccggttataaattatgcaaccaaattctagaaacaaccacaactgaaataagataccagtggaagccataaattgtttttcttcacagaaaactcttgtgtcgttattagaagatcacttctgagttcctattttcctcaacaattatttttttctcacttcatttagcttcctacaataagctctagtcctggttaaaaagtaataatcccagataataatctatcattttatatggtaaagtgtctttttgatttgcaggtttattttaaaattttcttaatatgtatggcttaagtctctaagacgtcgccctttttagagtcatatatcagaagtttctgcaacagtccaatttatcacaggtatttacaatcaaattattttattacacatgggaacaattaaacatttggccctcagctgtaaacaattactatataaaatgacattcatggatttttcttaaatagtcatgtattcctaatgacctctgttaacatgagtgagattgatgtatgtgtattttgtgtgtatccataagcaattatattcccaaatatcaaaagagagagtttacctagagaatacactaaccttgtctgatatcatgtggccacctgcaatgacacgtttaatgtatttgtttttctgcaattgtcattttatttctgttccaatttaattctaaagaactgcgggtgttcacagcaagaagcaagtaaagatttggataatttgttttttagagatttgaggtgtcaaattctaataaattgatattaatgttggaagtagcagaaaggtacaataagaaaggagagatacaaccaataggctggggcttgaatcctggttctgcccatgtctagttgaatgaccttggacaatttacttttttcagtatgagttttcaaatttgaaaaatgttgatagttgtaggactattatgactattaaatgaagtgtgtatttaaagagataaagcctatactacatactctttacatattgatttctctattgcctcccattcttctttcccagaaaggcccaggagccttttttgtgagtttccctttttggaatatctattcttaattgtctcaagtttagggtacattttcctttcactagatccctcttttctacaaatgacaaccatgggagaagctcacagctgttttactcacatccagaaataagtcaactggtcccagttgcaaggatacctaacagctgtatccagcctttctaagaggtcagaactaaagccgagtggtaaggtttcaagggcaaagctctagatgtaaagaatgataaaacaaaacctaaatgagcctacacatatctagtgacagatacaccacagctattctaaattattcaagctttctcagacttctagcaggagaaacataattcatctctgctctctttattctactctcatatcatggcaaagaagcaaacaaaaagtatagccccccaccctcaaaaattataataatcacccatatagagaagagctttgttaacgcatgtagtctttttagaaccatcgaatttctgggaactagctttgaaagtagaagttaaaaatgattttgcaatacttatgaatgattgtcttacttcccttttgttagcattctgctggcaaaaagccagaaaacagttgtttaattacccaggacaacaaaaacatataacctcttagataagctgttactgtattttagcagcaataatactagggtcaaaagtaacaaagaaaattaatcttcaaataagcaaacctcaaaagaacagctttgtgtattgagaataattaataacttgtttaggaaaatgttactgaaatgtggtttttggaaaaggaattgacactcttcagaggttagagatcctagtatttaacaagctaccatttggtggacagctggctggctaccctgtaggcatggtaaaagtttgttcacatgttattatgcaacgtttagacaatatcttaatgataccatgtagttcagctgaatcagtccagctggaaatcgtagcagcatttagattacctggccacatgtgaaattaaggctttttcaatctctaattttcacttgctatgttttgacacagatgttcttggaaagcctaaattatttatggtttgacaatatttagcagagtgaacccctcccctttcactgttaaccgttgattaagattgcattaccatataagatatttagcttgtcattataacaagtaatatatgttatcacagagaaaataaaatattagtatattttggacagttaggatggaacttttctacaccccttttatacaatatatattgtatacttttcttctttgcagatagttcttattgtaaagatgaaattcagtgtgtactgtggaaatcattttactctgcagctaatcacacgtgattattattctagaaaatagcaatttaggttgtgtaaactaaaacagagcagatttgaccttaagtcatatcataaagacatttaaagtatagcacaaacattttttaaaaagaaaaatgtttgctcaaggataacactctgaaactttatcatattcttttgagttttctccatgaaaaataagaaatgagtccatcagaattttttgttgttgttgttaattcccagctcactctgtccagcccaatgtttggatagcttcttccccatcctgctaactgaatgacaccacaactattttattttagaagtaaataaagtttttaaatttttaatcgaaaaaccttaaaggttatatacataggatctaatgaattcgggtaacaaatgatttttaagcaaaaataattgtcatcattatgacattatttcagctactttctttgaatcagataatgtggtacttaatatctttagtatgaaacataaaatgaaacactttaaaagcacctctacacgtatttttattacttataaacatattgtgaattttagtaaatagaaccagtggctgaggagaaacagaagttaatgttgaatgtgtgtgcatccccacagaagaaaactaaattcttaattcttgtaaatttgtattcaaaaataaaatgctaaattctggtcaactgtcattcccattagtacctggtactttctaaaccaaggaatcttgaaatgtttgactgacgtatttaagttaactgacaagacaatctatgcttagaattcctgaacaactaacacaaaaatgtcccctttaaaggtgacttggaatttaccattgagataatgccaaatggtcactaaagatgtttaaacatcattgtctactgtcttcagtgtgccattacagagccttgggttcctttcacataacaatcaatagtggatgaataagtctcaccacttgaaagtatctgagaaaggaagtcaacagagtaatctgggtttgctgggttgattcaagaagagacacaatatccacccctcttcttctagttctcttcccccaaccagcccacacccctgcaagaaagaaagaagggaaagagagaaagaaggaaagagagagggaaaaggcaagaccaaaatgtagggatcccaggcataatttacgctgaggagaaaatgtcacactgtgggataaaatatagccatggaaacagacttatgacttttactttgaaaataaaagaatgacaatgaaatttgtgtgaggtctgtgtgaatccagtcccagatgtttacaatgctgtagtagtatggctctgcaatatgagaggtttcagaagaaacagtacaacaggacaccacaaagcagtgcatacgctattgacaatgcagacatgagcatcatgttaccaagagggaaggcaggcagaagacaaatagcagcggtggtgcctgaaaagctaacttcatggactgcaatcactcaaactaacataagggacccaaaacaaaacaaaacaaaacaaaaatcaaaaccagaaaaatgcttttcgctcatatctagaggtagtggggtaaagggatgggggtggggagagagtggaattgacttttctttcttaaataaagttcccacaaagcccctataattgacagcggataattattttcagcttgaggagcctgtcccaaaactcttaacaagattgccagggaaaagaaacaaaatgtgtttacttgagccatttccagaaggaaggaaaaattgctctttggatgaggtgggaaaggcggtggagagagaaaggggcatctttgcactgcaacaactctcttgagcgccctgcgtggtccggctagtgacaggctggagggaaggggtgggtagagcggcaaggggtgggggatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagaggagaaggaggaggaagaagagttggtggcctctggtgacaccatgtcctgaccaagggcttggcaggtgacagggacggaagacaccaagaacagcaacaaaaagcagcagcagcagcagccgggcaggtggggaaaggctgaggcacaatgtgtcagtatccatttccacat

SEQ ID NO: 2014 - DNA, 172171 bp, Homo sapiens
tttctgtcttttttaacagtttatttttcaaattttctaccattggtatgtattaaacagacttatggttaatatataccatttctgtatattttatgattccaatatataattatatgggttgtctcttgcttctctcctctgtcttttccctgtcttcacatgtataccaaacagggcaaacccatcaaaagtaaatatacaaaaatcttacagtcttcaaggaaggtgataagaatgtttaatttacttttcatagttcatattttctgaatttttataacagcatatatcactgacaaaatattgaaaccatactttaaaaaataaattcagaaattgttttaacaaaataagcaggaaatatataaaagcaggtaataaaagtcatcaacgtacacagtgtcttaataaaagtcagcagttggagtagaaattactattctaaggtttccagaaaaacctaaattagcttatgaattgctatatttagaaagaatatgaaacagaatatcagcaatgtcattgcaacattgtctgcaatacattaaatcagtttaattgttccttaggcatctgatctaagaaatttttcagaggtgctaagtcaactttaagttaaattatgaccaataagagaaacattttaactaatctttatatttttagaagacttatatataaatccatcttgtgatgtagagtatttcttgctttagagtattatttcaaattccttcaactaaaaataatgactataatttaagatgatcataggatgtgatctggcattgattcattttatcagtccattgggaactttaaagtctaaatttgttttcacaattgctacttttgttttagcatcttgaagtctttcacaggctttttcaaaggcaatcatatccataacaaatttttcttcacaatgtcttttatatatttcttgagatctaagaggagaaagaaaggtaatagaatgagatacttttaaatactgaaaccatggcaatctattagactattaatgataataattagatgtcttcgaaataggcatatacaagtgagaaagacacaactccatttatataacttggttatatcattaaacaatactcagacaagtatttatgagatatctataagctataattaaaaattctcacaaactatggcttagatttccaaagaggcatctaaactaccctatgtcatcacctaaaatacatctccttaagcctcactaaacccaagctacttcttcgactctgttatggtctgaatgcattccaccatattcatatgtcaaagtcctaactcccagtgtctttgaatgtgactatttggagataaggcctttaagaagtagttaaggctaaatgacattatatgggtaggtcctaatccaatataatttgtgtacttataagaagaggaagcaagagcagagatgtgagtgtacagaagaaaggccatgggaggacacaaggcaaaggtggccatctgcaagccaaggagagagggctcaatagaaaccacacctgctgacactttgttcttggacttccaacctccagaactgggagaaaataaattactgtttaagccacccagcctgtgatattttgttatggcagtcctagtagactaataccctgccaaaccggggaaatgtcacaggtcttaggagatttcattcattcatccttatttattcaacaattatgtattgtgatgcatggcactaaccttagatgctggagacataaatatgacatgatgtaactacatgaagcttatcaaaagttaagagaaataaatgtatataaatatacaaatgagatattatggttcatcgtgaaaacattatgtaacaagtcagagtgaggaaaaacttgagtaaaaacttggtaaatataaactaaagagcaaggaggggaagataaaaaaaagtttaaagttaaaataacctttgaactgaatcttgaaagatgtgtattttccagtcagaaagtggaagagaattttgttcaaactatttttatatcacgaacatggtcaaaacaaaggtagagagggtagcacagcttggaatgctccaagaactggcatcaatctaattgtctgggtcttacagtctgggaaggagaacaaggcagcaggcaaggctggagaaacaaatttaggccagatcataaaatactttatttatgtgtaggtatactcagaaatctgaagttgaggagaaaaagagagggtgaagtctaaaaagcctgcagcttattgatgatgtgattttagacaagatattcatgttctttctctctcattttcttcattgttaaggagataacctaactcatagggttagtaaaggactaagtgggttgatacattaaaaattcttaggtgaatgcctaatattaaataattaattttactggatggataatagtggccttcaacagaaagaaatgtaggtagagcaacaagacgggaagaaagattagagttctgactggaaatggttagtgttaagagcctgcttattcatgtggtgatgcccagggtgttgaatatagagaagtgaaggcttatagttaagagtacaggtagtaaagccattctgcttggctctgaaatgtattgttggtgtgattttagataggttatttaagttgtctctgtattattttttttcatctttataaagaggacatttcaactcacagggtttagtaggaagtaaataaactaacacatttaaaatccttaaaggagtgcctagcatttaataatcattttagtagtagctaaaagttagctactagtactataagcctagaaatcaggagagtagtcaggtctggacgtgtagcagagtagaaatcatagcaaaggaatcttgcacatgtaattaaggatagtaattaagtcaataaatgtactaaaatagccctcttacagataaacattataagctgtgaagaaaatgtaagtaaaataactatttaaaagtcttaaagatttttgcacattgattttgtatcctgagactttgctgaagttgcttatcagcttaaggagattttgggctgagacaatggggttttctagatatacaatcacgtcatctgcaaacagggacaatttgacttcctcttttcctaattgaataccctttatttctttctcctgcctgcttgccctggccagaacttccaacactatgttgaataggagtggcgagagagggcatccctgtcttgtgccagttttcaaagggaatgcttccagtttttgcccattcagtatgacattggctgtgggtttgtcataaatagctcttcttattttgaggtaatttattgagagtttttagcatgaacagctcttgaattttgtcaaaggccttttctgcatctattgagataatcatgtggtttttgtctttggttctgtttatatgctggattacgtttattgatttgagtatgttgaaccagccttgcatcccagggatgaagcccacttgatcatggtggataagatttttgatctactgctggacttggtatgccagtattttattgaggatttttgcatcgatgttcaccagggatattggtctaaaattctcttttttgtgtgtgtctctgctaggctttggcatcaggatgatgctggtctcataaattgagttagggaggattccttctttttctattgattggaataatttcggaagaaatggtaccagctccttcttgtacctctggtagaattcggctgtgaatccatctggtcctggactttttttggttggtaagctataaactattgcctcaatttcagagcctgttattggtctattaagagattcaacttcttcctagtttagtcttgggagggtgtatgtgtcaaggaatttatccatttcttctagattttctagtttatttgctcagagagccaaatcatgagtgaactcccattcacaatcgtttcaaagagaataaaatacctagggatccaacttaccagggatgtgaaggacctcttcaaggagaactacaaaccactgctcaacaaaataaaagaggacacaaacaaatggtagactattccatgctcatggataggagaatcaatatcatgaaaatggtcatattgcccaaggtaatttatagattcagtgccatccccatcaagctaccaatgactttcttggaaaaaactactttaaagttcatatggaaccaaaaaagagcccgcaatgccaagtcaatcctaagccaaaagaacaaagctggaggcatcatgctacctgacttcaaactatactacaaggctacagtaaccaaaacagcatggtactggtaccaaaacagagatatagaccaatggaatagaacagagccctcagaaataataccacacatctacaactatctgatccttgacaaacctgacaaaaacaataaatggggaaaagattccctatttaacaaatggtggtgggaaaactggctagccatatgtagaaagctgaaactggatcccttccttacaccttatacaaaaattaattcaagatggattaaagacttaaatgttagacctaaaaccataaaaaccctaaaagaaaacctaggcaataccattcaggacataggcatgggcaaggacttcatgtctaaaacaccaaacgcaatggcaacaaaagccgaaattgacaaatggggtctaattaaactaaagagcttctgcacagcaaaagaaactaccatcagaatgaacagacaacctacagaatgtgagaaaacttttgcaatctactcatctgacaaagggctaatatctagaatctacaaagaactcaaacaaatttacaagaaaataacaaacaaccccatcaaaaagtgggcaaaggatataaacagacacttctcaaaagaagacatttatgcagccaacagacacatgaaataatgctcatcatcactgtccatcagagaaatgcaaatcaaaaccacagtgagatatcatctcacaccagttagaatggcgatcattaaaaagtcaggaaacaacaggtgctggagaggatgtggagaaataggaacacttttacattgttggtgggactgtagactagttccaccattgtggaagacagtgtggcaattcctcagggatctagaactagaaataccatttgacccagccatcccattactgggtatatacccaaaggattataaatcatgctgctataaagacacatgcacacgtttgtttattgcagcactattcacaaaagcaaagacttggaactaacccagatgtccaacaatgatagactggattaagaaaatgtggcacatatacaccatggaatactatgcagccacaaaaaatgatgagttcatgtcctttgtagggacatggatgaagctggaaaccatcattctcagcaaactatcacaaggacaaaaaaccaaacaccgcatgttctcactcataggtgggaattgaacaatgagaacacttgaacacaggaaggggaacatcacacactggggcctgttgtggggtgaggggaggggggagggatagcattaggagatatacctaatgtaaatgaggagttactgggtgcagcacaccaacatggcacatgtatacatatgtaacaaacctgcacgttgtgcacatgtaccctagaacttaaagtataataaaaaatatatttaaaaaagtcttagagaatgagaaatatgaaataatcaattatatcattatatccatgtataccaatgtcaaacaattggaaaataaaatcaagtgattccacttacactgtgaccagaaaagcataaaatatttagacataaatgtaataaaagataggcaaggtctatacctaaaaatgataaaatattgctaaaagaaatttaaaaagatctaaattaatggggagttatatcatctcagagattataagataatattatgatgtcaatttttcccaagtggatctatggataaataaaattacaattaatatgccaagagcctctatgatagaaattagaaattaacatttacatttgttttaaatatatattaatttaattcagatttattttaaatgtgttaaatttaaatgttttgaatttattaaaatttaaatttatatgaaaatgcaaaggtcctagaacaaccaatacaatcttgggaaaacagaacaaagttggaatctatttttcattccacataacaatttacccataaatgtattggcttacaacaaccaccttataatacctcatagtttcattaggtcagaagtccaggcacattgtggctagttgggttttctgcttaggtctcacaaggctgaaatcaaggtgtcagccagagcaatggttctcatttaggtcttgggtcctcatccagatcagtggttgttgtcagaattaattttatcatcactctttccctgtgcttccctctatttttaagtcagcaatatcatgtaaaacccttcttatactttgaatctgatgttctcttttgtctctgtatttgaaaggctcatgtgatacattgggcgcatctggataatccagaataatttccttatgttaaggttaattaagcaatattcttaattacatatttaaagtccctttaccaacacattcacaggtgtgctatctcatcatattcatagtcctgggaatcaaggagggcatggtatctatcttcttggtagccataattctgactaacacagcagccttacattacttgattttaaagattataagaattataagaggagagtttattagctttttacagaaaaatggaaacctaatcatgagacagcagaaaaggaaactgtggtaaatataaaatatatagaattttataaatatggatataggaagttgaatgaattaaagcttgaagtcctaaaatttcgttgggaaatagataaattatcttgttgagaaggagaggccataagtggtgtttgaatagaaagctgtactgttgaagattttaaatggctcttgtaggtaacaggagaaagagcaagcaactgtgggagcagctcaagttggagaccataaaattaatattggcataaatctgtggggcattgatttcttctagacatttttatccaaatacaggaaataaagatagatagttgaaatgttccaagggttgtaaggaacattttagcataatcaaggcaatgaaatgaaagaactttagagacactggagagaatggacaaaataataattgaattaaagaacctcggagcctacactagaaatgaaaataaaagtgtataaaggaggttatttgatggatgggtgtcaccatatatttggaggatatgtgtggtggaagtaaaggaagaaaggagttgaggaagaaaggagttgaaaagatagattttagttataaataaatatataggagttgaagatttaagaggtggggcagttccaagtgataagaggatctttgtatgtgtctatggaaatcagtttattaacgtccggtaggataaagattgttggtgtccaaaaatgttgatattaggtaattgggagggctgttcttatgaatttggaagttaacaatgattatggcagaaattggatggagagaaaaagcttcataagtcaaaatgatgtaaagaccacagtaaatgaagatggtagtatgggaggtcaattgatgaccaaataaggacaagttgaagatgatgtaattgaaaaaccactttattttctagctcttccatgctaagtgataccctacttcaaaatggacaccctgctctcctggcttgaacagtatcatcactttctcagagtacagacatgaatatcttagaaaaacccctgactagcttttatctgatacatagattctttcatttcaaagtctatctttaattaatgcttaaatactcctgtgggtattttattaactttctaaattagagctttatggttccccttttttcttttactctttctcattccacatagcaggattagggagctacattctcaataatgacttcactagttatggaaatttatcagaatgcttttaggtcaagagaataaagaatcatcagcggaaaaagtatcagaattgaaaaatttcagaagtctccagttagatttcactttttgatcacatcttctttctgtatattgatacctaatctttatttgaaaatatttagagtaaaactcaaagatgcctactggaacatactactcgcataaccaaaacattgccctattcttatgtgctctgcaggttaatacttttgcagtagcttatgagagaagataattcagttaacatatattaggatgcttgtttgagtctgtattctttaaaaattaattatggccagatattcattttactgtgaaaaaactaagctgattaaattagattgatttgcactagatttgtatttcaatacatactagctttcattttcttttccaaaatacttttttaaattaaaataagttataggaaatatttccaaagcacacacagacacacacacacacacacacacacacacaccacaaagtgtacactaaagaaaatgattttaaatatggagggggaaataaatagtatttttcatacgtaataaagtattacataaaacacatcagtaaatagcttaaattgcttataagtaggaaaaggcaaatgcttttttttatttaaaacttctttctagcacaggcttttaaaaacaatgttgtttaaaaatttaaataaaataagcagttctgaagatctctaaatgtttctatacaagccttaaatatgtatgtacataatttggccatttgaaatagcactaggataaaactgtggctgaccagtttcaatctaatatcagagaaaaaatgtgtgaaagactttgaaagggtaaaataaaattactaggagtcctggctagtacacccttcagaactatctgtgcctttcaatctccgtgaacaattttacaactctaaattaagaaaaactgtgagcaatacaaatgattcttctttatagagatataaataattgtgttcagctaagttacgtttgattattgcccagtgaatattgactagttttgcacctatctgtgaatttagttcagcatttttgattgccaatatcaatatagacatagaagtagacatagacatagacatagatataatatatagatagataaatgttctttgaattctcataactgatttattctttaatgagttaaatgatatctttggcatgtgctcattttatatttatatgggtcatggttttatgttcttaaaaatgttccttggcaattaataaaatttaaattgactagctgtaagttaaaatattttgagtcaacaaagctcctactttaccaaatttggtttaaaactttaaaaccttcaccataaaacaatttctatttttgcaattctttgagaaagttttgtccaaagtgtgccctaagaattattttctgagatatttcttgaaaggaaagttttatggtaaaatacatgtgtaaaatgcaatatatctttctggtaggaatcctaatggtctttactgcacaactgtctactgagacttagaggctctttttaatcaagttgatgtttctcaagcaattgcactgtcaactactcttcataaactttctgctataggtacaggaatattcacgatctccttgatctcccctagctttacctattttgaactttccaactttgcttatcctcttctccttgcctcacctctctactataatggtctcctctcacctctctgcttttccaatgtgaatcaacaattgtacttctcctactactattttttgtaacaattgaaatgtatgcttatgtttgccactggactgtgagttcttagaggatcaagaatatcttattcatctttgtatggcagggcaagggagaatttaagtgaagtaacactctggtttagttaaggcttctctttgaaggttttgattttggagtagcaaaaaatgctgcccccaaatatggcacattggcacactatgtattttaagctgaaggaaactgagaaacttgcagaagcagaaagattgctctcaacttccgcctcctgtcttttaaacactgtgacaagtgccatgctttaaaccatgagggaaggaatattatatagaaaggccaagaagaatctgaacaaacaggccttgcttggtacccctcatccccagtttattaccattaggtcatacccttttctttttgttccaatcatacttctacaaaattgtctattcttcatcaaatctaagcataaaaatagttgtccctgggtcttcattttagaaagcttctaggtcacataacattttgatgaaataaatttgttatgcctttttcttgctaatctgtctttattatagaagtgtcagccataaacccattaatgtacccgaaattttaattgtctattcgtaatgtttgtgttattgctggtattattatgtaactctgttaatctcattgctttttgccatatttcccacctcaattttcagtttcttgggccaaatgatctttacatgactacatcacctgtaagagaactcttcaagagctagaaatgaattactacttgaattatttgaattgaaggtaggtactacttagtagaagcaccaatgatcacagaggggcagaaaaaaatgtgcagggcaaatttactgccatgaattaagcacttgtactaagaagtttacttagtctaatgattagtgaagctactttcgtaacttggttaattacatttttactctatgtttaatattattctgattatcttcattgtaaaagcatttagaaaaaatatacattgcttcttattctaaatgacttaagtacaaatatgtaaaaagcactctcttctcagtggttgttatatgacttaaatgagtttatatacaacctttactaattgaggttctcgcctattttcctcaagaaatgtgtgttgaataaatttgttaactaggtactatactgggcattgaaatagaaagatggagtgaataatacaaagacttgattattttcttgagggggtggggccaaaatggctgactagaagcagcagtgattggaggctgtcatcaaaaagaaccataactgcctccaaatcctgcactggcaactgaggtatgcagggtcttcatcaaaactgactagggccaggtgaggtgactcacacctgtaatcccagcaatttgggaggctgagggggacggatcacctgaggtcaggagctggagaccagtctggccaacgtggtgaaaccttgtctctactaaaaatacaaaaaacggcttggtgtggtggcggacgcttgtaatcccatactcaggaggctgaggcaggagaatcatttgggaggtgaagggtgcagtgagccaagatcatgccattgcactccagcttgggcaacaagagtgaaactgtgtctcaaaacaaaacaaaacaaaaaacaaacaaacaacaacaacaacaaaaaacaagaactgactaggcagctggtatgacccatggagaggaaggaagagcagtgtgctgtggtggcccacctaagagccacacggggcaggggagcccccacaccccagtcaagggaggtggtgagtgtgctacccagcctaggaaaccgtgctttttccatggaactgtgcaacccaaggattggaggatcccactcatgaacccatgccaccgggaagccatgcagattctcaacagccactcaactagaatctgcttaagactcccaggggaggggcaaccagcaccacagctgccgctgcctaatgtctaagctgcctgaggtccttaggggagaggcaccagccaacactgagactgatagctgcctaacacattaagctcccagggcgggtatggggcagcagccatctctatagctccaggatatgcttttcccctgatggagccagggagtctggatagcttcgtcccaagaggtatcccccacagcccaacacaccggctgtggcagactgcagccagaatgcctcttcaggcctgaacctgacccatccctcctcactgggtggggtctccctgcaggaactccaacaactccagccaggggctcagggacagaagcctgatctccctgggcctgagcccccagggtgaggggtggccacagtctctgcagaccagcagacttaacctttcctcctgctagttctgaggaatctgggcagcccagacaagtgggtttcccccccagcaaaacacacctttcaccaagggatggtcaaagtgcttcgctaaacaggtcctgctccctgtgccactcaactgggtgagactcttaaacagggattgtcagacaccctatacatgagcattcctactgagatcaggtaggtgcctctcgaggtcagagatcccaaaagaagaagcaggcactcatctctgctgttctccaacctcctcaagtgacatctccaggcacaggagtgaaccagatgaatagtgcttgaagcgaacctctggcaaacctcagcagccctacagaagagggacttgaccattgaaataaaaacaatcaaacagaaaacaacaacaatagcatcagcaaaaaagagttcccaactaaagccctatccaagggtgagcagcctcaaacatcaaaactagacatattcatgaagatgagaacgaatcaatgaaaaaatgctgcaaaaccaaaaggccagagttcctcctctcctccaaatgatcataatgcctctccagcaagggtgcagaactggacagaggatgagatgggtggattgacagaagtaggcttcagaaggtgggtaataataaacgccactaagctaaagaagcatgtgctaaagttcttagcaaagaaggtaagaaccttgataaaaagttagagaaggtgctaactagaataaccagtttagagaggaacataaatgccctgatggagctaaaaacataggacgagaacttagtgaagcatacacaagtatcaacaggtgaatcgaccaagtagaagaaacgatatcagagtttgaagactaccttgctgaaataagtcatgaagacaggattagagaaaacagaatgaaaggaatgaacaaaatctctgagaaatatgggactatgtaaaaaaaaatgaacctatgactgactggagtacctgaaggagatggggagaagggaatcaagctggaaaacacatgtcaggatactatctagaagaacttcccaaacctagcaagaaaagccaacattcaaattcaggaaatacagagaacaccactaagatactccatgagaagatcaaccccaagacacatatgggcagccagagagaaaggccaagtaatctacaaagggaagcacatcagactaacagtggacctctcagcagaaactctacaagccagaagagagtggggaccaatattcatcattcttaaagaaaagaattttcaacacagaatttcatattcagccaaactaagcttcataagtgaaggagaaataaaatcctttccagacaagcaaatgctgagggatttcatcaccaccaggcctgccttgcaagagctcctgaaggaagcactaaacatggaaaggaaaaaccggtaccagccactgcaaaaacacaccaaaatataatgaccaatgacactatgaagaaactgtaccaactagtgtgcaaaataaccagatagcatcatgatgacaggatcaaattcacacataaaaatattaacctaaagtgtaaatgggctaaatgccccaattaaaagacacagactggcaaatagtataaagagccaagacccatcagtgtgctgtgttcaggagacccatctcacgtgcagacacacataggctcaaaataaaggaatggaggaacatttaccaagcaaatggaaaggaaaaaagaaaaacaagcaagggttgcaatcctagtctctgacaaaacagactttaaaccaacaaaaatcagaaagacaaagaagggcattacataatggtaaagagatcaatgcaacaagaagagctaactatcctaaatatatacgcacccaatacagcagcacctggatccataaaacaagttcttagagacctacaaagagacatagtctcccacacaataatagtgggagactttaataccccactgtcaatattagaccgattaatgagacataaaattaacaaggatattcaggactttaacacagctctggatcaagtggacctaatagacatctacagaattctctacaccaaatcaacagaatatacattcttctcagtgccacatggcacttattctaaaattgaccacataattggaagtaaaaccatcctcagcaaatgcaaaagaactgaaatcatagcaaacagtctctcacaccacagtgcaatcaaagtagagctcaggattaagacactcactcaaaaccacacaattacatggaaattgaacaacatgctcctgaatgactcctgagtaactaatgaaattaaggcagaaatcagtgttatttgaaaccagtgagaacaaagacacaacataccagaatttctgggacacagctaaagcagtattaagagggaaatttatagcactaaatacctacattggaaagctggagaaagatcacaaaatgacaccctaacatcagaattaaaagagctagaggccggacacgttggctcatgccaactgaggttgatagcactggtcaagaggctgatgatgatgccatttgtgataataagaacaactcataactaagaggtagataggttttgttgcacaggtggagagatggggaaagacagagttattttattgccttatctttggtaatatattagtatattatttgttctttgttttaatttttcaaagtagaatgtactatgttacaaacagcatactaattattaggtcttaaaatttagcatgcaatattcacatgtaattgactttaatgcctctgttatatctaaattgtacctacctaacttttttcatttctttaagtaaattctttctatatttttctgcttttagtttttgcttaacaatcaggcttttctcttttaggacagcctcattcttctccagtctgtcaattttaagtagtcctctggtcaaaagagtgcgctcattatttaagttttgaactaataaacgctctgaagccttttgggatttttcttttagaaacagagcttttctctctctagctttttcaaggtagttgaatctgttttgccaaacttgtcgtaaactgttctgaattgtctctttattttcttcaattagtttttgtgtagcatattttttctgattcaaatgttcattaacagctactctaactctttctcgagcaacttgtgccatggctacaactcttactttttctttatggtattcctgcttcttttgttctgtgtaatatttgtcaatatcactaaatgttcggagtttcataccagctctttgtggtgcaaaaaactctttcatactccgctccaatcgtatgtcttttttaatgattggctttggatgagtagtatagattggctgaggatatgcaggaaaaaaatgttgttttttctctctcaatactgcattattcttcaatgaacctgaagtgtatatgggtagtttgaaaactgatatcctaaaactggtatccaatttttcatccacaatttcatcttcagactcctgacctacatcaaacagaagcaaatattatacattatacaagagctaagtacattttattttctctccaaatatatcaataaacttgataagaaccttttatttactttactaagaagaatttttcccaagtaccttttcaacttgtgatttaatagtaactttggagaagaaaatcactattaaaacattttcacatagaaatgcactgaatctaattcttatattttctgtattatcttccacaattacttaacttgcagtgactcaatagcagcaacttatcacatacttagtactacttaaccacacatattattttttcatatagtttgctaaaagaaacaaagtttaattaagcaaagaataattcatgaactgggtagcactgagaaccagtgaaaatttagaaaactctgcgtaataaatgagcagggagtatttatagatagaaaatggaagaaatatagaaacagcttgattggttatggttcaattttgccttatttggacataatcatatcagttggtggcctgtgattggctgaagcttgactgctgtgattggctatgacttagttatcttttacaaaaatatacctgtaagttaggctttcagtttgtttacatactaagttaggttgcaattcattatgtaaggactcaaggaacagaggcagccttaggccacatttaacaagttattagtatgtcatatttgcaaagggcattgtaatccattttaccttatttttcttaactctggtggaaaatagtagcagccatcaatcgtttttcccttttttggacagacaaaattactaaaactcttagcttcctttgctttcctttgtgtgaccatgggctaagtcctttttaatagagtgtgaacacaattgttatgtgttattccttgtccaagagattgttttaagaaacaatgtgcaccttctttccactacgtagagatgagaatgaaaccccaaaagatggtggaaccataagatagaagctgcctgcctgcctgaatcacttgttgaaaaaacttctcatggaccagaatcatccaagttgggtcatttatgaagccagaaatcaaaagtaattatgtttcagtcaatatgcatttctgggtctatttgttactatacccaacctaattaatacaataaattgaatcacattgttgtttgcatatttactttttgacaaacctactaatgaattcagaatcaggtgacaaatacaagtataaaagttatgcttgttaatttaggagaaaaaggtgtttcttgatttcttccacttattaaaattacattcctgctaactctagtctacaagggtttgatcttccttagaaaattaccttgtctttatgtgtaaaaatgtcaaatatgatgctggtggttttatggaagttaagtgaactatgaagaagggcagggcttgtagtctagacggacagtagaaaataattgaataggcaagattttcacgaaaggctacaggagtatcaacgttggaaaagtaagtaaattctacagcaaagtaggaaatcaagtctagcaaatagaaaaggcagtccatcaggatagaaagccaaagtgtccagaaataaacactaaatatgtgtgtccaaagcaagagactgaggagccaaagtgtcaaaagtcagagtctctcattagttggttgaacatagtcccattaacacttttaaaagtctcctaatttctttctctgttttcagaatctctgtttcaagaaatcactcactgctatatttatctttcttaagtagggttctaacaacattgtaccttatacacaaacaaaggaagacaaaatctttatggctttccacccatagtctgaagaatagtttccatttttggcctaggattatataataccagaaaagagcgacatatttttccccaacatatgcatcatatcttatcatcattgggcctttgcttctattattttaagttttgctcagtatgctgtttttcttatctgtatctgttcatattctatgcattcttccatgtcttttcacgtcatattttccttattgcttaaaaaagaattcatatgttttaaactatcacatatgtttttcctgatagaattaatcatattccacttacattaaagctctatgtagtagtttttagctataggatcgaacttgatataaccttcttatgagtaaggatctactcctttggtctttgatgctacattcccagcccctagcctactattttgcacagtttggtttgtgcagcaatgtagtttagatgtgtgtcccctccaaatcccatgttgaaatgcaatccccaatgttggatattgggcctagtgagaggtgtttgggacatggggtagacccctcatgagtggcttggtgccctctcgtgataatgagagagttcctgttatggtagttcatatgagagctagttgtttaaaaaagtctggcacctctgtcttcatgtgatatgccagctcccacatcaccttctgccataatattaagggaaatttatagctctaaatgcccacaggagaaagcaaaaagatctaaaatttacaccctaatatcacaattaaaagaactagagaagaaagagcaaacaaattcaaaagctagcagaagacaagaaataactaagatcaaagcagaactgaaggagacagagtcacaaaaaacccttcaaaaaatcaatgaatccaggagctggatttttgaaaacatcaacaaaatagaccactagccagactaataagaataaaagagaggagaatcaaatagatgcaatcaaaaatgataaaggggatatcaccaccgattccacagaaaatacaaactaccatcagagaatacgataaacacctctatgcaaataaactagaaaatctagaaggaatggataaattcctggacactacactcttccaagactaaaccatgaagaatttgaatccctgaatagaccaataactagttctgaaattgaggcagtaattaatagcctaccaaccaaaaaaagtccaggaccagagggattcacagccgaattctactagaggtactaagaggagctggtaccattccttctgaaactatttcaaacaagagaaaaagagcgaatcctccttaactcattttatggggcaagcatcatcctgataccaagacctggcacagacacaacaaaaaaagaaaatttcaggccactatccctgatgaacattgatccgaaaatcctcaataaaatactggcgaactgaatccagcagcacatcaaaaagcttatccaccactatcaagtcagcttcatccttgagatgcaagccttgttcaacatatgcaaatcaataaacataatctagcacataaacggaaccagtgataaaagccacatgattatctcaatagttgcagaaaaggccttcgacaaaattcagcaggcttcatgctaaaaatgttcaatatactaggcattgatggaacgtatctcaaaataataagagctatttatgacaaacccacagccaacatcatactgaatgggcaaaaaccggcagcattccctttgaaaaccggcacaagacaagcttgccctctctcaccactcctattcaacatagtattggaagttctggccagggcaatcagacaagagaaagaaataaacggtattcaagtaggaaaagaggaagtcaaattgtctctgtttgcagatgacatgattgtatatttaggaaaacccatcatctcagcccaaaatctccttaaactgataagcaacttcagcaaagtctcagggtacaaaatcaatgtgcaaaatacacaagtactcctatataccaataaaagacaaacagccaattcatgagtgaactcccatttacaaccactgcaaagagaataaaatacctaggagtacagctaacaagggatgtgagggacctcttcaaggagaactacaagccactgctcaaggaaataagagaggacacaaacaaacggaaaaacattccatcctcatggataggaagaatgaatgtcattaaaatggccacactgcccaaagcaatttatagatttaatgctattccgatcaggctaccattgactttcttcacagaattggaaaaaactactttaaagttcatatggaaccaaaaaagagcctgcatagccaagacaatcctaagcaaaaagaacaaagctggaggcatcatgctacctgacttcaaactatactacaaggctacagtaacacaaacagcatggtactggtaccaaaacagatatatagaccaatggaacagaacagaggcctcagaaatcatgccacatatctacaacaatctgatcttcaacaaacctgacaaaaacaagaaatggggaaagggtaccctaattaataaatggtgctaggaaaactggctagccatatgctagctgaaactggatccctaccttacaccttatacaaaaattaactcaagatggattaaagacttaaacctaaagccataaaaaccctagaagaaaacctaggcaataccattcaggacattggaatgggcaaaggcttcatgactaaaacaccaaaagcaacagcaacaaaagccaaaatagacaaatgggatctgattaaactaaagagcttctgcacagcaaaagaaactatcatcagagtgaacaggcaacctatagaatgggagaaaaattttgcaatctgtccatctgatgtaggcctaatatccagaatctacaaagagcttaaacagatttacaagaaaaaaaacaaacaaacccatcaaaaagtgggcaaaggatatgaacagacatttctcaaaagaaggcatttatgtggccaaaaaacatatgagaaaaagctcatcatctttggtcattatagaaatgcaacacaaaaccacaatgagataccatctcacaccagtaagaatggcaatcattaaaaagtcaggaaacaacagatgctggagaggatgtggggaaataggaatgcttttacactgttggtggaagtgtaaattagttcaaccattgtgggagacagtgtggcgattcctccaggatatagaaccagaaatacccagcaatcctattactaggtatatgcccaaaggattataaatcattctactataaagacacatacacacgtatgtttattgtggcactgttcactataggaaagacttggaaccaacccaaatgcccatcactgatagactggataaagaaaatgtggcacatatacaccacagaatactatgcagccataaaaaaggatgagttcatattctttgtggggacatggatgacactggaaaccatcattctcagcaaactaacacaagaatagataaccaaacaccacatgttctcactcataagtgggagttgaacaatgagaacacatgggcacagggagaggaacatcacatactgggacctgttggggtgtgatgggctaggggacggatagcattaggagaaatacctaatgtatctgatgggttgatgggtgcagcataccaccatggcacgtgtatacctatggaacaaacctgcacgttctgcacatgtaccccagaaattaaagaaattaaagtatatatatataaaaaagaggcctgatagaggtccttcaccctctaccatctgtgagcacacagccagaaggcaccatgtataaaccagaaagtgggttttcaacagacaccaaatttgttggtgtcttgttcttggacttcctagcctccagaatgattttaaaaaatctgttgtttataagctacccagtttatggtattttgttataacagcccaaatagagccccaacccccagtgtggctttatttggtagtgggacccctcagaaactgattaaggttaaatttggtcataaagtgaaaccctgattgaatcaggttagtgttctcatgagaagaaatatcagatagctcactttcccttctcactatgcacacatatcaaagaaaggccatatggacacagcaagatggtggttttctaaaaggcagagagccctcactagaaacttaccatgttggcatcctgatctcagactcagactccagaattgtaagaaaacaaatttctgttccttaagtcacccagtctggaattttgttatgacagcttgaacagactaacacaaaggaagttccctctcctgaatttttaagtaaagttgcccaactggtatgctgtggcaaactagtgtgttattaatggataataggagtgctcagagacattgatcaccctgggatggttatttatttccattttacttcaattttaattgatcctagcatgtcaataattcttctaatttggagaggggagtataatgttcctagaatgtccaaaatgtgaccatttgtccagtcttgggtctcatatctcaatttcattgtgttattaatgtaacagataacaatttcccccataacctcccagcagctacttaaaattacatatgatctcagtgaacgattaagtagcttctggcttcctagaatcattttgattcattcaccaattaattcatctatctatccttccatccattcattcatattttagtagcttgcaaattctatggaaattcagggatcacaaatataaaagttattattcaaactttctttagttcttaactttttatgtaaattttttttcctttgtgtttgagagttgttttccatgaatattagcagtctgtctttactcgtaaatgttttctttgttaaatatagaagtccaataataatataatgtgtgaacagtgtatacataaaattgaatgtttgttgtgtataagacacttttctaaacaaaatacatgaggtatttactaagaaatgcactatcccagggctcatgaaacttctagtggagaagatggataacaaatttataaataagaaaatatcaaatagaaataaatgctctgataaaaattaattggcagtgagagggtctagtaattagattgggtggataggaatgggtttttagaggatatctgatttaaccctagatgagaaaagataagtaagaacaagcaaggagaaaaaatgaacattccagaagaaaagagaagctaatataaaggcagtagacagaagcacatttagcctgctagggatacagagagaaagccacctgaaatccactaagtaagaggagagtggtgctggagacgctcacagaggtaaggcaggggccagattctatgcggcatggtaggtcacagaataaaagttttggatttcattctgagatttgaagtcgttgaagtaggggactgatatggtatgtgatttaccatgaagacaatggatttgaatgtggaccgtaaaattctaagtaggggactggttaagaggctactctagtggcccaggtaagattttatgataggaagggcctagatgaaagcaataaattcacagagaagtagaaagatttggcatatgttttacaagtatagtcagaaggggctgctgataacttagatagcagaagtgagaaagaaaaaaatcaaagatgaatggtagcattttggcttgagaaaccaggtgaatggtgatgccatttgctgacatgggaaaaactgcaggaaaagcagatttggtgagctagaagaaatatttttatatgtattactgttttgcagttcatacttttcatatttaaacacataactaacattttcctaattcaacgtcatattcaaattgtttatattaaaaaatcatttaaaactttcactaatgtaatgtcattttaaagtattttattcttaaaataaaatcattttgaacaaataccatttatttccatttacatgattcctagtaatactcaggttaaaactgaggaaaatgacacctttgtgtcttttttttcttttttttttttttttgagacggagtctcactctgttgcccaggctagagtgcaatggcatgatctcagctcactgcaacctccgcctcccggattcaagcaattctcctgcctcagcctcctgagtagctgggattacaggcacacaccaccatacctggctaatttttgtatttttagtagagatggggtttcaccatgttgatcaggctgctctcaaactcctgacctcatgatctgcccacctcggcctcccaaagtgctgggactacaggagtgagccaccacacccaccttgcatactttttaaataataataccagataatacttgaagtacaggttctcctttctccagccataacttccacaaactgaattttttgacacaaaggcaacaaaatggcttgttttagatatagtattaaagaaaagcttgctaaaaagcaattattcttatatttataccttatatgtacctctcaacttaagagcaaaacaactggatcatatcagccaatttactttcagttttctgaacagatagttggatcttttaggactcagagcaacacagaagccaataccatttgtggtcaacagagcttgtttgattcttctgaacgtattgcagatttatgaaccatctgtgaagaaacaaatggtccaaacctatttaaaatcagcatagctgtgatttgaatgctcacaagtgggtctgaagcagttgctttcctcagcaaactggcctgacacctttgcacaagcttatagccttatgtgatacataagctttaagtttaggtgaagcaaagaacaggaaaataaggaaaatgaaacgaatataaggaagaaagcagtggcataaacttctgtcacgtactgagttcttcctgatttgctagatgcaaaaagttcacttatagcaatggttgcaatttcttcctattttcttagtagcaaatgttttcaatgaagtctctcccattacacacgcacatatactctggtataaatgacttatctaagatatggtataagatcaccataataaagaatatagtttatgaaacatcttacatctcacatgtaataaagctctcctggggatttattgtaatagaatagaaaattacagagatgcacaggcgttacccctctcactttacatctttaatcaatttctgaaaattagacattctgtaaagaagtgctatgctggagcctatttctttatattctacatgggaaaattgtaacacattaaatgttaaccaccaacccttattggatttccaaaaatgaaaatagagcattaaaacattaaagcaggaaaacacactaaaacatgaatttataagtaccgttcacactaatgtacaaattgcttaaaacattgctttttgattatcagttattaaggctgcttacaaatagtatccattgcaatgatgtgactgttagtgacaacgtctcaaatagccatacctattgttgacatttggcatgctttaaaagttcctacatacgattttaaaaacatccgtattgagatatacttaatattccatattagtggtatattaaatcattaaagtgtacaatgtaattgttttaatacatttatagagttgtgcaaccataagttatcaccacagtctaggtttagagcattttcatcaccccaaacagaaaccccatacgcattagagtcattcaccatcccctgtctcctaccatctcccccaccttaagcaaccactaatctactttctgtctgccagattttcctattctggacatttcttataaatgcaatcacacaatatgtgatcttttataaggggtttcattattctaaggtagtaaattacagctttatgatacgttcccttttaaaatttgccttttatacagtttgccttcgccactccactctgagttctacctgtctggtaattttaggtagaacaaaatatttaaaccaatttcatacctggccataaagagtgaaaaaaatagactgggcaagtttgacttaggattaaggtcaaactttctacaggttcctgaataactatgaatcagtccgttaataattatattatttcccttttcccaagcttaccatttctttcatcttctaaggatcatgacgcttcaatctttttttcctctaagatcaggatcttaatttgaagatctaaatttctctacttgatatcttaggcccaaatatgtgagttccaccaggaccgcgctgactacataagtcttactagtccgatgtccactgaaacagtgctttggatctaactttctctttttttgagccattggacagctacagccactgttggatagtagttagggtgaaaaaccaggagcacaatcacttgcatatctgaaatgccacatcctatcatttcagaaagtaacttcatggaagttactcaaattcacgatgccatagtttcttcatctataaaatgggagaatgaaagtgcccaccttatagatttgctgtgagggttgagtgaaatctgcttggcactgaggaagaaattataaaatttagttgttcttcttatatcagctctcaatttcattttttgatctaaaacttcttatgttctcgataatggtagacatctctaatatcctcaaaagcctttctcacactgcttttctcacactctgggcagagagcggttattcattggagaagattataagccaatacagatttactatctttatctgatataataaattttgcttaatctcttattatataacaattacaaatccctctctgagctcttctctctgtggaatatattcaatctgcagttcctttttttcataatgtgtattatatctgacttctttaaaacaaaataaattctagattgtaggaatcttacacttgatcttaagtcttcaattaattttgatttaacaatttccttgttcactattctttctggtttttaaaaataacatcttctttgagatacaattcatatgccaaagaatgtatctttttaaagtgtacaattacaataatcaaaacagtttggtattggcaagagtattgacaaatagatcaatggaacaaagtagagagcccagaaatagatctgtcccgtgatatagtcaacttatctttaacaaaagagcaaaggcaaaacaatgaagtgagacagtcttttcaacaaacggtaatgaaataaccggtcctccacatgccaaaaaaaaaaaaaaaaacaaattaatctagacatagaccttacacccatgacaaaaatcagtttgaaatggctcatagatttaaatataaaatgcaaaactataaactcagagaagaaaatggaagaaatcctatataattttgagtatgacaataacttctttaaaaaaaccaaagttccatgaaagaaataactgttaatctggatttcattaaaattaaaatttctgccctgcaaaagagactatccagagaatgagagagcagccacagacttagaaaactatttcaaaacacacagttgataaagaacgttattaaaactcaacaataataaaataaacaaccagatgaaaaaatgagcaaggggctgggtgcactgactcacccctgtaatctcagtactttggctaaggcaggaggattgcttgagccagagtttcaggttgcaacaggatatgatggcaccactgcactccagcctgagcaacacagccagaccttgtctctaaaagcaaataaataaataaataaacaaatggacaagagacttccttaaagaaaatatacagatagcaagaaagtatataaaaagatgctccacatcatatgttattagagaattgtaacttcataagataacactacacacctactagaatggccaaaattcaaaacattgacaacaccaaatactgatgaggttatggaacaacaggacctctcattcattgctggtaggatgcaaaatggtaccaccactttggaagactggcagtgtttacaaaactaaagatattctcactgtaaaatccagctgtcatgttccttggtacccatcaaaatgaattgaaaactttgaaaacttgtgtctgtacaaaaacctgcacatggatatttatatttaatagcagctttattcataattggcaaaatatggaaactaccaaatatactttagtaggtgaatggataaataaaccttggtatatccagaccatggaatattattcagtgctaaagacttgtgctatcaagccataaaaaaaaaccacgaaaaataaatgcatattattgagtgaaagaagccaatctaaaaaggctacatactgtatgattccagatactggtatacaatatgtgtgaacaggtaaacctgtaaataatagtaaaaacatcagtggtagccagggataaggtggggaggataggatgaataaggagtgtagaaaggatttttagggcagtgaaatgattctaaatgataccgcgatgttggataaatatcattgtacgtttttcaaaactcatagaatgtacaccaagagtaaaccctaaggtaaattatgatcttttgcagataataatgtgttagtttaagttcatctattgtaacaattgtaccactatattatatgtggtgtgggatgtggataatgaaagaggttctgcgtatattgaaacagactgttatggaaaaatctctgtattttctgctcaattttgctatgaacaaaaactgtcctaaaagtttattaattacaaaaaggaagaaaacacaaatatatatatatatatatctatatatctacatacacatacatataaatacacacatacatacatacatatacacacatacatccacatttttaatgcatgtgtatatatgtatatattgatgtgcaattataaatataatttaaaatacaattatgaattacaactataaattatataaaatgtataattgtattacatattatgaattatataattatataaaatattataaatatataattatataaaatttaaaaatatattttaaataatatgtaaatataaatatagcttatataaatacccacatacatattaagtgtgtaatccagtgggtctttgccactttttatcacagaataacacaaccatcatgacatgtatgcacatacatacacatgcatacatacacatacacacacatacatacatatacactttatatatatatatatatatatatatatatatacacacacatacatataaagggtatgattcagtgtttttctgacactttgtcacagaataatgcaactatcatgaatacctaattcaagaacattttcatcaccgtagaaagaaagcaggtatctattagcagtcatttcttgttcccccctctcttctgcccctgacaactacaaacctattttatatctctataggtttgtattttctgggcaattcatatacatggagtcataaaatatgtgttttttgtgtcttctctcttatttaacatgtttgcaagaatcatccatgttgtaacatttatcagtatttcattcctctttgtaattgagtatcattcattatacatattcattatatgcccaggactgggcaatgcattttttacttactggttgatggatatttgatttttttatttgtttccacctttgaactgctttaagtactgcttctttcatatacaatttttatgtggacatatgtttatgattctcttggctatactgctagaaataaaattaggggttcatatggcaactgtttaatgtttgaagactgccaatctgtttttcaaaagtggctgtatcagatgcaggaaaagcactcatgaaattaaacaccctttcttgataaaaattgaataaagtcctggcatgttggctcacgcctgtaattccagcactttgggaggccgaggtgggcacatcacgaggtcaggtgatcaagatcatcctggctaacacggagaaagcccgtctctactaaaaatacaaaaaaattagccgggtgtggtggtgggtgcctgtagtcccagctactcaggaggctgaggcaggagaattgctccaagtcgggaggtggaggttgcagtgagccgagatcatgccactgcactccagtctcggtgacagagtgagaatctgtctcaaaaataaataaataaataaataaataaataaataaataaataaactcaacaaattagatatagcaggaacatacttcaacacagtaaagaccatatatgacaaaaccatagctcatatcatacacaatgggaaaaattttaaagctttttctgtaagatctggaaaaagataaggatgcccactctcaccacttgtattcaacatagtactagaagttgcagccagagcaattaggcaagagggaaaatagggatccaaattggaatagagaaagtcaaactgtccctccttgcagatgacatgatcatacatataaaaaactaggaagactccaccaaaaaactcttagaactaataaatcaattcagtaaagttgcagacacaaaatcaacatacaaaaatcagtagtgttttaatacaccaatagtgaactgtctgaataataaatcaagaatgcaatcccatttacaataactacaaaaataaaataactagaaataaatttaaccatgaaaagaaaatatttatataacataaaatacaaaatactgatgaaatagtttcaggaacacaaaaataaatggaaaactatcctgtgttcatggattgtcagaattagtattgttaaaatgtccatactacccgatatgtgtccccaaccaagtctcaacttgaattgttacccccacatgttgagggagggacctggtgggatgtaattggatcatggaggtggtttctcccatgctgttctcatgataatgaggaagttctctcaagatctgatgttttaaaagtggcagtttcccctgcactcactctctgtctcctgccaccatgtaagatgtaccttgcttcccctttgccttcgctatgattgtaagtttcctggggcctccccagccatgcagaactgtgagtcaattaaacctcttttgtttatagattacccagtttcaggtaatatctttatagcagtgtgagaatggtctaatatactacccaaagtggtctacagattcattgctattcctatcaaaatactaacgacattcttcacagaaatagaaaaaaattccccaaattatataagatcctgaatatccaaagcaactctgagccaaaagaatacaagttactatagctttttagtatattttaatgtcaggtagtggaagcatagtacctgacattaaaatatactaaaacggtatagtaaccaaagcagaatggtactggcataaatggagacacatagatcagtggaacataatagagagcccataaataaattcatacattcacagccaactgattttagacataggtggcaagaatactcattcaacaaggacagtctttttaataaatggtgctgcaaacactaaatattcacatgcagaagaatgaaactagacccctatctctcaccatataaaaaatctactcaaaatgcattaaagacttatatgtaagacttgaaactttgaaactactagaaaacaaaagagaaatgctgcatgacataggactgggcaaggactttttgaaatagacttcaaaggcacaggtaacaaaagcaaaaatagacaaatgggattacaccaaactgaaaagctgctgcacagcaaaggaaccaatcagcagaattggagaacatattcacaaactatacatgtgataaggggttaatatcaaaaatacatagggaactcaaactcaatagctaaaaaaacaagcaacccaactaaaaaatagtcaaaatccctgactagacatttatcaaaagaagatataaaacttgccagcaggtatatgacaaaatgcttaatatcaccaatcattaggaaaatgcaaatcaaaacagtgagatattgcctcacccctcttagaatggctattatcaaaaaaacaaaaaacaaaaaacaaatactagtgagaacacagctaatggagaactcttatacactgttggtaggagcatacattagtacaatgactatggaaaatagtatggaggttcttcaaaaaactaaaaatagaagtatcatatgatccagcagttccactactgggtgttcatccaaaggaaatgaaattagtattcagagacatctgaactcccatgtttgttgcagcactattcacaatagccaagaaatggaataaacctttgttcatcaatagatgaatggataatgaaaatgtggtatatatacacaatggaatattatgcagaaataaaatggaatgaaatcttgtcattcgctacaacatggatgagcttggagaatgttatattaagtgatataagccaggtacagaaagacaaatattacatgttatcttgcatatatggaagctaaaaaagtttgtctcatagaagtaaagaataaaacagtggtttccagaggctggagagtgttggagaagggaaatagtcagaggttggttaacagatacacaaatagataggaggaataggtaagttctagtgttttgtagcactggggagtgactatcatcaacaacaatttgttgcatgttttcaaatagctagaagagtggacttttaatgtatctaacacaagggaatggtaaatgtttgaggcgatgaatattctaattatgctattgatcactgtgcaatgtatatctgtgttgaaacatcatactgtaccccataaatatgtataattattatgtattaattacaaacaaaatagaaagtaaattgatgtatcattttacatccagcaatgtatgtaaatccatctgtaatccacaaagtttccaatttctccttatctttgccaaccctttgcactgtctgtgttttttattatagccatctgaatgggtgtgaaatagaatctcattaaattctttatttgtattgccctggtggccaaagatgttgtaagatatttttaatatttctggatacaagtccatagcagatatgttatttgcaaatattttatcttactcagcgagtgtcttttcactttcttgatggtatactttgaagcacaaagtggtttattttttcaactttgatgtggttcaatctttcattttctatctgtatttatttgcttcctttttttccttttcttattatttttggcttatgctcctagtggcatatctaaaacatcgttgcccaagttaaggttacaaaggtttactcccatcttctcttttaagacatttataattttaatgcctatgtttagatctatgatccatttaaagttaatttttgtacatggtgtgatgtagagatccaacatcaatttttgaatgtagatatatagttgtcccagcaccattttttgaaaagactattctttcctcaataaattatcttggcacacttgtcaaaaagttgtattgccttgatctaaatgtctttcattatgccagttttcacattgtcttaattactgtagctttgcagtaagtttcaaatcaggaactgtgagttcttcaaatttgtttttatttttaaagatcatttggttgttggaaatcccctacattctatgtggactttaggatcatcttttccatttctgaaaagaaaaagcattgaaattttgatagggattgcttgtatctctatattgctttcagtagtaatatcatcttaattttaagtcacccattttaagaaaatgagtgtctttccatttatttagatctactttaattcttcagtatagaagtcctgtacttccttcattaaatttattcctagttattttattcttttttgttgctattataaataaaattgtattcttaaattattttcaaattattcgctatataattgattttcaaatatttgcgtatttttatacttctaggaaagtgttcatttcatctaacataaaatttctttgcatattgttcattgtattcctttatcatcctttttatttctggaaattttgtggtaatgtcccctgtttcatttctgattctagtaacctgagtcgccttcttcttcgtcgtcatcttcttcttcttctttttcttcttcttcttcttcttcttcttcttcttgttcttcttcttcttcttcttcttcttcttcttcttcctcttcctcttctttctcttcctcctcctcctcttcctcctcttcctcttcttcttcctcctcctcctcctcttccacctcctcctccttttcttcttcttcctcctcctcctcatcctcttcctcctcctcatcttcttcttttctacttctttttttcttaaggtggaaagttaggttatatatttgaagtatttttgcatttttaatacaggtgcttacagatataaatttcattctcagcactgctttagctgaaactcataagttatttttgttttcacttacctatctatattttctaatgtcatttgtaatttttttctctgatccattggttattggagagagtatagctgggtgtgatggtgcatgactgtagtcccagctaatagagatcacttaagcccaggagtttgagttcacagtgggcaacatagcaagaccctgtcacacacacaccaaaaaaaggtaggaggaacatctgccaccaagggaccaggacatcaggaagaccggtgcactccaagcagatcttcagaaggaaggcattgagagtggacagagaggaaacactgctaggttgaaggggcaggaatctgggacctctgcatgtagctaccacacatcaggactcattttgacccccagtgacttctggggaaggagtgagtttagcaggcaagaagcgtcccactctcaccacagacctctggaattctggcagcgggagatgtcacaactttcaaggacacttgagctggcagggaaagctgcttagagaggtggaggggcaggacttgatctgatatatgacctcagcaaagtttcaggatatgaaatcaatgtacaaaagtaataacatcctcatactccaacaacatccatgctgagagtcaaatcaagagtccaattccattcacaatagccacaaaaagaatgaaatacctaggaatacagctaactggggtggtgaaagatctctctcatgagaattataaaacactgctcaaagaaatcagaaatgacacaaacaaatggaaaaacattccatgttcattgataggaagaatcaatactgttaatcaatattgttaaaatggtcatattggccaaagtacttaacagattcaatgttattcctatcaaattatcaatgacattcttcattgaattagaatattttaaaattcgtatggaaccaaaatacagactgaatagccaagacaatcctaaacagaaagaacagagctggaggcatcacattacctgacttcaaactatactacatttgcagaaaatgaaaactcgaccacttccttataccatatagaaaaatcaactcaagatatattaaatacttaaatgtaaaacctaaaaccatgaaaaccctgaaggtaacctaggaaataccattctggacatgggaccaggcaaagatttcatgatcaacatggtaaaagcaattgcaacaaaaacaaaacttgacaaatcaggttgggcatggtggcttacactagtagtctcagcagtttgggaggcctagtccggtgaattgcttgagctcaggaactggagactaggctgcataacttagtgagaccctctctctacaaataatacaagtatagccaagcttgctggcacatgcctgtagtcacagctactagagaggctgaggtggcaggattccttgagcctgggaggctgaagttgcagggagctgagatcataccactgcactccagcctgggagacagagtgagagtttttttcaaaagaaaataaaattgaccaatgggacctaattaaattaaaaagcttcttctgcaaggcaaaataaattatcaacaaagtaaacagacaacctacagaatgggagaaaatatttgcaaactgtgaatccaacaaaggtctagtatccaaaaacctatagggaacttaaatatacaagtgaaaaataaccccattaaaaattgggcaaaagacatgaaaagacacttttcaaaagaagatatatatatgaccaacaagcatatgaaacaatgctcaatatcactaatcattagagtaatgcaaataaaaaccacagtgagataccatctcacaccagtcagaatggctattactaaaaagtcaaaaaacgacagatgctgccaaggttgtggaggaaagggaaggcttatacactgctgatggaaatgtaaattagttcactcattgcagaaagcagtttgacaatttctgaaaggacttaaaacagaatgagtactcaaaggaatagaaatcacagcactattcacagtagcaaagacacagaatcaaccttaatgtccatcaacagtagactagataaagaaaatgtggtatatacacaacatggaataccatgcagccatgaaaaagaatgagatcatgtcctttgtagtaacatggttggagctgtaggccattatcctcagcaaattaacacagaaacagaaaaccaaataccacatgatatcacttatgggagctaaacatcaagtatatatggatacaatgaagggaacagcagacattggggcctacttgaaggtggtgggtgtgaggagggtgaggagtgaaaaaatacctatcggatactatgcctattacctgggtgaggaaataatctgtacaccaaacccatataacatacaatttatatatgtagtaaacattcatatgttcccctgaacctaaaatagaagttaaaaatagaaagtaaaaacaattaaataaaatagatactcaagtagtcctaaaataacaaccactaccaaagcaaaacaaaacaaaaaaaatcaaaacaaaacaaaacaaaacaaaaaaccccaaaaccaaacaacaacaacaacaacaacaacaacaacaaaacgaggaagggtgtttcctaatttacacgtatttgtatatttgtgagatttcaaaattttcttctatcatttctaatgtaatctcataatgaataaagaaaatgttttgtatcatttccatcttttaaaatttcttgattcttttcataacgtggtatacttgtatatggtttaaactggaaaatattccaagcacacttgagaagaatgtgtattctgctattgatgagtggtttgttcaatgtggctgctttaaattgttggtcaaatcttctaggtccatttggatcttctacccattcattgaatcctttattcaaagtggtgtataaatgtctccaattcttattgttgcattgtctatttctctcttcaattctgtcagattttgctttctgtcaatttggggtttctattgttatgtgcatatatttttatatttgttatatattcctaaagtgttgactctttcattattgtgacatgcctctctttatttctagcaacactgttttttcattttaatttttttgactgacattaatacagtccctccagttctctgatgattgctgtttgcatgatatcattttccatcattttagtttcaaattacatgaaactttaaatctaaagtgtgtttgctttaaaaagtatgtaggtagattgtttttaaattaaatctggcaatctgtcttttgattggatctttatcaattcacatttaattttatcttgatatggtgtgtgaacattttctgtggcaccattttaattattttaataattgtttaattttatttttgagccatattctcaggggtcactctagggcttgcaatagatatatatcttaagttatcaaaatgacaccagatttccagtaaattccagtaaaatatgaaaactttactcttgcaaatgtcattccccacttttgtgcatatttagatactatatataatgtataatgtctatatatggtaaaaatatttttgtaattatactgtatatatatttagaaagttgatgaaaagtggagagcaagtatatatagtcatagagcttgttattatcttttttatttaccaatttttatcctatttctttctgtaggcttgttatcttacatcatttcattactccaatatagctttgttacacctgcctcctttatgctgttattaccaaatatattacattactatatgttatatggccaacaatataattatgtatacatattgttttattcagttgtttctaaagtaagttaaaagagaaaaggagaagaaaggtgcaattacattgtgttttataattactgactttatgacctttattagcactctgttttttcatgtggatttgaaatactgtttgatgccacttgctttcaactcatggaactttctttcatacaccttctaaggcacatcttttagcaatgatatctctcagctttcatatatctgggaatggtttcatttcaccttcattcatctggaatgtctttatttcacctttatttttgaaagacactttttctggatttaagaatcttggttgatagttttctttcagcattttgatattatctcactgcctctggcctcattatatctgatgagcagtaagttattattctcattggagttccttgcatgtaatgatttgtttttctcttactactttcaaaattctatcttaatattttgttcttaatattttgattataatgtgtctggatggaaatatttttgtatttatcttatttggagtttgttgatatccttaaatgtgtagaatacagtttttcaacaaatttggaaagtaactattttttcaatagtttttctttcccttttgtctcttttcttcacctagttctcccattacatttggctacttaatattttcatatatttctccaagactttgttcactgtacttacaatcaaagaactgcagactatcacaagatagctggcactacagaagacttctagtacaaccaaaccaattatttttattgccttccttattcaaaaagctcaacaaatgttcatcccagcttatgcttgcatatcttcagtgaaggaagtgactaattcttaagtatttcattttgattttatgctggtctaattttaagaaagctttatattaaggaacagtctccccttgttttgattccaagtccccttagcatcataattacccttctctctaaaagcttctgttagttataatcattttcaaaggtgaatcataatcctagaagagctgacatcagagtaaaataataggtttttatctcactgtagatgcatcaattcataaagctgaagttatatcagatattgaagaggtacaaaatacactgttcctccatagttaacgtgaggtcaattaaaagttggatgtcttcacatgaatttgctttaaatcatatatcgtttaatctgtgtttgaatagaattttttaaatggcacacttatatttgctaaaaattttatattcctgggtttagctctttcagtctaaatatttgtaattttattttttattaaatattagctcactcttctggcctcataaaatgtataatcatgttgtttgtacctaattctaatatggtaataaacagaatgatcctgagatagccccttaaaaagctaagttcaggttaacgttgaagcatttataatagttgttaagtaagattattcaactacataaaaactgaggcagggcacaatggctcatgcctgtaatcccagcactttgggaggccgaggtgagtgaatcacccgaggtgaggagtttgagaccaacctgaccaacatagtgaaaccccatctctactaaaaatacaaaattagctgggcgtgctggtgcatgcctgtaatcccagctacttggtaggctgaggctggagaatcacttgaacccgggaggcagaggtaacagtgagccaagatcatgccattgcactccagcctgggcaagaagagagaaactctgtctcgaaaaaaaaaaaaaaaaagtaaaaatgtacccataccttaatattttctattttgtcctaagattattaagaaaatctcttaaattcaaagatctctaaaaatcaagatagcctgtatattacataaataattatttgaacaccaataataatgaaaattagatttatttgacataatgtgtacttagtaatcccctatgggcttccatttcttatctattttctttctaaattctcaaaaaatattatacaatagacacattttttggtataaccacagctacttttcataatacatttcagttctatgggtatatgaggtctaataacaacaataacagcagcagcagcagctaacatttattaacaattattctgtgctagatattttactggaaaattgagtatacacatgtgctagactttatgtcaagtactatccatgcattctctcacttaattttcatagcctacttatgaaatatatgtttttattatagctatttgattataataaaagtccatcaccatggttagtatattactcaagataattaacactagatgccatggcagacaaaacctaaaatcataatggttaacaaaacaaaagttgatttcttgctcattcaaacctaaactggatggggcattcttcgtatgtagtatagctagaccatctgaaacataagctagctctagggatgctaaagcaacgaaataaagagaatggtatgcttagcccagaagtgacacacttactttgagtcagaatttattaaccagtaataaattatgtcaccccaattaaatttaaggaaagctagaaaatgtagagaaacaagtagaatactttgtaagaacaaaattattgccacaagtcaccaaagatcctttgatcccttttcgccaaacattgaacacactcctaaaaaatgacaactgaaatcccatcaagtccagaatctctacgtgtgcagtatctctcaatcaggtctggataagtttttaatccagagacttatgaattaaaagacaaatcatctgccttctgccccacccattcttatacacttaaacatacaaaagtggaagagggaaagactaaccacaagtggaagtacacactctgtgaacttctcctaccttaaggtacaggtggttcctgaattaatccctgattctgctttccgtgtggagttagttctcttgccttctgaatgtgtggagaattacggaattgcctacctcagaggctacaaaagctttttcagtgcactttttagtgctgaagatgaagaaatcaagtgtatatttaagtcttgaatgctcaaaggtattttaggctaaaattctctggtaatccttctctgttaaaattatagatatctgatctattttcttctgtgagttccatatgtggttgatcacagtaaaaattcttttggagtcatatgtagttttcatatctgcttttttttcttaatttcttcccacaattcactctctagcaatttaatggaagttactataaatctggaataatatacgggaagcccatacgcttaatctaaactgtgctgtgagtcataattttcacttaagtttgcgcccttgtctaaaagacttgttaaatttattgttttactatttgttatttagaagcagacagctttccatatgtgcaaggccctaattttggaggtcttctttttcttttattttgtcttgaaaaccagctacttttctgagctctctttttactataaggtaacttgccaaacatagtcaagtacaaccaacacacagaatcaatattccgtcttccagcttcttgccttagagacataaattagtaggcacatagtttgccttccaagttatcacggggaaattctttgctactaaataacttggactgccatcatttcagcccctgatatcaattttttcatctcctataactaatcacaaagataaggccatattttaggttttatgttatgatactaatttctgtatttaatagcataattaatcctaatttccttcacagataaaccctgtaatctcaacagtttagtacagtgaagatttctttatttctcatctaagaatcaatgtgggtcaggaggaccttgcagctatattaatggaacatatggcctctaagatctgcatagcagggaaatagaacaattctcttaatttcttttactctgaaatgatcacttttacttttgctcacagtcaagtggagagactgatcacataatttttacataactgcatgggaagctgggcaatgcaggggagcacatggaatatatggtaccggtgcttataattacaaaataaattcaaacatatctgatttaaatttcaccttcttcctctctgttctcagtagtaaaagtatttaaaatattttaaaagcaatttgaaatattacatagatacaaaaacaaaatacatttttggtttgtttgcatgtttgcttttaatttaacatctggtggcaaagatttctagtcttatatgcatgagtatgccttaattgctcatctggagtaatttagttgatattattttatatcctagactaaaattcagtcattccagcaaacaatttaggagaatggtaaaaaaaaaaagcactgttaaaattgcataaagcacaagtggattgagatcagaaaggtgacaaattggatgaatttggaagaaaaatgttggaggcagaaaatgtaatgtgtttcagtggaaaccataaaatcacctttagagtattcgtttcagatataagtggatttggagcaagacaaagtatataatgaaggtaaaataactaaagactgcataaatctgatcacaggcaggttgatacaatgaccctcaaataattaaacttttgacctttttggctgaataggaagtagcagttttgttctcagaaatatcttttatgtaacagctggcactttctggaaagtatttgaatttacttctttacaactgtatctgaaatatgaatggtccttgaaatggctatagaagattggcccattctgcagctatacttattataaagggttaaaaatcactaacagaacacacacttttaaggtttcaatttcagtcttgtatgccacatcttttcagtataaatcaagaaatttgtatgttaatttctaatactgaaaatgcttcttacagcagccgatgaaataggtattcatgaagtatagcattatttaaaaatgtctgacctacagtgttatatcatttttgtagagaaaaataaaaaaaattggataagcattataaaatgaagctaggagaaataatagctttaatttaagttaaagaagataaaagcacctattattacaaactagctaattaataaaacaagaattttggataatatttatagcaaaatcaatcagcagctaaaatgtcacatacaagtaaattaccatttatttgataatataaatgagacaacataatatctatccttagtcacaagctacaagtaggtgcatggagactttgaacttcataatcttccaaaatttccactgaaaattgtaatatcatccttacaataatatgcaagctccaagacagtaggatttcatatgccctagttgaattttgaatgcctagggctgataaaaatatttatgtagtatcactaatcattaaagaaatgcaaatcaaaaccacaatgaaatgccatctcgcattagtcagaatggttattataaaaagtcaaaaaacgacagatactgacaaggttgtggagaaaagaaaaggtttatacaccgctgatgggaatgtaaattagttcacccactatgggaagcagcttggtgacttctgaaataaaacttcagaattactatttggcctagcaattccattattggacattggacatatacccaaaggaatataaattgttctatcataaagacacatgcacacatgttcattgcagcactattctcaatagcaaagacatgtaatcaacctagatgaccatcaatggtagactgtataaaaaaacgtggtacatacacaagatggaatactatgcagcccccaaaataatgagataatgttctttgcagcaagatggatggagctggaggccattattctaagtgaactaacacaggaacagaaaatgaaataccacaggatctcacttataagtgggagctaaacatcaagtacatatggatacaaagaagggagcaacagacactgggccctactggagagtggagggaggcaagagggagaggattaaaaaaatatgtattgggcactatgcttactacctgagtaaggaaataatctgtacaccaaacccctgtgacatataatttacccatgtaataaacctgcatatgtacccctgaacttaaaatgatatatatatgtatatatataattgtgtgtatatatgtgtgtgtgtgcatgtttagtaataacttatgatttagtaaaaagaaatctaagcataataaaatacctctcaatttcaaaatctgttgaaggggcaggaggaaggagttaaactatctgtccaacaatccactcattttgtttataaaatgagggcatgtaggaagaaaagaagactgtgatgtaatctaatctccatgtcaactggaactccagaaaaaatagagaaattatatttttcaggagaaagacaccttacctattgcatgcctttagcagggtggtccgtggctaaagattatttatatatatcaatatatatatataactgattccttgtctttgctatatatacatatatatatatacacacacacacacatacacacacattatatatataactatacaaattttatagttatatatatatataggttgttaggtaaattgtttgtatgtatatataactatctattgtctatcatctatctatgtagttatatatagttatataatcttttagagacagggtctcgctgtgtcactcaggctaaagtgcaatagcatgatcatagctcactgcaacctgcaaacctcaagtgttcctcctaccttggcctcccaaaactctgagattacaggcatgagccactgtgccctgccaggattgcttctgttaaataaacacagagtctgtaaggtgtgttccctggaaaatgtcaataaactacacaaccctctggaaaataaaatgaaaatattttgtaatgtaaacacttgcctccgttggaagtaaactcataatcctcactagagactttgtttttccaagtcagaagtgcatgttctccaagggaagagaggacctagaaagctacccttgatgtcccagatgtctccttgtttcatttgagtcttttgattgtatccttgatgttattagtacagtttcatactgagataagatctttgatttgtgtcattctaatttgataagccaatcatgttaaactgacttatgaagaagaaaaagaaaggcacatatgttttgtataataataaaatatcatttagactggagcatgttcaagactgaaaggcactgttatacaccaggacaacaggcactaactcagactctctggggccaaactgggacatgtagttatagtacaaatagcatgggtccctttcattagtgtatttatctaataaatattttaaaagttttgccaactttgaaagtctaggtgagaaaatggaataatatggtcccatatgggatttgtaatactcaacaatatattaattattcaggctgatcttatattaacaatataaggattagaaaatacatagaataacatgttattttcatttaaaaattaacaaatcatatattacttttaagggtagtttgattatcaccattatatttagccacacaaatatcagtatttaagaatggtatctaaaagttggaattatggtaataggtgatatgaatagcactcaaattaatctatactctgtcagaaacattaagcatcgcatatatctcaagtaagtcttatataatgtctaatgtttaggaatagctcaaggaatgaagatacaaaagtgtgcaagatatgtaattgataataccagaaccattacttactgaggtgagcttctcttggaaattttagaggtagtataaaatcttgcatattagctaaattatgtgattcttgttcttatcaactaatttaaggaccatagatgggctttggtgatcccatgaacctcctaaaattataaataaaatgcttttgtgctcatatatatatatatattttttaattgagagattaatgtttttatcacgttcttaaatttcttcatatttgggcttgtgaacaaagaagaaaaaataatcagtgctcaggagtaatagtatctaggaaataggtctactgagagatgatccatatggtggggcaatttatgctcacatttatgctctgattatgaagagatctgtagcctagttggaagtaggtacctattagcagactgaaccattttgaaaaaaaatttaatccacagtcattcactcaaattccctttaccttagaaggcaggagtaatatctagaatttattatatccaaaattaactttgtgtatgaagttttgattattcgaatattctgaccataatgttcttttataattcatacatatatattaaattttcaaagtataaatataacaaaatattgataacactaaaaatgcttttggctcttaatttagaatttttgatactcagaaggttgatttctttctttcaatgccttgagattattgagagcataaaaagtgtaaagtttaaaatacctcaaaagtgttaaatattatcaatgtttttactcctttacttccattcactcttaaccttctccaacatggttcctatctctgctccttcgctgaatttgcttttgtcaaggccaccgttgatatctatgttccagattcaataaatactatttagttttcatattccaagacttttggccaggcaaggtggctcacgcttataatcccagcactttgggaggccgaggcaggcgattgcctgagctcaggagttcaagaccagcctgggcaacatggtgaaactccatctctacaaaaaatccaaaagatagctgtgcatggtggcttatgcctgtagtcccagctacttaggaggctgaggtggaggatcgcttgatcctggggggtcgagggtgcactgagccataatcactccactgcactcaaacttaggtgacagagtgagactgtcttaaaacaaacaaacaaacaaacaaacaaacaaacaaaataaaaagaccacacacacaaaggcttttcagctggccttcaacacagttgaacagtccattctttaaaaaaaaaaaaaaacagttttattaaattagtacatgtgtaaaatggagaactgatgaaataaagccactggcaatgaggatctaacagagtttgaccaattcatatgcaaagaagagaaaatcaaatgggataaagacaccatcatgggattaaaaaagaaagatttgaatgtttaagaattaggagaagcccttgagaaaaataagaccttcaaatgattttacaaaagtgattttatgattcttctgtgaaagataaagaaaagtttatctaatcatgacaaattttatcagaataaatgttgtaaaacaaaatcaagatcacatttaaaactaaaattttatcagcaataagacaataggcatttttattcaacaaaaatgattatgaccaaagtctgaaagaaatttaataatttataaaatttaactaatttgtaataattattctgatacttgacagatttcctgaaggaggtacaatgctgacatagccatacagtaacaaagctatcagttcaatgattcttcctaaaaaaatttctcctaattcccaacttctaccccaaatgaggttcttgatatccataaagtaaccttctgaatatgtatatttagaaaatgttgaataagatatgattttttaacattgctgtaatatttttaatgggaatagagaatacatagagaaaagtgcacaaatcacaagtgtataggtggatgaattcttccaaagcatgtaaccaacacacagatcaagaaataatattatcaaaatcctagatgcctgtctgtaatttcttccagtcactactcccctatgaagataattatcattttttagctttttatacacggattacatgtacttttttgtgtctggcttcatttgctccaagatatggatattttatctagaagtctcaacatatatttcatagacttttggatttatacttgcaaatcaacatgcccaatttctaattatattatttactcttcatcaaaatatatttattaaatataattaaaaattcatataactaacctttttgaatgagatgtcttgatgtttttgatttcatgcctagatcttttggttttaattcacataaaatagatgacacatgttttctgtgttcactggaattttttaaatcaacaggataatatatattctgtgaaaataaaataaaagcaatgacaatgataatatctcatgtgttttagagttcttcaagggttttcacatgaattacattatcatgattgattttcatttaaaacatgaaaacaaaaacctgtgaggtaggcagggttaagaaaaaaatttaaaaagctccattgtgtataattttaacaatctgtcattctactaatattgtaccttggccaatgctgtgagagagattgagggaaagagagacctgccaggaaagtgctgtgacaaaaggaacaagggaagagggaaaataaggaataaacaaagagaagcaagatagtgttccccagaaagcctgaaggaagattcagagtaataaagggaggtacaaaattatttcacagagcactaaaaggcagtaacatgggggaggaaaaggagggacaataacaggaagaaaggaagggagaaacgggaccagaattatcacacatgttaaaactacaaatgggccaggcacaggggctcacacctgtaaccctagcactttgggaggccgaggcaggtggatcacctgaggttaggagttcgagcccagcctggccaacatggcgaaaccctgtctctactaaaaatacgaaaattagccaggtgtggtggtgcatgcctgtaatcccagctactcaggaggccaaggcaggaggattacttgaacccagcaggcggacattgcagtgagccaagattgcaccattgcactccagcctgggcaacagagcgagactccgtctcagaaaaaaaaaaaaagaaaagaaaaaggacaaatggatcagctatgtgtgggaagagtagcaagtagcttcatggggaacagaggcattgtcaaatgtaaactgtataatatctgtgaactggttgggatgttttagtgacagtgttatctgttttcctcttcacagttcatccaggactgttacggagctttcatcaggttatcagggacataggctctttcaaaattcctttatcatctcttactgtatctgcatgggtactatcctcaaacttttcacatgagtgaaaatagctactagagctccaaacaccatttcagtcagaagttggaggaaaagggaaatgacaaaaggacacaggccctgtatcttaaggagcttttccagaggttcttcaaataacttctgtttaatatctcattggccccacatccggctatgaaggggagggtaaagaataacgtattttgctaggtgttttgctgcctggaatgaaatttgggcccgttaccatgacagaagaaaagagtagatattggtaggcaaccaatagtccatcagagaaaaagttcagaagcttagatgagggtatgtgtttacatattaaaaaactttctcgggatatgatactttctttggtaagaaacactgatctgacttctgaagactcacaaatatttagtttccatagatctttctgagatctttggttttgtgtatttgtttctggaacatttacatagcgcttatcatttgctattgtgaagttctttatggatattaactcatttaataatcaaaacaaccataaactgagctctttcacatggacatctcatactcaagagaatcaaaacaatatttttttcctccaaatatattagttcttagtcctagtttcagtgaatggcaccacattcatttaagaagaagaaagtcaggtaaactctctgatatgtcacagctgacagaattttgaaatagagaattcatcctcacatttcccccattacttcgacctgttcacttgttcaaacctcctttatttgatgatttagaaaagacacttggatatgtgccttggtcccctgtatttacaattttcttagtttctattatttaaattttatatgtgatattctctaatttacttatcaaaaacaatttgtctccaagcagtgactcatagggtaagggctttttaatgctcattataggtgttaagtatcatctgttcctggaataaacctgtttttatttttcatttaaaaattcttcactcaactcttacacaagacaatttctattcactctttatgtgataaaatcacctcattttgctagaaacacaaataagtacttttaagctcatacattctctttacatttaaaaatttttcaatgttgccaaggataattaaaatttaagaagtcacaataccaaaacatattgtcaaaatatgacacaattttaagtaatgctgcttctattttcatttaggccctggtttttctattagagaagtatgacaaaatacaatgtgtggcactattttgcaattccagtctgtaacaacaactctaaatactttttcaacctcaaattcttctgcaagtcctcttcaagttgcatgatcactctcgtattttcctacttctaagaattttgctctatttggaaacttctctctgtttctgcctcctaacgatgcaattcatcacatgttgaaaatcacctcaaattgcatttgaaccatagaaatgtgtcatttctttcttctatatatctcacttttatcctacccatgataaaataatgagtatgttcagtgatcctgtttccactagtacttacacctttagattcccctgaaaaaaacaagaaccccccccaaaaaaaatctgtcaaatttgagatatccaaactctatcacaaatacagttaatttataaactcatgaaacgtaaagggtcagaaattaagtagacagctagttagctccttttagaaatatattttcttcgtttctcctaattatcctttttcatgtatctggctgtcattgcttgccacattttataaaaatatttccttccatgtttttagaaaagaagaattcatgacaaagggtacatatatgacaggggaacaaatctacagaaagatgaacaaaaagtttaaagctctaaaggaactgaggcttacacaagctgcaaaagtaaagaaatgggcttttctgttatatgtaatgcaagaagggaaagagaatgtgtgcacttactgatagatctttgagctcatagagaaggaaaagttatcagaagactgggaatgatctaataacgatcttactttcaataacagaaagtatatttgattaactaccctactttagacttaacactggtcctcaataattgcagaaaatattttaaggatatttggtagcacttagtaaaggaataataatcaaggaataagttgacaataaactaattatatcaaatacaatttcatttttaacaaggtcaaaattaattcaggttcaaatatccttcgcatggtaaacctgtattcagcagtatgtttgataaaatctttcattacttttagatagagatcagaaacgttgagtgaccatgaaagactgaagattaataaaatgatgccaagctgaagggaggtatctaatgtcatgatacatggttctgttttcagctccattctggtcaacgtttatataaatgagaagtaaaatataaaagaaatgcttgctaccttttccaatgagatagtaaaaaaaacaaaatcaattaataccaaacaaaaatctaagatagtgtcaacagcctggaagtaaattaagcaaatgaagtaaaatagaaataaatattgcagttgggcaacatacgcttaatcactgggatacttggtggtgattttaaaacatgcatgataagacatattatattatatttataaaatacgttttagttaaaagtaaattagttaggaatttgttatgtgatgtgaccctaagctgtattaagcatttcgttgagaaagagagaagcaatagttttaccatattcacttctgaagaactatgtcagatcaggaaaacatatcttcagatgattttggataacctggaacatgaatagtaagcagcttacctactgaattattgtgaacgtaagccctatataaataggctatagataaatccagtatagagaaaagataaagggagattcagagtccctatttcctccactatccatcttcttcattttgaaaaataatgcagaaaaaaataattttttgatcaactcagaaatacttagaatttgttatttaacccttcttctgaaaccttatgcctaagctatcagcaaatcttggcaaggctacttccaaaatatattttaaatatgcttccttctctaaattttcagctacttctctattctacagctataattgtctatttctggtcaatcacaaatgcctcttattggactctgccttcaccatggcttttataatatacattttcatttgtcaaaatgtaaatccaatcatgtttctcttttagctttaagtcctcctactgttcaagatgctaagtcctttctacgaggtatagaacatcatcaaaatatggctcctcaccacacagccaaactcatctcatgctactgttgacttggtttattacagtcctgctatactagatttaatgcagactcttgaacaaaccccaaacaaaataagctattgcatgcctcaggtccttgtgtaagatctttcttctgcctggaacactctccttcccaaaatgtgcatggctagctccttttccttcaggacttaactttaaatattgtctcctcagaaaaaccatccataacaatcttatgagaaatagtcctcctcctattattctctatctcaacatcctacttgttttatttataacatttatcacaattttgtttgctaacgtaggttaagatttgttttgttttgttttttccctagaatctaatccacaagggcaaggacttttcttttcttttttactcaatgctgagaatgttctctgacactcaataaatactcaataattattcattaaatgctgaatgaatatagccaaagagaaatagcagaaggaatgagtggagatttagaaacttcagttcaatatgatgtaaaacaaagctccattctttggagacagtccaacaaccagaaataattttaaaagaaacgtatagcttgtattttctacaggactttgccccaataacacattcaacattctcttcttttcttcctgaattctttcacatctttttgttactccaaagcttctcactcagcaacccttcacaactcttgcatctctttataaactgtttatcacgattctctgaatttagattctctgaattttttggtgtttctatcaacttatcaatttctgaatttgtcacacacacaaaaagcataaacataaacatgtggtaagaataattatatctttagtcagatacatctatctacctgttctgttgattctatatcacacacaaaaaaaaccaaaacagcaattaaagagccatccttaggtaattcagagtgaagaagctaagaaaagataatctataataggtatagaagtgggggagacatagtatattaataaatctcatctaatcataataagaatttctcagagcattattgaaaattggaatagattatctgaggagctatagaactctccacaattgacaaattgaataagtacctggttataaaagtcagatggattatggtactagatatgtattttcccaagagagataatgatttatctttaaaaattaaggagcggtagcagtggtaaccattgcctctatcttctttctagatcaagaataaacactttacactgaactctgctgtctttcaaattcaaggtgcattttcaacccttcctagtttgagtttcccaacttagcctagttagagctctaaaaaattgtaattttgttttcacattctgaatgatacaaatcagagtgctaatccagatcttaccttttccagataatactcaaagagattatactaaaactcaaacaaaaagagtcgcctttatttgtttgaatgaaaatcgttagctctagtgtctggcagcacagcctctcattaacatagtatgcaaagccttcaccttagggggaggttaacgtgtacagcaatccatgtatggcaagtaaatagggttgtcctcaaagtgggtaaactatagagtagcacttggactctgctttcaataataagtactggctaacaagaaaaaccatggagaaaggagcatggttcaaatggtttaaaatgaagttttaccagaaatagttactaaaaagtaactctaaaaagttacttaaaaaagataacccctttaagtgactggcaggtttaactgaggtttgaataattgctactatcctgcatttgatatcaatcttactttatcttaagagagtgaactagaagtgataatacccttgatacgcaggagagaatccaaaaagaatagcctggataaataaacacaggaaacatatagtataaataaaagaaatgtgacatttctcttctacacacaacttagccaagaaatgagggcacctgaatattatattatgctgcaagtgtccagtttaagaacacatgacaaaaaagataatagaaagcttatgttccctcagttcaagaatggtctaatagtctaaggtctatctttactaagattggaggcaccaatgtgtaaattaatgatgcctactcttagctacactacagtgggcacttggtagtagcctttgtagaacccagtgaaaaagagatgttgcaaacttccatgagattttagagcaggttatagtttcaaattgaggaaaaaaacaatgctagtttgtgtattgtagtaattgatactaggtggaataagtaaaagaaaggacatggggaaatttcagaatatatagttttcattttatttgaaaatctctccaaaaatgtatttgattaatttttgtttacgtttcaatacaattctattcacaaccctatttttctagtacgtggattacattatctagtagctaacatattattagtaatgattaaaaataattctatatctttatctaaagatctcattttaaacagagtataactctcccttaaataattaatatcattgtttatagccttcaaagcattcgttgcattctactttatatcatagttatgtccattgctcacccctagtaaaaattactctctctgaggactgaggttgtggtttacttatcttgatatttccgcaccagtttgattgtattcttcaatctgttgtattatcaagtcacaaacaacaaaaaaggataataaatttgattagtttattcaacaactatgtattgaatggcagctatatccatggcataatattaaacataggcacaaagttattattagtaaatatttaaattatgtctttttcaaaatatttcataatttactgattatttccctatgtagatgtgaaaacaagaaaaaaaggcattgaaagtgagaaaaacatagtagaaagcataggctaaattcttaagctcctgattaaaatctgcattttattaaacctcatgttttaggccaattagttacgataatattttcaatttataaatctaatcattttaatgaaagagacatacgtatatgagtaatatgagtttacactgcttaagtaatttgcaattctgaaaagttcatagggtcatgtaaaatttaatgatgggcaataaaatggaattttcaagagggaaattcttttttcttaacaataaaatacatagctcaagactctatatttctaagtatatttgaacaatgtctatatttatgaaagatttagaaaaaagccacaaacggggacttgccaatattttattactgattagtttgctcttactttacctaaacaccttaagtaatccagcaatttagaatttatgtgttttaagtttgagtttgaatctgaggagggatttatattttttcatgagaaaaatgtctcctattaacaaagtagctatatatatataattatatctctaaagtaaggcatattacaatctacttgcatgtactttataaacacatattgataaattatgaaattgactcaataacaattacttgaataatattttctaaaattgaggttttatccccctgcaacttggaacaatatattcattttaggatttcagaatatttcttaagtgttacttcatgtaagtttttattacaatactgaagcctaaaatgactgtctcatatgaagtatagttatgtttcttctccgccaaatgccacatgtatctctaaaacttcagggactctttttatcaaatgatggattatataacaaggcagaaaatacacacacacaaacacacgtgcttatgtatgtacatatatatctcctgaggctcagtctcagtaaactgctatcactcacccaaggtaggcagcctgaaaattctacagcctcagtacaaatcttagtctgtttcactccacattgtattcagcatagcttgcttaataactttatgcctactgctctggtcagaaatatttcagccactgcccaaatgttaattatttacaagactccaatattccggggactggataaggtgactcaaaactgccctagttggcaaaccatttctaccaacaagcttattttaagttcttaagcaattaaggcaagtgttgtcagaatcttgtatattttatttttaaaggccttaatataaagaaatgcctgcaagtgactgtaagtctctctgggctttgtaggtgaattttgtcagcaaaacccaggcttatatggagtatctaaaaaactatcttaactagaccagagagcatcagtgtgattcaatagttaatattttccttccaagtcatgctgcctaaataagttttgagaaaattcagtgctgttgatgtataggtaagtcataaaacacaaatctttgtcatttaaagcttataccaatattgaaacacattgaaatagccaatctctcttacattgaacaaataaaaattcattctaagtaagtggtaaagaatggtgcttttattgatcttattatctttttcattaaaaaaggatgaacagcttaaaagtttttgcattagcagtctctgcaaagcaatttttatgatggtatgtttcattcaatttaagaattgtaatgttagctttcttatatgaggaaggaaataatatcatgaacattttaatgcaagttttaaagtgttaataaatgctagcttgagtgaattactaagtgtatttctcttttcaactttacacttatcttgtgtgtacagctgatatccctagtgtccaatcagagacaagttttcatcctgttgtccaatgaatgatgtgcataattccttttggcactgatgagagatgaatacacacatccagcccacttcagtgaaaattgacccataatttttttttatcctgaagaaaaatacagtaataaagtttaaagatggaaaaaatcagttaaactcttgaggtgtaccattagttaacaataatcagcaaacattacattttgcctggaggacagtgagctcaagatttgcttttaggtgctcatgaattctaataatcttggctctccaaatgatagcaagaaacctaaacatgtgaattttcacatttcaatgagctcaaaagttaaaattcaaaaggacagacatactttttaattattttcttctatctctactgtccccaaatatttttcttgtgaaacgagtgtatgcatttctgataaatatttagcagttgagaatatatatttatttcccacagaaagacaaaaagtgcagatcttatgtaaaactccaatgctgtctctctagtagtattatcaagataataccagaattctaagaattaaggggaaaatgacttggcatactgaggcagactaattgtcatatataccaagtattttacctttaatagtagtaaaaaggaatatgccgtaaaaagttgtttatccaccaaaacattttaattttctttaataacccttaagaatctactattcattaatttatctatgtgatttatttttggtctgttaatatcatcagcctatagaatttccagaataatgaatttcattataatgaccacggtactggtaacccccttactttatctatctttgaagggtattccaagttctactataacaggactgtcaagaaaatcagttttatttctatagctcataactttatgttttattctttgacttgcatcttataatgttaatgtattttctttcaatgattcccttcaatcttcccacccacatacaaatatcacaatgataagcagattctgtcagctattattttatattagggcagtagaataatgttttcacaaaatatatgaaaatgattatgtgatttataagttgtaactcaaaacaatataaatagaatttggattctgctttttaaatgcaacagatactattttaaataaataaatattttttgagtgcatcctatgtgcgtatcactatgctaagtacatggtggcaaaaaaaaaaaaaaaaataaaacacaacctgccataaaatggctaatatttttagtgtaaaaatgttcatatagaatagtcaccttaaaaggaggtcgaatataaataaatttaaataaagacataaacaaacctgaataacatcagagagagactaatttcccctaatactaaaagtgatctttactaaaagagaatgaatcttcattctggatgacatcagagactatgttattttatttaccattgcaagttgaagtgaagagggaaaagataaagaggtacaatcttggaataaattattccaaaataaattgaagtagttaccaggaaggaggttttagcctgggagcccagaatttaatttaaggcaaatgaacaaaggcttttagtgcctactttaagatagcataattgtagaaagaaggcagtgtgctggaatggaggtgaagcagagaaggacatatagtgatgctttttatgtcagacctatctgtgaaaaagactttgctctcaataattgactgattgatacataggcactaagatcaaacacagttaattctaacacacaattctaataatggaatctctcacaatatgcagccatggtttgcttctgagaaaaaagctgctggtagaaataatgctccatctctgtaatcaccctctccatccttcggagctactaaatcaacaaacagagaccccactctctttccagttctagtacctgtgacaggagctatttaagtgtcttcaggccaaaatttagaactcttgataaatttatctttgtgaacagcctaacatataatgctggtagttaggtttttacctcattttgagacttcatcacccctttctgcctttgcaatgtttcccagtttcttcaaacttgacatctgccttgagccatttcctaagcctctattctacctatccagtctttagtccgagttttcttcttaagacaatacttcagcatggtgtctgggatttgatacctgatgacagattccattaaccgacttttaatcttaacctggtccaatttcaatgttgctaaatgcttcatgacagttgctcaactctttcttgccatgtggacaatgaatagagcttacagtactcactggataccagactgattctctttttctaattcctagtgctataaccattctgtctcctgtactgtcatactagcccagtccaaattcttccttagtttaacctattgtgttttaattaatataccatcacctgtgaatctcaagataaagtgtatgtttaagttttaatatgagtaataggctaaaagctctaaaagttatcaaaagattgagctcattggaaagcatcttaaagaaactgggaacatgagttaggcagatgtaaaagagtaaataatacttaatttacattaggaaaacatgaggcaaacaggtaataatggacaaaagactaaagagaatggtgaacagacaacaaaaaacaattaaacagtaagccaaaacacccataaactcctgtaatctataatcctattatgctcttttatctaggctctaggaagttttctacactatcttgtcatctgtaacatttcaccacctacaaaactttaggctgacaggtgtaagaacttactctttactctttccttcatatcttaattacaattaaatagcaatcctaacatttggttgcttatatggaagattaaataataaatgtaacttgtttactcaaagtattttgataaatattatgcatataactccacaactccacatatggtattaaaatatatagagagaacttttattgccaaataatcattttgagtgctcaggtgaaattaaaatgttcattaacagccctatccacttgtttccacattttgtctcatacatctctatgtttaagataatttcctttccattaacacatttgccaagctaattctcacttccacagttttgatcatatagttttcttagttagcattttccttcctctgttcttctgaatagtattatttaaaattttatcttttttttttttttttttttttttttactttttggctttcatttttttcaatgatccaccacagagttggtgtttaattatataaacgtattggtctctatttcatctgtattcctctattacctcatctaaaatgctatttcataaaaaaaaatctaccctctttaattatcccattgcatgttgaggtgaaaaaggcacataagagcatagaatgtgaaatttttagctaatctttagtacttatgtaaaaacaatctgtgttgatatctgtattgatacttatatctataaatttgtgtgagtacctatctacggacctttaagtatatgagcaaaactgattttttaattataaagaccatcatatttgcattatactgtgtggccgaacagtgggataaatcagtatttctataggtaaaaaagtcatcaggctgggggccgtggctcacagctgtaatctcagcaccttgggaggctgaggcaggtggatcatgaggtcaggagttcaagaccagcctggccaatacggtgaaaccctgtctctactaaaaatacaaacattagctgggtgtgatggcgcctgtagtcccagctacttgggaggctgaggcagaagaattgcttgaacccaggaggcagaagttacagtgagtggagattgcgccactgcactccagcctcggcaacagagtgagactccatcaaacaaacaaacaaaaaaacaaaacaaaaaaaaacaattgtctctcagatatttgaatattctttccatatgtcaactctcagaaactaactctccacatagatttctatccattatgagtctaaaaattacaaacatttcgtaagttttttcagagaaaataacacaacattcatacacatgggaggaattatttgcatgttaatttctgaaatttattataatgacataaaatgcttacattttaggataatagatttaaatattaagcataaaacaataacaaactataccattgaagattcttaagattttttgtccttcagtagtagcataccttttaaataatataaattattcaatgccaaaattatatatacagacatacgtatcaataaaatagaacttagagtccaggaataaatccttcaatatagtcaattgaattctgacaacagtaccaagataattcaatagagataagaaatttttctcaacaaatggtagtgggacaagtggatatctatatgtaaaataataaagtcaaacctttacctcacaccacatgaaaattagctcatgatagattataggtctaaatataagagctaatactataaacgcttagaagaaaacatagaaaaaaaatctttgaggcctcaagtgaaagaatggtttcttagatatgacacaaaaaataaaggcaacaagaaaaaaatataaatgtaagtttaccaaaataaaaagcatctgggatttaaagaataccattgagaaagtgaaaagacaacccacataatgagaaaataactcacaaattatatatgtgataaaagatttgtatcaagaatatgtaaagaattctcacaactcaataataaaaagataatctattataaaatgatcaaaggatttaaatagacagttctccatagaagatatataaagggacaataaatacacaaaaagatgctggcatcatcaactgctaggggaatgcaaattaaaaccaccatgagattactttgtatcctgtagaacagttataatcataaagacataaaataacaagtattggttgggttttggagaaattgtaactctcatgcatttatcatgtgaatgcaaaatggtacaactgctatggaaaactgttcggcagtttctcaaaaagtcaagtgtagaattaccatatcatccagtaatttcacttttaggtatacccaagaaaactaaaaacatatattcattcagcaatttgtacatggatgtttagagcagcatagttaaaaatatccataaattagaaggaactcaacgaatgaatggaaaaacaaaatgtggcatatccatacaatggaatattattgagccataaaaaataaatgaattgttgataaatgttacaacatgtttgacatgagatttgggcagtgaaaaaaagtgtttcaacatggatgactcttgaaaacattatactaagtggaagtagccagacataaaataacatatatgcatgattccgcttatattaaatgccaagaatagacaaattaatggagagagaaaatagattaatgttcccaggggctgtagagagaatttctaatgggtatggggtttcttctggggaataatgaaaattttatttaattagtgatgatcgtttcacaaatttgtgaatatactaaaaacaactggactggacacttaaaatgttttattttaatggtatgtgaattacatctcagtaaagatgtttttaaaaatggtgaagttggcaatgtagcttcagtagtgtttctcaaaattataacaaaatgtaaacaatgtgagataccaaagataattaacataatagcaagagacctgagaaaattattataatttttcaggcaatttaggattcacattttcaaaaactgtaacactttttactatttctagtggtaactcaagaatgtaaaaagaagccaagtaaatatgaattttactatgtttttactgtttgataaaactgaagctcaaaataactaaaatgcagaaaacaacatatttatcattaattactagctataacacttccagaactttcatttaaacttggtaataggatcttatgcattttctgtctttggggatccaaatataaattatttgatggcatctacagaattataataaatcaggattcaagatagactagtcagaatggaataaaaaatctacaaaatagttttttttttaaaactgaagtgctaggaagatgagaaaactatgagagaactttaaaacttaaaaataaattataaaatcaacacaaagtacatcagatttagtatttaaaatacagctaaaaagagataatgattatcaggtcaaaagaagactgtaccagaaatacttagtaatgaaaataaaatttggagagtagagacatccataaccaggactggtaaaatataaatttggactaattctcaagtttcaaaaagccttatgaaagatttgtttaggccaggcatggtggctcacatctgtaatcccagcactttgaaaggccaatgtaggaggactgcttgagcccaggatttcaagaccagcctgggcaacaaccttgtctctaaaaaaaaagtataataataaaatttaacttagctgggtgtgggagtgtgtgcctgtattaccaactactagagaggttgaagtggaaggactgcttgagtccaggaggtcaagattggagtgagccatgaatgtgttacttcactccagcctgggcaacaaacagagtgagacactatctcaaaaagaataagtaaatacataaatcaaaataaaaaaattaaaagtcttttgaaaattaggaaagagctaccaagaaagctaggacttatcaggtcaaaatttaagagaaggcaagatcccccaaaggtaagtcctcaaagatgcttttgttctgataaaatttgcagatcaggaataactttggtggctcaaggagatcaggaatcaaaaatcaaatcccatgttcaccaaagtagaaggtcctgtccatagtgagctggaaactcacacagctacagcatgatacaagtaaacatggaataaaacaggctgtaaattaaaatgatacctgaataatccataaaatctcgagatttaaattgtgtcatggtcaaatattggtggtgattcagtttctagtggtagaaaatggaaacactatctggaggaaagtaccttcattctaaggcctaaaattttcacaattgatatttcaaatacaatgagcagtacacaagacctgaggtatcaaatgaacatgaacaaagactatagagttactctgcttattatttttcaataaagaatgaacaattttgatatatctgcaggaaagaacaaaaaattaaaatttattgattaaacgtagctaacaagaaaattagtgaactggaagagtaattgaaaaaaatttcagaaagcatcaaagagaaaccaaaaacaagtgaaattcaaagaagagaaaaagaaccatagagaatacaagcttattagtaaaaagtaacaaacatcctatagcaagatttttgacatcagtgcaacctagctttgctttaactgtctcaggcaaataaatgtcttaataattcaagtggaaagtatctattttattttataatattttattataacattctacctccattaaatactttctttacttcttgattattttctattgctttgccaattgctttccatacctactctgcagcaaagacttatatttgttctttaatattcgtttacctttgttttcataatagaatctctgatttttgtctgggcacatttctgcttaaaataatgcctacatatttcagccttccttgcagctgaatgtaatgataaaaccaaaatctagccaaagatatattgtgtggcatcatttagaaaccttacttaaaacacatctgcaagttccctcacacttttattttctatctcttcctctttcttgatggctggagtgtgcatgtgatgggtggagtaagtgcagtcattttgggtcatgaggtactatttgactggaggtcatgttcagaaaagcatgagataaaaacagtcagtcactaagtactgagtgaaatagttccataatatcagtcctagactgtatacctctggagttttacctgagaggtgaacaaacatattagtatcattttagatctttattacacatagctgaatctaatttaaactgatagcaatatggtagctggaagtgggatggtacagatgaaagaaatgtaaaacatttgacaccaccttagtacaggagattgggtgaccagtgataaggactcaagatattataggctgaagagctggtgacccttgttattatggcttcaaaacattttcactttggaaggcaggctacatgctgactgagtgtgttgtgttacagaaattttcaaacaaataccgtaattgagtgtgtcttagatgttacttgtagcttttatttaagtcttttgagagaaaaaaaaatctgggttatatctagccaggctgaaataagagatggaaatagaataaaatttttgataaggcaggtactctttgaagtctgcaagttaagcttactgagattctagtgattcagggccttgtgtaggtgaaaaaaccaacatctcgttcctcaaattgaagcggttacaataggggacttcaaagtagaaataagacttatatacaaaggtgtaaatgtctgcaggaaagatgagattaagaattttgtcttccctccaacacccattgtttcagaaagttcacctatggtcactatcgttaatttggaagagaggaaaatgagtagagaacaaaaaccagtaagtgaaagatcagaagcttcaggattataaacaatgtctaaacaagatctttctacttgcttaaggatagaaactactgacatcaaataaatcagaagcatactaagtttttgaatgaaatgtattaccaaaaaaaaaaagtctgtcctaaaaatacctgtggttcttcaatctctatagcaacccacaggcccctaaatctattaagactatgaaactccaacactcaggaggaacaaattccctaatacctaattctgatgttgccataaatatgaataaacaggtaagatgttttcacagggaaaatataggagatttttccagatgtgtttactctatttcaaaagaagagagtgtttactattcctatcagactgatttggtaactgctatgggggcagaaacaactgtgtttcccttttccaaattagagttttattataggtatgctgtttctatgccactttatatgctaggtatgtataaggtgaatattttataatttagctataggttgctagactatgagttatatcttgtctaagtgaagcagactggacatctaccaatataacgattggaattaagtttagctgcaagtagtgacttattcaatataggagtacttccatctcacatgaatatctgaatgtaagaagaccagggctggtatgaaaactgcaattttctgttatccaggatacttccaagtttccactcattcatggtctaaaatgaagttccaagccacagaatgaaggaaggcagaaagaagagacaaaatccattgccaactgtcttttggggacatttctcagaatctgccaaatacttcccttcatgacatggtttgatgagctgaataaagggctgccaaatcatctatgtcctaatcccctgaaccctgtgaatgtcaccttatatattagttgggtagggcttccatagactgactggcttaaaacatagtcttttttttctcacaggtctgaaagttggaagtccaaggtaaaggttccagctgattcagcttctgatgagggctgttactggcttgccgatgacaaccttctcactatgtcctgatatagtctttcctcagtatgtgcacatggggttgggggagggggagattcttaatcctatcaggtcaggaccccatccttatgacctcatttaaccttaattacttctttagagtccccatctccaaatatagccacacaagtttagaatttcaacgtatgaattttgaagggacacattcagctcataacactttataggcaaaaagatatttgcagatgtgattaaggatgttgagatgagttgattattgtggtgtgcctgataaaataataggggtctttgtaagagggaggcaggacattagagaggatgtatgtaagagatgagatgacagaagcaagaggttagggtgatgtgaggtaggggtcacaagccacagaatataggcagcttccagaaactagactaggcaagaaaacagattctgccctttgaaaaacatcagccatgtaaacactttgatttagtcaagtaaagccaattttagtcttctggaactataaaggaatgaatttatcccattttaagccaccaaatttgtagtaatagaaaactaatatacatgccaatacttaattgctagagaagctgagaaatgcaaattaatccagacagctaaaatttggggatgctattagagaggaagagagatatgatagatattagagggcaaacatcacttactgccacaaccagaaatgatggaattttttctgactattatagtgacataagcttttaggtttgctccctttggtagaggctttgtgttctgtttttggaaaaggtacaggcaaatgtttgaaattgtccttcaatagtcattccaatcttattctataataaaggaaactcatgttttagctgggcatttggatgatcttaatgagactttatttcttagcctcttgtagctatgagcccaatttgtggggcctaccagatataagcagagtgttgcatggcagcttctaggaactttccaaaagtaaacacaatagctgtgacctcttcttctttatttcctcttctttctggcaggttagaatgaaagcataatgactggatctggtgaaactattgtggaccacaagaggacctgcaaaatagaggccatgtatgctggagcaacaggatggaaggagtgaagaactctgagaacattatgatgcagagttgttataccagcaatgcactgtctatctcttgatttttatgtgagagaacagttgttttgtttacatcgctattagggatgattactcccaattctaactattgcattctcttccttctttattatttctctcatagaactgttcatgtaaatttttactcgtgtctctacatacatatccataacatgtataacaaaattttgtctttgaaaatgtaacattagtgaagttatttaaaggcatatgtgttgtgaactattataactaagatattgggaaggaaatttgttaaatatattattcctaaatctcataagcaacttacattaagcacaggaattctagctaatgagtaagaatgcttttttatgtagacagtatattcaatattggatacttttgtactctaaaatcatagccatatataactaaaccatggtcacatgggaacatagtaaataaaaaatgtaaaaatacatttaggtcattactgctaacttataagtttatccaaaacattcctaatctaagtgttactttacaatcatatagttatatttaaaaagaaatgataaaaattatatctgatggagatgtttagcagagggtctcaaactttttggtcagaggactcctttatttgcttcaaaattatgaggcccctaaaatcttttatttatgtgtattatattctttcaatatttaccatactagaaattcaaagtgtaaaaagtttaaagtatgcattaatttatttaaaataacaataagaaacccattttattttcatgaaattacacactattataaaacagaactatatttcaaaaaaaataactgttaagagtggaactggtctatatttttaagaatagatttagtgtctggcttaataacccagagattttcatatctgtttatatattaaatctcttattgtatcatgtcatgcagcctctggaaaaactccatgatacagtaatgggagaatgagaatcaaaaaggaaaatactgttttagtattattataaaagctatattggtatggtggatcctttaaaaagatttcaggaacctaaggtggtccctgaactacactttgagaaccactattatacagaataactacaaagataaatcttacaaaactggaccaattataggaaagccagtcaaaaggcaattataggaaagccagtcaaaaggcatgaaaattctcaaggttataacttcctcctttggcttggagaagtataatcgtctgaagccttctcgcaactcgttaaagtcattctcggtccagctttgttccattgctggtgaggagctgcattcctttggagggggagaagcgctctgatttttggaattttcagcttttctgctctgttttttccccatctttgtggttttatctacctttggtctttgatgatggtgacatacagatggggttttggtgtggaggtcctttcagtttgttagctttccttctaacaatcaggaccctcagctgcaggtctgttggagtttgctggaggtccactccagaccctatttgcctgggtatcagcataggaggctgcagaacagcaaatattgctgaacagcaaatgttgctgcctgatcgttcctctggaagcttcgtctcagaggggtacccggctgtgtggagtgtcagtctccccctactgggggatgcctcccagttaggctactcgggggtcagggatccacttgaggaggcagtctgtctgttctcagatctcaaactccatgctgggagaaccactactctcttcaaagctgtcagacagggacatttaagtctgccgaggtttctgctgccttttgggggaagtttgaacacatcacaaagaagctaaaatccttgaaaaaagattagatgaatggcttactagaataaccagtgtagagaagtccttaaatgacctgatggagctgaaaaccatggcatgagaactacatgacaaatgcaaaagcttcagtagccgattcaatcaactggaagaaagggtatcagtgattgaagatcaaatgaatgaaatgaagcgagaagagaagttagagaaaaaagcgttaaatgaacaaagcctccaagaaatatgggactatgtgaaaagaccaaatctacgtctcattggtgtacctaaaagtgacaaggagaatggaaccaagttggaaaacactctgcaggatattatccaggagaacttccccagcctagaaaggcaggccaacattcaaattcaggaaatacagagaatgccacaaagatactcctcgagaagagcaactccaagacacataattgtcagattcaacaaagttgaaatgaaggaaaaaatgttgagggcagccagagagaaaggttgggttacccacaaagggaagcccatcagacaaacagtggatctctcagaagaaactctacaagccagaagagagtaggggccaatattcaacattcttaaagaaaagaattttcaacccagaatttcatatccagccaaactaagcttcataagtgaaggagaaataaaatcctttacagacaagcaaaagttgagagattttgtcaccaccaggcctgccctaaaagagctcccgaaggaagcactaaacatggaaaggaacaaccagtaccagccactgcaaaaatttgccgaattgtaaagaccatcgatgctaggaagaaactgcatcaactaatgagcaaaataaccagctaacatcataatgacaggatcaaattcacacataacaatattaaccttaaatgtaaatgggctaaatgccccaattaaaagacacagactggcaaattggataaagagtcaagacccatcagtgtgctgtattcaggagactcatctcacatgcagagacacacataggctcaaaataaagggatggaggaagatttaccaagcaaatagaaaacaaaaaaaggcaggggttgcaatcctaatctctgataaaacagactttaaaccaaaagatcaaaagagacaaagaaggccattacaaaattgttaagggatcaattcaacaagaagagctaactatcctaaatatatatgcacccaatacaggagcacccagattcataaagcaagtctttagagacctacagagagacttagactccgacacaaaaataatgtgagactttaactccccactgtcaacattaggcagatcaacgagacagaaagttaaaaaggatatccaggaattgaactcagctctgcaccaagcagacctaatagacatctacagaactctccaccccagatcaacagaatatacattcttctcagtaccacatctcacttattccaaaattgaccatatagttgcaagtaaagcactcctcagcaaatgtaaaagaacagaaattataacaaactgtctctcagaccacagtgcaatcaaactggaactcagcattcagaaactcactcaaaaccactcaactacatggaaattgaacaacctgctcctgaatgactactgggtacataacgaaatgaaggcagaaataaagatgttctttgaaaccaatgagaaaaaagacacaacataccagaatctctgggacacatttaaagcagtgtttagagggaaatttatagcaccaaatgcccacaagacaaagtaggaaagatctaaaattgacacccgaacatcacaatgaaaagaactagagaagcaagagcaaacacattcaaaagctagcagaaggcaagaaataactaagatcagagcagaattgaaggagatagagacacaaaaaaaaccttcaaaaaatcaatgaattcaggagctggttttttgaaaagatcaataaaattgatagaccactagcaagactaataaagaagaaaagagacaagaatcaaatagacacaataaaaaatgataaaggggatatcaccactaatcccacagaaatacaaactaccatcagagaatactataaacacctctacgcaaataaactagaaaatctagaagaaatggataaattcctcgacccatacaccctcccaagactaaaccaggaagaagctgaatccctgaatagaccaataacaggctctgaaattgaggcaataattaatagcctaccaaccaaaaaatgtcaaggactagatggattcacagccgaattctaccagaggtacaagaaggagctggtaccattccttctgaaactattccaatcaatagaagaagagggaatcctccctaactcattttataaggccagcatcatcctgataccaaagcctagcagagacacaacaaaaaaagagaattttagaccaatatccctgatgaacatcgatgcaaaattcctcaataaaatactagcaaaccgaatccagcaacacatcaaaaagcttatccaccatgaacaagtgtgcttcatccctgggatgcaaggctggaacaacatatgcaaatcaataaatgtaatccatcatataaacagaaccaaagacaaaaaccacatgattatctcaatagatgcagaaaaggcctttgacagaattcaacagcctttcatgtgaaaaactctcaataaattaggtattaatgggatgtatctcaaaataataagggctatctatgacaaacccacagccaatatcatactgaatgggcaaaaattggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtctgcagatgacatgactgtatatctagaaaaccccatcgtctcagccccaaatctccttaagctgataagcaacttcagcaaagtctcaggatacaaaatcaatgtgcaaaaatcacaagcattcctatgcaccaataacagacaaacagaaagccaaatcatgagtgaactcccattcacaattgcttcaaagagagtaaaatacctaagaatccaacttacaagggatgtaaaggacctcttcaaggagaactacaaaccactgctcaacaaaataaaagaggacacaaacaaatggaagaacgttccatgctcatggataggaagaatcaatatcatgaaaatggccatattgcccaaggtaatttatagattcaatgccatccccataaagctactaatgactttcttcacagaattggaaaaaactactttcaagttcatatggaaccaaaaaatagcctgcattgccaagacaatcctaagccaaaagaacaaagccggaggcatcatgctacctgacttcaaactatactacaaggctacagtaaccaaaaacagcatggtactggtaccaaaacagagttataagccaatggaacagaacagagccctcagaaataataccacacaactacaaccatctgatctttgacaaacctgacaaaaacaagaaatggggaaaggattccctatttaatacatgatgctgggaaaactggctagccatatgtagaaagctgaaactggatgccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaaccaatggcaacaaaagacaaaattgacaaatgggatctaattgaactaaagagctctgcacagcaaaagaaactaccatcagagtgaacaggcaatctacagaacaggagaacatttttgcaatctactcatctgacaaagggctaataaccagaatctacaaagcactcaaacaaacttacaagaaaaaaacaaacaaccccatcaaaaagtgggcaatggatatgaacaaacacttctcgaaagaagacatttatgcagccaatagacacatgaaaaaatgctcatcatcactggccatcagagaaatgcaaataaaaaccacaatgagatatcatctcacaccagttagaatggccatcattaaaaagtcaggaaacaacaggtgccagagaggatgtggagaaataggaacactttttatatgttgatgggacggtaaaccagttcaagcattgtggaagacagtgtagtgattcctcagggatcttgaactagaaataccatttgatccagccatcccattactgggtatatacccaaaggattataaatcatgctgctataaagacacatgcacatgtatgtttattgtggcactattcacaatagcaaagacttggaaccaacccaaatgtccaacaatgatagactagattaagaaaatgtggcacatatacaccatggaatactatgcagccataaaaaaggatgagttcatgtcctttggagggacatggatgaagctggaaaccatcattctcatcaaactatcacaaggacaaaaaaccaaacaccgcatgttctcactcatagatgggaattgaacaatgagaacacttggacacaggaaggggaacatcacacactggggcctgtcatatggtggggggagcggggagggatagcattagaagatatacctaatgtaaatgatgagttaatgggtgcagcacaccaacatggcacatgtatacatatgtaacaaacctgcacgttgtgcacatgtaccctagaacttaaagtataattaaaaaaaaaaaaagaaaattctcaagtttgtaagagtgcatttggagactatcaagaggacaaagtagatgagaaaaaacattcttcatagtttatcgcagatcaagagggaaaataatatttagaaaagaataaaaatgaaactgctactctccaaattattcgatactgatacagtattatcttcactgagtggtaaataaaggtataatgttgaatgttttcattaagaactaatttaaaaattgcctaagaacttgaataaacatttcttcaaagaagacacagaaatgcctcaaaagtatataaaaatgcccaatgaaactaatcatcagaaaaatgcaaatcaaaactgcaataagatattacctcatatctgttaagatggctattataaaaaatagtaaaagacaagtgttggtaagaatatgaaaaagttgaaactcctttgcgctgtttttgaaaatgcaaaatgacgtagcagctacgaaaagcaggatggaggttcttcaaagaattaaaattagaactatgatatgattcagccatcccacttctagatatttatccaaaagaattgatatcaagatctcaaagacatgaacacttcctagttcctttctcttactctttccctttcctaggatgcattgtgtcatttgataaaccctctgttcaactctctcatttccccagtgatctctctattgactttggcaattcacacagctttttacctcagattatgtattaatctagcacccacttgctgcttttcaaaaccaattctgcaattacttggcttgaaacctttcttatccacatatatggagctaggtataataaatggtgtcaaagatgggtttctccagaaagggctatagcctcccttctaagccatcaatattgcttccttggaccttaaaggctgaactacaattatctttagcctctggtagctctagtatcttctctatagattcttctgacaaatatcttatacttctacctaagtagacactaaaaaccactacttctcagaattcctaatactcagaacaactccagcttcttatatgagacccattagttgcaggtggctgactgactaaattgtacttcattgtttatatttccctcatttccattctttataaaatcaacctctgcccagtgagatttttctagctcttccccatcccctacaagttccagcatagaacttgattgattgcaagtttgtaggccttatgctttactacagtgcctggaatattgtaaatattcagtaaatatctatttaaaataaattgcattactggtggaaccctaaaatgagagttatacaataacaaaggacaatttttagagtagatgtaagaatgtcatcacaaagctcatttcttagcattagttaagctagaacaaatcccagaaactgaataataataatattttactttccagcataaggaaacacactatttcacaaaacaatgacataaattgacccccaaaataaataaaaatacttaaacatattttttagcattccatattataaaagaaggtgaccagttccacatttgctaaatctcatagagaatcaactccttcactattttcttagtatcattttctgttgaacaagataaaaaagaagatgagtagtagcttcaatattttggcttgtaatattatggaactaattattctccctctgtccttcccccccccgccatatttacctgaatttaaagtagacataaaatactaaaagcaatcaaataagactagttcttgatgtatgaaattacagcaacctcaccgtgacttgccagctctgttctgcaacactctagtcaaagccagctacatagactgtgatgtaaatgcactcctgtgctacgcaatgcaatagtcctgagtaaggtgaatccttctctttcctctcttatataggacaggtgacaaattatctcatctttctaatagtaaaaggaaaattacatctcaccaaagaatatacatagatggtaagtaagcatacgaaatgttcaacatcatacgtaattaagggaattataaattaaagcaacaatgaggtaccactaccaacctattagaatgaccaaaatccaaaacactgacaataccaaaagctgatgaggtcttgtgtagcaacaggaactcttattcattgctgatgggaatgcaaaatgctacagctgtttgtatgacattctcgtcatacaatccagcaattgtattccttggtatttacccaaatgaataaaaaacatgcccacacaaaaacttgcatacaatatttgtaggagctttattcataattgccaagacttggaagcaaacaagacgtccttcaacaggtgaacgcatgatctttcatacaatggaatattattcagtgctaaaaataaaatgtgtgctcaaagccacatgaaaaaggcataaaggagacttaaacacatatcaccaagtgaaaagaagccaatctgaaaaggttacatactatatgatttcaactatacgacatttcagaaaaggcaaaactgtggagacagtgaaaagatcagtggttgccaggggtaaggtaagaaggattggcagagtacaaagaatttttaggagagtgaaacaattctgtatactacaatagtttatacatacaattatacatttgacaaaacccataaagtgtacaacaccaacaatgaaccgcaatggaaactacggactttaggtgataatgatgtgtcagtatgggtccatctatttaataaatttaccactgtggtgtaggatgccaattgtggggtatagggaaactctctgtacttcccactcaactttgttatgaaactaatactgctctaacaaataaagtttatgaattaaaaagaagagaactgatgatgtggcataaaatataaaacagaggtacctgaaggcaatatttctatatttatgttatcaaaaaagtaagtaaattttttgttcacaataaaaacgtttttattttgtaaataaaacatatttgaatttttaaaaagatgtataaacctttagaaagcaataattatctaaaattgtattaactatgaacactattaatatcttgctgactataccttaatgtattttttcacatctatgtggtgtgtgtgtgtgtgtgtattttttttttttttgagacagtcttgctcttttgcccaggctggagtgcagtggtgtgatctttgctcactgcaacctccgcctctgggattcaagtgattctcattcctcagcctcccaagtagctgggatttcaggagtatacaatcatgctcagctaatttttgtatttttagtagagatgggggtctcacaatgtttgccaggctggtcttgaactcctggcctcaattaatctatccaccttggcctccctaagtgctgagattacagacgtgagccaccatggctggcctatgtggtataattaaaaagttatcttgttgctatttttgagtccttattaaaattataatagatttaaatacaaacagctcatcagatttaaaaatatatatttaacctttagaataatacatctaataataattaatggaaagggttcacagggagaattgtatatgagaacatttaattttatttgatcttacaaaatggcactcaacatagcatgtatatagttccatgagtcttatttataggaaaaattaatctttggaagcaaagcaaaagtaaataaaaatattctagaattcaagcaaatcagcagttataaaacaaatcttactttagtagagctgaatgccaggttattttatgtcaggtgttttctggaggtatacaaagccatagagtacaagatgtgaacattcagtatgttagaagtggttccgagtaagagatgcctttcagagaggttgtatatggttaccctatagatagctttcctcctttgctgataaccagggagaatcaggcaccctctccagaagattaagacagagggtgtgaaattccaattttcatgcctcaaggagaaagggtattgctcaagttctaagaaaaagattagatcattatcctaggaagtggactgtcaaaaaagatagaaattcacaacatatagactgattcttttctttccacatggttgaagcagtaaaagtttctggccatcactttcttacttcacagatgctttctctccttccttacaacataggaactaaatcagcacaaggaagcttccgatgtatgtggcaaggagtggggatggcggggggaggaagggaggggagctaggctgcctctaacataaatattttgggaaatgcccccatctatttccttttggctcccatgggtgtgagtatctctcacactatattccttctaaattcatgtttgaaatataggaagtagatgaaagaagactatttatgccaacaaagtataggtaataaaggaattaccacacagtccagcctaggttacttactataagtttataaggaatttgaagtcaaagccccggtggggtattagtgtgtttgctattactccctgaacatatattttgcttagaacagcagtaacctccaagggaaaggatcaacgataccaaagccgattttaaatatccttaggcatcctagcaaaatctttcatattagtattcagattttcctaaaatctatcataatagtatacaagttttccttcaattggatttaattgaactcccacagttctgtatttatgccagcctaatctgtaccactcacaaccacgctttaatacctgtaagccatggaaaagtaatgtccctagtaagtgtctaggaagtgttccacatcctccatttcttctattctgacccagctgcttttgtcaaattcactcctcacggcttctgacttctggttctctatctcatttacagttagttcttgctccataaacactggatgtttatttgaatatctagttttgcatcgtggtatttcctaagtgaatgtagcttgaactcactcctctgtctcttcgcactttaggttccatagttatgggaattattaaaccctttaagtcaagcacgttttattcccaaacaggagaagattcagatactgattacttcatctaattactgaaccttgaattctattcttggctaatcctttgtattgttttgctcatggcatgttttgttgttgctattgttttgttttttatgaactttcagtattaaatgttcatgttttctcacctccacccctttccctactccttaaccctttcactgttcctttagatttatcaattatcactatagtttcttacaaaccaaactccaaggcacaagaaatcaggtagctcacttagttgatattattatttttaccactcaaaataatacaagataaaagaataataagtgaataaaaataatacataatgaataaaagaataatatgtaattattatataaataataaaataagaataatgaaagataataataagagaataatatatcaactaagtgagctgaagaggaaactacaaatgaagccagcagaagattgaaggacaattttatataaagaaactattcatcaaaaaataaaacttacaattaaaaataattttaattactttaagaaattgagatgaagacaacttctataatattctatgaatggtggttataaaaaataaaaatgcacaacacaatgtacatatttatcaactatgaaagaatagttcttaaaaagtaacattaataattacacatttagcagaattattcaaaatacaagggagatttcaaacattctttataataaatttatcttgaaaaaacttcataatattcaaaatacttgcaaaaccttgacaatggtacattttatataactttatacatactaaaaaatctttggaaaatgaatattttatttgatttcatgcacatatatatttgcttgccacaacaaaatatatacacaaaatatatatttatacacaaacacattggttgtcaatatattcaaattagttataattacacaacaaattggttatcagtatactgatatcatactctctaatcatactccgaaatcatactctgtataaagtatgtaaaaaagcaggtggtatgctctgaaatccagtgattttatattctacacagagggtcaaaacataatttagatgaactttataattttataatacacactatcatctggagcaaattaatactgttggcactgagtgctgatgagggacaagttttaagtagaatatgtttgccttttgtatcctatgtttttattcaatgaataactttcacacgatttaaggagttgagaacattactatgctatatctggaacacaggtgttcatttgccttgaaataagactaatgacagtctggaccttttgtattgccttctaacaatgctaatgtaatagaaatatttgtagtttaggctactcaagcagagagccacacatgaaggagcttatcacaaactaagtgctttagaaattatagaatgttcactccagttaattctactataatgctaagtattcatttctaccattaattagtgtccaaatcaaaataaaattataaagataaaaaagcacaaattctagagtcagaagacctggagtccgatcctacctattaattatgtagcttttggtaagttaattaacctctatgtctcttagttttcatattggtcaaaatgagataaaaaatatctatctatggtgctacagagaataagttacataccacttgcaaaatgtctagcacagtgcctgggatatagtaggcattcaatcaacataaataaatttctttcaatttccactgggtcctcaaagcaatttataatatagcataaaaccaatgaatgaatgttgtattatagagttcccactctttaataaactaaatatttatgttttcaatcactgagaagtggtttttacgttattattactacttgtaaaaactaaataaaaaattatatatataaagcataaattattaaatggttgtggtatactatactatagatgcaccacaaaaatatatttgtattacattactatataacttttttcaatcaaaaaatataaagcaggatattaacaatgtaatgaaggacatttaatagagactgaagaaataatagcgctacctaaatcataactttaatatcttaaatacatttcaaataaaaataataaactaattatacttacatgtttccaatatgcaagctttccttttatattagtttcaggtttgaaaaagagatccttaaggagcttatcttcataccctttggttatgtaaatccattttgcttcatatcctctaataattttttcctgctgtttttttttgtggaaaaacacagggctgaatataaggggaggggaaaactatttgttagttttttgccattaaaaaacatgaaaattagtcatgagttcacttacatcttagaaaacatagtgttaaattgaatgtaataatatatttattttcatagtagtgttatataatgctacttagtaactaagatttgttcatcaacattcatcagaggataaatgaatgctgagaaatttcagctgatatgaatctacaaacaattctgtacttacatctggctaagcattttaataaataatgggaaggagaacatgtctaaattatctatagaaacataaggtaaacagtgtgaagttattttttttccaaacctagtgaagaaggaactttttaaatgaggtaacagttattactatatcacaaaaattatatttgtacttcattacaaactaggaaatatactctagagcagtatgtctaacataatataagccagaaataattttaagtttttgattagccacactaaaaaaaaagtttaaaaaacaggtaagcttaattttaatactatgctttatttaacccaatagatcaaaaatattacccaataaatggcatctacaagctaacatcatactcaatggtcaaaaactacatgttttccctctaagattaaaaacaaagaaaggatgtaatctttcatcaaacctactcaatattgtactacaatgcctactggtctaataaggcaataaaaagaaaaccatagaccaatctcacctttgaaacaggcacaaaaattctaaatattagtgaaaagaatctagtaatgtaagcaaagaataataacactatgatcatgtattgtaaaactcactacgtcaacaaattagtggaggaaaaaagtgtgattatataagtacacacaggaaagtcattggataaaatttagcagcctattttatagaaaaatctttgtaaaacaggatcaaaagaaaccacatcaatatcacggaggtgatttaccaaaaatcagtaacatccattctgagtgataaaataatcgtttgaagtaaaatgataaatgaggtagatggttaccattattaccattattattcaataggagaaataaaactaggaataactgaggaaagcaatcttctcacttctaagatgttttaagcagactccacctatttactccttcattcaaaatatttgtattaatgacatacaaattagttaaggtaaaatatactaagataatacaatttataataatttaaataaggccgtttactttctcatgctgaccagtctaggctagtggagtagccctgctccataaagtcattcgattttgttttaccatatccaaaatcactgccatcagctacatgatgaatgcactctagcccatggaataaggaaacgtgaaaacaaagggggagcaataacaatttaagcacataaaatcgaagttgtactcattacttctgctcactttccaatataacaacaacaaaaaattgtagtctgatgaatatacttagtcacgagagagtgtgaatacaatctctagttttcagtcaattgccaaaagaaaagaaaagaatggatgttaaagggaaaagtagtcttctgcaaatgctcaatatgtgccctgtgaagagaaaaaaaaaagtttctaccatgatgaagcttatattctctactatgtagagacagatagtatataaataaaatacaaaatatataataagtaaattgctttttacatagtctggtctgggataatattgctaagaagagacaagatatagcgggcatcacagaaaaaaaattccagtcagagcaaataccaagtgcaaagaaccaggcagaagtatgcttcatgagataagaccacatttggcatgtctgaaaaacagaaagaaggtcactgagatggaaagtcattgcagagctttgagcagaagagtggctttgaaaaggatcatgttggggagatgattttctggaatagagatgtgagaaattctgtggaatctcttcccagtgaaacaatatctagtggaaattatttttttaagttatatatctctggaaattgtccaaagggcatacagcaaaataaacatctattcaagaaaatctattacatctcagtgttaacagtgaatctttgccatttaaaccacaattttctctcttctttcctcccttcctccctcaaccccagttcagtatgacagaagttcgaccctgaataagtacagccaagaacataggatccctctactactgggtcccagttgagggctatggtattttcacaagaaatgcataaatttatctcacatcccgatcctacctccatgtttcagagatattatgtcaggaaagaatagttgagaggtctggggctttcttcatccctccagctcccactgataggcagaagctctaatcaaggtgcaacggggagagaatactggagccctggtagcccttactccagatcacttgtaagatagcgattctgagacaggtgaggcaagttgagaagactagagactgctgtcacagctgagcactctatttgtgaatgtcactctgaaaaaagtgagccactgcctcctccttctgatctaggacagtggcacagtgattttgcctaaggataaatgtagcctatatgaacatagaacctgaagtgctctcctcatcctctcaaagtgaactgactttatgaaacagagtgtggagaatttcaaatctaaaggcactgttaaagacagtagagattatgatgttaagcaattaagaggaggatggtagctccatgagactaaaaaggtaaactgaagatcaggttgaagttttccagagaaaaacaggaaaagagctaagaagaatatcgggattagagcaaacagcaaaaactggcctcaaagattaccctggaaggggccccaacataaaatgaatcagacagtgggtcaatttatgttccagagcattgttaaagacaatagaacaatcaaccagcaattagtggaggttgacactgggtttgatactaaaaaagttcagacagcctaacagggaaatcagagaagacagtcaaagaaagcttataccactgtcctaccaagagcaacatagctggccaaatagctgactatagctggtgcacgctctgaggagcaatatcagaggcttgcacaatgcagggaaaatagacttcactaaaatagtccagccaaattattaaacaaataaacaaatcacaacaagaaactctgggtggggctacagtatcccggattgttacgatacattacctaaaatgtctaattttaaacaaaatgttattaggcaaagaaacacaaaaatgtaaattatatacaaaatagggcagacaacagaaaccaacatagaaagggcccagacaacaggcgaaacaaagacttcaaagcagatgttataaatatgttgaaagaaaatcaagcttaagtaagtaaatacacttaaaagaaatcaaatacatttaaaggcatgacaacaatgccttttcaaataaagactatcagtgaagacataaaaataatttaaaaaaaaccaaaaattttgcaactgagaagtacaataactgaaacaaaaaaattttactatggtggctcaacagattatgctgaaaaacagaaataaaatgaagacaagtgaacagacccacaaaaagttgagggatacaattaagtccaccagtacaaataatgggagtacaagaaaataatagagacagagagaaaaaggcagaaaataaatattataataatggctaaaaattctaaaacttgattttgaaaaattaatctacacatccaagaagtccaatgaatgtaaagaggtccacgtccagacacatcatagtaaaattattgaaatctaaagacagaaaatctcgaaaatgtcttcttgagctcacgaaaaatgatgagtcatgtccaaaggaaccccaataaaattaactatggctctcttatgagaaacaatggaagccagaaggcaatagtatgacattgtcaaagttctgagagaagaaaaagaagaaagaaattcaattaacaatcttaaatccagaaaatatgatctttcaaaactgaaggtgaaataacaatgtttccagatcaatacaagctaaaataatttacttctagcagcatgctttttacgagctaataaaggaagttctctttaggctgaagtcaagagacctccatgctttttaagattaaaaaaagcagaatgctggcaaaggtaattatgtaattattaatgggtataaatgcatattttttctcttaactaattgaaaaagtaattatataaacatatatatataaatcccctctctctttctctatctctctctctatatatatacacacaactatatatataattgtatcattttatgtgtatattgttatatatatacacatatatataattgtattgttggatctataacatatagaaacatatctgacaataagagcacaaggaggcaggtgagagcaagttggaatagtgaaactacctcaaatggtagctcaaatccacaaaaataaagagaactaaaaatgataaatagaaatataatataacaaactctatgaatatatccattcatcttttagtttctttaaaaagcttacagttttataatgtaacaattatagtcacaaactgtcggatttgtaacatgtatagatgtaatatgtctaatttaatagtacaaaaagtggggaaagggaataatgctatatagaagtaatgtctccaaatctcactagacttaagttagtataaatatgaagtagacaagataagttaaagtgtatattgtaaggcctaataaaagcaccaagatcatgcctgtaatcccagcactttgggaggccgaggtgggtagatcatgaggtcaggagatcgagagcatcctggctaacacagtgaaaccccatctctactaaaaatacaaaaaattagccaggcgtggtggcaggcacctgtagtcccagctactcaggaggctgaggcaggagaatggcatgaaccaggaggcggagctttcagtgagcagagacggagccactgaactctagcttgggcaacagagcgagactccgtcttaaaaaaaaaaaaaaaatgcaccaagaaaatcactaaaaacatacaattaaaaatcaataaagaaatgtaaatgttaagctataaaatattcactaacaataaaagctgtaaaagaagagaggaacaaaaaagatataagacatatctgtgaataatgttaagatttaagtttattttaaaataaattccccttttattcttaatattttatacaattatatgattaattttacatggctcctattttaaatataatctttaattttattttcattttctttctaaaatatactatcttgtcgaatgatttattttttataatgtctgaaagaaagtaaactcatagaattgaagcggtacaaatcatttccacaacctacagatattaaaacctaatttttatctcagaagaagtatttattcactctttcatgaattgctcaatcattcattcattcaaaaaacactgttctagactctaaggacctattgattaaaaatccaaagtctaatgatgtttagattaggaaaacttctcaatggaagattatttttctcttatgatgaattataaggacaaaacatttaaatttaacttttaaaaacatcaattatttaatctcaacatttctttaatatttccatctcatcttatttttactggagactccctaaatgacattctaacaggaagtggctttttaatgaactactggctggaggaattcaggaattatctggttgccttagcaattaaaactctcattacaaaatagaaaataactcaagagttcaaaataaaatggggtgtttgtaaaactttgctttgccttcaataagtaagtggcttcattaatccattaagatcctggctggacagtgtgagacagtccagatctcaagatcaaggtaacctagccagaagacaggggtcttggatctttcatgaaataactcagatttactctaattttccaagaataaaggctaaaaaacaggagaattttaaagttatgttatatattacagtttagcttcagggtcatgaatctatactgagaaaaatacccatagctttcttcagattcccaaaggaatctgaaccctcccaccaaaaagtcaaatgttggaacaggtgttaaaacaactaagaatgttctaaaagagaagaaaaacaagacttgatgacaaaaaccaaatattaaacgcttaaaatgcataatgtaaaatagaaaatcaatacaaagaactaaaacaatataaatgaggacattattcaattaaaataagtccaaaatatacattctttctttttaaaaatcaaaatatattgattttaaaaacctgaaaacaaaaaaccccactacagcttaaaacaataaaacagaagaattctccaatatagacgtttttccacagcagagtacccaatattagagaaatgtgttggtgtagagagaataccaaaagaataaaaaataaaaatccatacactgccctatacctggagctcttgcccttgcccactgaaattaaggtaatagagtttcactgtgttcttttgtaactttggaaatatgaggtcatgtattaaagaatactatcatggcttgaaatttgaaggctagaaaaccaatataagggtctattaacagttctctgaaatgacaacatacaggcaatcagatataaggctcacccccactgaacctgtcaaagggtgagataataacttcagcaatttcagaaaaaaaattgagatttctttctatggtattaaataaaaaacaattggattaattattattttacaattcaatacacaggtattattaactaaaaaatattagataatttttaagttttcctcaaagtttgttgctaattacctgggttcagtagaaaaatacaaggaagtgagcatcaaaattcaaaggaaatgttgatcacagtaatttttacataagaaagaagatacatatgtttagaatgctttaaaagtatctacaaaatgctatctgcaaagagctttaaatttacatattaatgaaaaaatttaagccattatgtattaagattttatgataataggtaatataccattaataaggtataaattgcagaagcatgaagagccaaacttataaagacccataattcaaacgattattaatttaaaagagtaaatctgccctgttatgtacttagtcttcagctctatttgtcctaaaaaggaaatgattagttataatgtagtgccaccttttagttcttttctactgtaaaacaaagaaaggtatattaaattatttaaaaagaatcatcacaataatcatcacaatcagtaaaggaaaagtcactatcattttcagaacatttgtatatcaaaatattttaaatagaagttatccagaactgatgataaaaggtgattttccaggtaactttggcaatggttgaaagtaaaaatatagatagatggaaaagatgtgtatattttatcacaattggaaatattaactttcaacatagcctttaagagctacctccaaccaccttcattcctgtggctcatttcattaaataaagacttgacttaatgacaagagtctcatgtaaaaagtatgaagaaaagataagcaaagtatgaagaaaagataaggccttattatttgtattaacagtagtacaattattagcagaaataatagaaaaacaaatattgtcttgataagattaataatataccagcttagtgaggtggctcatgcctgtaatcccagaactttcggaggccgaggtgggcaaatcacttgaggtcaggagttccaggccagcctggccaaggtggtgaaaccttgtctctagtaatactacacaaattagccaggcatggtgatgcacacctgtaatcccagctactcaggaggctgaggcaggagaatcacttaaactcaggaggcagaagttgcagtgagctgagatcgcaccaccgcactccagtctgggtgacagagcaagtttgtctcaaaacaatagtaataatacaccatataactagcaattactagtatcagtaatacaataataaaaatataattctatatatccattgacctggcaaatcaaattctagaaactgtttataaagacattataatggatatatagacatatgtaaatttacagggttttgtccctatctttttataatttagagaaaatagaaaccataataatgtccaccaagaagggagaatttacctaaataaaacataaccatttaaaagaatacatttagctattaaaaattgttatggaataatatctaatactatagaaaatggaaccaaccctattagaaaatagcaggcataacatacccttttttgtaaaataaaaatacactcacatgtatatgtacacatttttaaaattgtatacacacacacacacaattatcaatcattactacactctcgcttttacagaccattgcacaggcacctacccatacatttggttccacatttttcccttgttcaaacggacataaacttttgcccttgttttttgcaaaaaaagaagtttgttaaatgtattttttttgtaacttgcttttctaacttaatacatttctgaaatcactcaaattaaattttagaactaacccattactttttaacaactgcataatattttatactgtctttgtatccagttttcaacaaaggacacacataagtttttcaagagttttgccaccagaaataagacagtatctctcttgctctctttctctctcggtctcttcccagccttctccccaaccccactacctcccacacacacattttatttttgtagtataagtttcaagaacggttattgctggcgtaagagtgtattagtcaggattctctagaaaaatagaaccagtagaaaaaaaatatagagatatatatatagagagagagcaagagagatttattttaaggaattggctcacacaattgtggaagctggcaagtctgaaatctgtagggcaggcctgcagagaaaagttgatgttgcaatctcaattccaactctgcagtctcaaaattcaggcagggtttctatgtcgcagtgttgaggaagaaatgcttcttcaagaaatcttggtctttgtatttgagacctttaattgattagatgaggctcacccacattatggagggtaatatgcttcactcaaagtctacaaatttaaatgttaatcacatctaaaattctaccgttataacaacatctgggcaggtgtttgaccaagtaactgagcaccgtagcctagctatgttgacacataaaattaaacattacaaatagtataacactttaaaaattaattttagtaaaaattgtcattttattttttaaaatggtgatagcaattgtcaccagcaatataattccctttctcttaaatccttataagaactattatcccactttaaattttttttcaaattagggaaatatatctaattgctgatataatttgcatactcttgaatattaatgaggttaaagatcttttgatatgttggttggtagtttatatttcttcttctgtaagttgtctattcacatcctttgtccatttttttctgactcatttttctttgctcgactactttatatacaagctatttatatgtgaacattttctgatttgtatagacatattcttttgaaagtagttaaatacattttctccatatataggtcacttacagtctcccccacaacaacgttacaaaaatatacaacttaattgtcttctaatgtcctatatgtaatgttttaactcatctgaaatatatttttgtttatgggtgtacagtaagaaaacaaatattttgtttagaaagataaacaattttaccactatcaattattaaataaatcatcctttccccaccaaattaaaataatactcctatcctactttgagattcccttatatacacagctctttttaggggcccttgttattctgttcatctgatttctctatccctgtgccaataaaatcatatatcgataaagtggcctaaaagtaatttttaatatttggaaaggcatatttcttcagatgtttcttggatattacaaagcatttaattttccttctctggaactttaaaagcatatttcccagtatctctacaaaaacaagattgtaattgaaatcacttatgtttaaacataaacttagaaaggatggttatttgtattatactgaattctcacacagaaatatggtatttatttatatatgttcaggttttattatttgataaaaattattattttcttcacataggatatttattttttgtatgttgttttttttttttgacatggagtcctgctgtgtcgccaagctggagtacagtggcgtgatctcggctcactgcaacctccgcctcctgggttcaagtgattctcctgcctcagcctcctgagtagctggaattacaggtgcatgcaaccatgcctagctcgtttttgtatttttagtagagacaggatttcactatgttggccaggatggtcttgatctcttgaccttgtgatccgcccacctcggccttccaaagtgctgagattacaggtgtgagccacagtgctggcctctatgttgtttcttaaatattttccggttttattaacaaggggaaatataaaattttccatttatatgcaattggaattttgttagtatgaagaaaaacatcaatttttatatatgcatattttgtatccagccaccagccaaattttttaaatctactaatctctttgatttaccattcatattaatacattatataataatctaatttctttcttattttctaaacatgtggccagatttatcttatgtatggccttaacttgaaactccaaaacaatgttaaaaactttaaattttaaaataaatgataatatttaataaatagctcagtcttttaaaattatttttattagaaagagtgttaattttattaagttacttttcgggcactcaataacatgattacattttctccattaattaattgtattaataagtttcccacttattatccctcgattcgtggactaaactttacttggtcaaatttattaaacctctcatatattgcagaacattatgattgattaacatttaacatttgtgtctacctgtgttcctgatgctgggcagtaacatttttattaccctgtcatgtattagaattaaaattgtaccaaccttataaaatgaataggtatttaaaaaacttttcctatgtgcaggaataatttaaacaatattatagtcttgttcattaaagattatgtggaactcagaaataaaactacttgagaatagtgtctttgtcaatgttcattcattattttattgtttgcttattggtctacagagatattatactcaccttgagtccattttgatggtttgtatttgctagatatcattcttattttggcagataagtgccatccaacttttccatgtcatggcaaacaaagaaaatgatattatttgtttattactgaaaacaaaccaagtaacttgtggctggaagggacctgccaaaaaggtgcagaggattacggctgccctaggcttgcgctgactgctgaaccataaccccttatgggcaagactatgtggcacagtaagctagtgagaagtttttctctagactttaatatttcatagttttgtaggctagtcatctatataattttaatcttattagtaattttggttacagatcttctcattacttttctgtttttttaattatactttaagttttagggtgcatgtgcacaacgtgcaggttagttacatatgtatacatgtgccatgttggtgtgctgcacccagtaacttgtcatttaacattacatatatctccaaatgctatccctcccccctccccccaccccacaacaggccccagtgtgtgatgttccccttcctgtgtccatgtgttctcagtgttcaattcccacctatgagtgagaacatgcagtttttggttttttgtccttgcgacagtttgctgagaatgatggtttccagcttcatccatgtccctacaaaggacatgaactcatcattttttatggctgcatagtattccatggtgtatatgtgtcacggtttcttaatccagtctatcattgttggacatttgacttggttccaagtctttgctattgtgaatagtgccgcaataaacatacatgtgcatgtgtctttatagcagcatgatttataatcctttgggtatatacccagtaatgggatggctgcgtcaaatggtatttctagttctagatccctgaggaatcgccacactgacttccacaatggttgaactagtgtacagtcccatcaacagtgtaaaagtgttcctatttctccacatcctctcaggcacctgttgtttcctgactttttaatgatcgctattctaattggtgtgagatgttatctcatagttttgattcacatttctctgatggccagtgatgatgagcattttttcatgtgtcttttggctgcataaatgtcttcttttgagaagtgtctgttcatatccttcgcccactttttgatggggttgtttttttcttataaatttgttggagttccatggtactggtaccaaaacagagatatagaccaatggaacagaacagagccctcagaaataatgccgcatatctacaatcatctaatctttgacaactctgacaaaaacaagaaatggggaaaggtttccctatttaataaatggtgctgggaaaactggctagccatacgtagaaagctgaaactggatgccttccttacaccttatacaaaaattaattcaagatggattaaagacttaaatgttagacataaaaccataaaagccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacatgcaacctacagaatgggagaaaaattttgcaatctactcatctgacaaagagctaatatccagaatctacaatgaacttctcgttacttttctaaaatatttttttctggcctgggcctatttcattagtcttttgagagaataaacatttagcccccactcatttgtgggagctaaaaattaaaagcattatttcctaactctagtttttttgttcaacttctgtgttaattttccattccaacttttatttacttatttttaaatttttaatttttgtaggtacataggaggtgtatatagttatggggtacatgagatattttgatacaggcctataatgcataacaatgtcatcaggattaatggggtatccatcacctcaagcatttatcctttctttgttttacaaacaatccacacatattctttcagttattttataatgtacaattaattattcttaactatagtcactctggtgtgctattaaatactagatcttattcattacatctaactgtatttttatgcccattaactgtccccattccacccaccctactacccttcccagcttctggtaaccatcattctatctctacttccatgaattcaactgttttaattttcagctcctataaatgagtgagaataagcaaagtttgtctttctgtgtctgccttatttcacttaacataatgacttccaattccagccatgttgttgcaaatgacaggatctcattctttttctgtggctgaatagtatttcattgtgtatatgtaccacattttctttattcattcattcatttgttgatggacacttaggttactttcaaatcttggctatggtgaatattgccacaataaacataggagcacagatatatcttcaacagactgattgcctttactttgggtatgtccttagcagtgggaatgctggatcatatggtagtttttgtagatatttgaggaacatccaagctgttgtccatagtggttgtcctaatctacattcctaccaacaatgccaatgtcaaattatactacagagatatagtaaccaaaacaacatagtactgtcataaaaacagacatctacagatgtctctatatctgtgccagcatttgtttttgcctgtctctgataatagccattttaaatagggtgagatggtatctcaatgtagctttgatttatgtttttctgatgataaattatattgagcacattttcatatatatgttttccatgtatatgtcttcttttgagaagtgttcattcagaacttttgcccattttctaatcaaattattagattttttcctatagagttgtttgagctccttatatattgtagctattaattcattgtcacatggatattttgcaaatatattatcaatttctgcaggttgtctcttcattttattgtttcctttgctgtgcagaagctctttaactttatgtgatcccatttgtctaattttgtttggttgcctgtgcttgtggagtattactcaaagcttgttgcacagtccaatgtcctggagaatttccccaacgttttcttatagtagtttcatagtttgaggtattagcgttaagctgcaaatccattttgatgtgatttttctatatggtcagagatggtggtccaatatcattgctctgactgcagatacccaattttcccaacaccacttactgaagagactgtctttctccaatgcatgttcttggcacctttatcaaaaatcagttcactgtagatatatagatttggttctgagttctctattctattccattgttctatatgtctgtttttagaacagtcctatgttgttttggttactatatctctgtagtataatttgaagtcaggtaatatgattcctcctgttttgttcttcttggtcaagctgactttggctattctgggtcatttgtggttccataaaaattttaggattgttttctctatttctgtgaagaatgtcattgatattttggtagggattgcattgaatctatagattgctttgagtagtatggacattttaaaaatattaattattctaatccaggaacatatgtatttccattttttttgtatcctcttcaatttctttcatcaatgttttaagttttcattgtagagattgctcacttctttggttaagttaattcctaggtatctaattttatttctagctattgttaatgggattaatttcttgatttatttttcagattgttcactgttggcatacagaaatgctactggtttttctatgttgattttgtatcctgcaactatactgaatttattcatctgttctcaatttttttggtgggatttttgggtgttttcaaatataagattataccatctgcaaacaaagataatttgacttattcctttccaatttgaatgccctttatttctttcttttgcctgattgctctagctaggacttcaagtactatgttgaataacagtgatgaaagtggacatccttgttgtgttccagatcttagagaaaagccagttttttcctattcagtctgaatctagctgtaggtctttagtacacagcttttattttgttgaggtatgttcattctatatctagtttatttaggtttttatcataaagggatattggattgtgtcaaatgctttttcagtatcaattaaaataattatataatttttgtccttcaattctgttaatataatgcaccacattgattgatttatgtacgttgaaccatccttgcattcctgggataaattccacttggtggtgatgaatgctctttttaatgtgttgttgattttggtttgctgttattttgttgaggatttttgcatcaatgtttatcagggattctggaatgtagttttctgtttttgacctgtctttttctgattcttttatcaggataatactggccttgtagaatgagattggaagtattccttactcctctatttttgggaacagtttgaataggattggtgttagttcttctttaattgtttagtaaaactcatcagtgaagccatcaggtcctgatgttttctttgctaggagacttcctattacagcttcgatcttattacttgtttttgctctgtttaggttttggatcgtttcacggttcaatcttagtaagttgtatgtgtataaggatttattcattttttctaggttttccaatttatttgcatatagtttctcatcgtatcaactaataatctttcggatttctgtggtattgcttgtgatgtctctactatcatctctgattttgctgatttgggtcttctctctttttttcttggataatctggctaagggtttgttgattatatttatcttttaaccaccaatttttcatttcattggtcttttgtattattcacctcatttcaatttcatttatttctgctctgatctttattacgatcttgtcttctactaattttgggttccatttgcttttgcttttctagttctttaagatgcattgttaggttgtttaaagattttttaatatatctgatattggtgcttatagctataaatttacctcttagtagtgctctcactgtattttataatatttggtaggttctgcttccattatcattcgtttaaagaaatttttaaatttccttcataatctgctcattgacccactggtcattcaggagcatattgtttaatttccatgtgtttgtatagtttccaaaattcctctggttgatttctagttttattccattgtcatcagaggagacacttgatataatttcaattattaaaaaaattttaagacttgttttgttgtctaatatatggtctatccctgagaatgatctatgtgctgagaagaagcatgtgtattcagcagccactggatgaaatgctctgtaaatatctattaggtctatttggtctataatgtagtctaagtccagtgtttctttgttgattgtttttgtctgagtgatctctccaatactgaaagtggggtgctgaggtctccagctattttggttttgtggtctagctccctctttttctctaataatatttgctttatatatttgggtgctccagtgttgggtgcatatatatttaaaattgttatatccccttgctgaattgacctctgtaccattatataataaccttctttgcctccgtttatagtttttgtattgaaatgtatcatgtctggtataagtattcctgatcctttttagtttgcattggcatggaatatctttttccattccttattttcagtccatgtgtgtctttataggtgaagtgtatttcttactggtaaccaatcattgagtcttgttttttcatccattcagccactctatgcttttgattggagaggttagtctatttacattcaatgttattgttgataggtaagattttactcttgccattttgttatttgttttctagttgatttgtgatcttctcttctttctttcctgtcttccttttagtggtatgttttaatttcttggtttttgtgtgtgtatctgctgtattttttttatttgaagataccatgacccttgcaaatgatattctataactcattattttaaactgatgacttaataatgattgtataaacaaaaaaagagaattgtaataaaaattcgacactggacttcatccttctgctttttaactttttgttgcttctatttacatcttagtatgctgtctatgtcttgaaaagttgttgtagttattatttttgaatagttatcttctaggttgtttttactcaagatatgactagtttagacaccacaattacagtgttaaaatattctgtgtttttctgtgtacttactattaccactgagttttgtattatcagatgatttcttattgctcattaacttccttttctttctggttgaagtactccttttagcagttctggtaggcaagtctggtattgatgaaatccctcagtttttgtttgtatggaaaattatatcttcttcctatatgaaggatatttttactggacatactattctaggatacagctttttttccttcagcactttaaatatatcctgccattctctcctggcctaaaagttttccactgcaaagtctgttgccagatatattggagctccatgtatgtgaattgtttcttttctcttgctgctttcaggaatttttctttatctttgacttttaggtgtttgattattaaataccttgaggttggcttctttgggttaaatctctttggtgtacaatagctttcttgtacttagatattgacatctttctctaggtttgggaagttctctgtttttatctcatttttttgtctcctctgtatgttttgtgatggcatgtcttaaagctcactaattcttacttctacttcattaattcttctggtaagagaccgatttactcttcagtatctcaattgcatttttcaactccagagtttttgcttcattctttttaattattcaatatgtttgctaaattgatctcataggattctggactccatctctatgttatcttgaatatctttgagttccctcaagaaggctattttaaatcatctgtctgaaagttcacatatgtctctctcaacaggattagtccctggttcattatttaggttgtttggtgaggtcatgttttcctggatagtcttgatgcttgtgaatgtttatcagtgtctggccactgaagaattgggtatttattggactctttgcagtctgaggttgtttgtatgtgtgcttcttgggaaggtttttcagatatttaaaggaatttgggtgttgtgatctaagtttttgatctctgtagtcatatatacattagggggcaacccaagcccagtaatgctgtggctcttaaagattcatacaggtacttccacgaaattcttcttggatagttctggaagaattatctggattgcaaagcaaaaacgcttgttctcttcctactttcccctggataaacagtctctctctgtgatgagctacatatagttgaggaagggtggcataagcatccctgtggccaccaccactggaactgtgctaggtcagatctaaagccagcacagaactggatctcaaccaagtctttcagtaaccactgccttgctattttctatgttcactcgagcctgcagagctttaaaatcagcagttggtgaagccagccaggcttgttttcttttcttcagtgtggcaagttccccttggtcccaggtaggtcaagagatgccatccaagagccagcaccttgagtcagttactttaggaatctacctgtcacccaagccacaaaacaaagtccttccctacttccctcctctacccacaagcagagaagtctctccctgtaactatcaccaccccagttatgtggtgagtgagtattacctggttacctctgatgtttattcaaggacccagggctctttagttagcttgtggtaaatgctgccaggcctaggactctcccttcagtgaagtgagctcccctctggaccagagagggtacagcaatgccatctcagagccaagaccaaagcctggaatctgagacccttggtgctctactctgtttgggccaagctggtacctaatctgcaagatgaagtcaccttttctctccctccatttttcctcgagaagaaggagtccctagctatagccaccacagctggaaatgtgcagggtcacatctgaagccagtatgtctctcagtctcaaccaaggcccaccatgagtactgcctgggtaccactgctgattattcagtacctaagggatctttagctaggagataatgaatccttccaggactgggtctttctcttcaagacagtggattctcttctggcccagggtatgtctagaaatgttgtccaagagctaggtcctggaataggggcctcaggactctgcctcatgcccacttctactgtgggtgaacatgtatcaaagttgcccccccaccaaaaaaaagtcctccttacttatctctctcttctcttcaaacagaaggcagaagtctctcttggagttgcaagctatgttgtctagtgttgggtgaggggtgatgcaaaccctcccttggctgcttctctggcatctcatttggttatgctcccctgtcaactccactgactctgagccagcccagcaccaggacttgcccacagattgcagactttgtggtctagactgcctttcaagttaatgtaggcctccccagagcactttagccccgggtaaggtggtgaggcttgttagaacttaggctctgaccactgggatgagcaacttccctatggctatggctgatctcaatgcacattccatgagcactggctgagttccaccaagtgccactttccactgtgacagggcagcactaaatttcaatgcaaagttccacaattactgtgttctcactctctcccaagtgcagattctctttccacgccatgtggccactgccagagtgtgggggaagggtgatgttggcaattaaggactggctttcctaccctcttgagtggctccttcattgatatgaagataaaaccaaatatagtgatcactcacttgatttttggttcttataaatgtgattttttttgtgccgatagttcttcaatttggtgcttctgcaaggaggatgatcagtagaggtttctattcttctacggtgcgttacctctttcaatcagtatttctacttttaagaggtattgttgtttgtttttaaataaaaatctctaaaggcccacaagagaaagcaggaaagatctaaaattgacaccctaacatcacaattaaaagaactagagaagcaagagcaaacacattcaaaagatagcagaaggcaagaaataactaagatcagagcagaactgaaggagataaagacacaaaaaacccttcaaagaatcaatgaatcctggagctggttttttgaaaagatcaacaaaattgatagaccaccagcaagactaatacagaagaaaagaaagaagaatcaaatagacacaataaaatatgataatggagatattaccaccacagaaatacaaactaccatcaaagaatactataaacatctctactcaaataaactagatatctagaagaaatggataaattcctggacacatacaccctcccaagactaaaccaggaggaagctgaatccctgaatagaccaataacaggctctgaaattgaggtaataattaatagcctacagaccaaaaaaagtccaggaccagacagattcacagccgaattctactagacgtacaaggaggagctggtaccattccttctgaaaatattccaatcaatagaaaaagagggaatcctccctaactcatcctatgaggccagcatcatcctgataccaaagcctggcagagacacaacaaaaaaagagaattttagaccaatatccctgatgaacatcaatgcaaaattcctcgataaaatactggcaaaccgaatccagcagcacatcaaaaagcttatccaccatgatcaagtgggcttcaaccctgggattcaaggctggttcaacatatgcaaatcaataaatgtaatccagcatataaacagaaccaaagacaaaaaccacatgattatctcaacagatgcagaaaaggcctttgacaaaattcaacaacccttcatgctaagaactctcaataaattaggtattgatgagatgtatctcaaaataataaagagctatttatgacaaacccacagccaatatcatactgaatgggcaaaaactggaagcattccctttgaaaactggcacaagacagggatgccctctctcaccactcctatttaacatagtgttggaagttctggccaaagcaatcgggcaggagaaagaaataaagggtattcaattaggaaaagaggaagtcaaattgttcctgtttgcagatgaaatgactgtatatttagaaaaccccattgtctcagcacaaaatctccttaagctgataagcaacttcagcaaagtctcaggatacaaaatcaatgtgcaaatatcacaaacgttcttatgcaccaataacagacagagagccaaatcatgagtgaactcccattcacaactgcatcaaagagaataaaatacctaggaatccaacttacaagggatgtgaaggacctcttcaaggagaactacaaacgactgatcaatgaaataaaagaggacacaaacaaatggaagaacattccattctcacggataggatgaatcaatattgtgaaaatggccatattgcccaaggtaatttatagattcaatgccatccccatcaaactaccaatgactttcttggaaaaaactactttaaagttcatatggaaccaaaaatgagcccgcattgccaagtcaatgctaagccaaaagaacaaagctggaggcgtcgtgctacctgacttcaaactacactataaggctacagtaaccaaaagagcatggtactggtaccaaaacagagatatagaccaatggaacagaacagagccctcagaaataataccacacatctacaaccatctgatctttgacaaacctgacaaaaacaagaaatggggaaagattccctatttaataaatggtgctggggaaactggctagccatatgtagaaagctgaaactggatgccttccttataccttatacaaaaattaattcaagatggattaaagacttaaatgttagacctaaaaccataaaaaccctagaagaaaacctaggcaataccattcaggacatagacatgggcaaggacttcatgtctaaaacatcaaaagcaatggcaacaaaagccaaaattgacaaatgggatctaattaaactaaagaacttctgcacagcaaaagaaactaccatcagaatgaacaggcaacctacagaatgggagaaaaattttgcaatctactcatctgacaatgggctaatatccagaatctacaaagaacttaaacaaatttacaagaaaaaaacaaacaatcccatcaaaaagtgggcaaatatgaacagacacttctcaaaagaagacatttatgcagccaacggacacatgaaaaaatgctcatcatcactggccatcagagaaatgcaaatcaaaaacacaatgagataccacctcacaccagttagaatggcaatcattaaaaagtcaggaaacaacaggtgctggagaggatgtggagaaataggaacacttttatactgttggtggaactgtaaacaagttcaaccattgtggaagacggtgtagcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtaggcacctggatgaagctggaaaccatcattctcagcaaactattgcaaggacgaaaaaccaaacaccgcatgttctcactcataggtgggaattgaacaatgagaacacttggacacaaaaagggaacatcacgtactggggcctgtcgtggggtggggggaagggggagggatagcattgggagatatatctaatgtaaatgacgagttaatgggtgcagcacaccagcatggcacatgtatacatatgtaacaaacctgcacattgtgcacatgtaccctagaacttaaagtataataataaaaaaaagacaaagcacataatcctaccaaaaaaaatctctacacttccttataagtatttcagctgtattttgtcttatatgaaatgacactcaatgctttttttaactttatatttgaatttttatttgattcaagtattatttatgagagtattttttgattcccaggaaattttgacatttttattactcatttctaacattattggagtaagagtatctgatcttcaaaaattatttcttaaaatatagaggtcttctgtaatggctgagtgagggacttggcaactcctctttccaaagagtaattgtaaaactgaacaaaatttcccaaaattaccattttaagactagaaattcactaaaggcatataaccaaatgaaaagtctttattgatgaaatgataataaatataaataagaacagtggggagtttgtagcattttagcctggtgctgctcctgctaccaatagccccccataacccctaccacttctacctacatggtgcaaaggtactactatggcatagcagactgagagcagattgaagtgacatcagacagtaacttcaattcacaggaagaaaacatgagtaatagaaattataaatacatacgttaatttcaaagagtctataagtatatattccctcctcttaatatctttaaaagcaataactataacactcttttcttgggtttaaattaccatatatagatgtaatatagagcaacagtagggcaaaggaaggtagagggatttaagttttactggagcaaagttctatattttactgaaataaaggtactattaatttgaagtaaaatgtgataagatacatactgtagtacatagagcaaccactgagaaaataacaaaaaacacagtaaaaagcaagaaagaaatcaaatggtacagtagaaaatacctgtttaatataaaagaatgtggtaaaggagaaatacagggaaatacatgtgatatataaaaacccaaaggaaaaatggtggatgtaagtccagctatataaataataattttaaatgagaatggattaaatattccaattaaaagacaaatgttttcagattaacttaaaaatagcaaaacgtaagtttctaactacaatctgtctacaaaagaaactttaaaattcagagatgcgaatcagccaaaagtaaaataatgcaaaaataccacaataagagtgactataagaagctggagtgggtattctaatattagacaaaatagactttaagataaaatatgttactgaaacaaagacaaaaattttacagtgttggaaatgtcacttcatcaggtacacacaacaattctaagtatgtatgtacccaacaaaaatgagactaaaatatatgatgtaaaaagtggcacaattgagggaagaattacacaattcaccagtaagagttgtggactttaatgccacactctaaataatagacagaatgacaacacaataaatcaacaaacatatagcaaattataggaactctatcaactaactttacttaactgatgtttatggaacaattcacccaatagaatgaaatttcttctcaatcacatgaaacattctccaggatatatctcataacaaggctataaataagtctcaataaatttaaaataattgaaatcaacaaagtatgttcagtaatcatggtaaaattaaataagaaatcaacaacagaagaaaattttggaaattcaaatatatctggaaataaatttattatttctccataaccatggggacaggaataaatcaccaaagcaattataaattatttgagttgaatgaaaacacaacatataaaacattatgagatgtagctaaagcagtgcttagatgaaaacatagctgtaaatgcctatatcagaaaataagaaatgtctcaaatcaaaatccaaacttcctcttgaaaagtgtgaggtggagtgtggaaggagggagggtaaaggaatctcatagcaagcaagattgaaggaataaatatgagagaggaaatcagtgaaataaaaaactagaaaaatagtagagaaaattaataaaatcattgattctttgaaaatatcaacaaaatggcaaacctctaggtaagctaagtaaaacaaaagaaggcatatattacgaaaataaaaaagagaccacattactaatgaccttacagaaattaaaaatatcaaaagaaaatatgagaaatagtattatgccaacaaattggaaaatgtagatgaaatggatgaattccttaaaagacactaattaccaaaactaacttaagaagaaatagaaaacctagatagatctgtaacaagtaaagaaattgaattcacaatttaaaatgttcccatagataaaatccaaggcacagatggcttcactggtgaattttactaaacatttaagatagaaataataccaatcttttacatactcctccagaaatagagaaagaaacacatcccaattaattctgtaagaccacagtgttccgccatcattccagatggtggctacacagaaagtttcttagcacagcagtgagcatcattccaaggtacctctctggaaccctactaagcagcttaacggcaatttcaagaataaagtattgttcaagaatccataaagaagaaatagatctaattatatatatattagaaatagcaaaaaatcatcagggactttgattttgttgttggaattattccctaatgtgagcattaatgagttttatctaccttcttatccaccattcaaaatttttctattactttggttattccagtcaatttctcagaggcaaattgggaagactgttcttagtaattattttgctaactgtaaatgcaaaatttccttagcattcttcattccttccactctcttcactatcattcagtagaaattattaaggctaaagggaaaaccactttgattcattttatactgcaactcaaaccataaacagtttaagtagaaaacttttagagtcttatttgctgaacctcataacggttctttatttatatcttcaagcactgaattaagtttattattttactgctgtttgttaaaaacatgttaagtattttacaagtataatatttttgtctatttcttgcattcatgattgcttttgttttcaactttcggttcctaaggggcaggagacatgcctttacaatgatctaaataaaaatcatatatacctaacagacaatatatctagtataattacagggggaaaagcatctcctctttaaatttttttaaattcactcctattttatttgcaacactttttaaaattaaacaatcaacctaaattgctactgcagattttacataaccaacatctttctatatactataaaaatagatatgaacagacacttctcaaaagaagacatttatgcggccaaaatacatatgaaaaaaagctcatcatcactggtcattagagaaatgcaaatcaaaaccacaatgagataccatctcatgccagttagaatggcaatctttaaaaagtcaggaagcaacagatgctggtgaggctgtggagaaataggaacacttttacaccattggtgggagtgtaaattagttcaaccattgtggaagacagtgtggtgattcctcaagggttgagaaccggaaataccatttgacccagcaatcccattatggagtataaacccaaaggattagaaatcattctactataaagacaaatgcacaggtatgtttattgcagcactgttcacaatagcaaagacttggaaccaacccaaatgtccatcaatgatagactggataaagaaaatgtggcacatatacaacatggaatactattcagccataaaaaaggatgagttcatgtcctttgcaggcacatggatgaagctggaaactatcattctcaggaaactaacacaagagcagaagacaaaacactgcatgttctcactcatatgttggagttgaacaatgagaacacaggacacagggaggggaacatcacacaccggggcctgtcagggggtgggagggtagggaagggatagcattaggagaaatacctaatgtagatgatgggttggtgggtgcagcaaaccaccatggcacgtgtatacctgtataacaaacctgcatgttctgcacatgtatcccagaacttaaagtataattttaaaaaaaaaggaagaagaaaagaaataaatatcctggctcttttgcttcctttaaaaaaacaaacaaacaaaaaaaaaaaacaaaaaaacaaggccctgacttcatttcatggtaatgtgacctggatgtatgattacaagtatggggtagaggtcagtacagataagcataaagacctttagcatttttcattttaaagacgatcatgtttatagccaaatcacagctcataattatcccaggtcacaaaaagtctattttcagctattccttctgagtaaactggggccaaaatgcccagactgtctccaaatatccttcaatccattaccagacttacatacttactttttggtgtcccatgggcagggtctgacccagagttcagctaggcatgtcaagttgaatgtctgttgtctcaatatgagaaacaaaaggagaaaaactgcaagtggaactcttcaggagagtgaaatggcctttgtttaaacaaaaatcctctcttatggctgctttcaagaaagcagccagcgaagactgtattttgaaacaagtggattgagaaactacatttttggactcagaacatgttgcaagttatacttgtaatgggagtatttttcattttaaagatgatcatgtttatactcaaatcacatttcataactcccaggactacatgggctccaggatgtaactgggttacatatgaaattcaattatctgtgatatatctgttcctctccaagcaccttcccttcctctccaatacagcccccagtccacttatcatagaaaataggagagtggctgggcgtggtggctcatgcctgtaatatgtcactttgggaggccaacacttgaggccaggagtttgagaccagaccgaacaacataacaagaccctgtctctacaaaaaataaagaaataaaacacaaacacaaaaaatgtatttatgtgtatatatatatatatacacatatatgtatgtgtgtgtgtatatatatatacatatatgtatgtgtgtgtgtatatatatatatacatgtgtgtgtgtatatatatacacacatacataaatgtaaaatgttaggctgtaaatgatgaaaatatgatggctttggggaaataaaatgtataatttgacttcaaacttttcagtggaaagaaggaagggagaaaggaaggaaggaaggaaggagggagggagggagggaaggaaaaagcgagaagctaggaagggaagtagtgaggactggccgctatccatgcaattgcatacaccaaaatttttagtgtcatccatcatatgcttctttttctcaccataacaaccactacccatttgctcaccaaattctctaatcctctgtattgtacccataaatacctttatctgatccctacatctatattttattccaggcacttatgactcacctaaactattttagtaacctaggattgatggctttagtcttccctcattaaaacttttattccacataactgtagagtaacatcccatggcatctcttctgtgcttaaacacttgtaatggcttgccactacttataacaaaggataacatttcttgatataaatactgactatataaaaataaaaatattaatgtcttattataacccatagataaaattatagtatatgacaaaatagcatgaaagttgaaaaggagatataatgaaaatagagttctaaaatttttatatggtcaagaagaagagtaaaggtactaattaaatgaagatatattaaagtaaataagcatattttatttgctaggattactgattcttcaaaattggaaatatagagtgtatcttccaaaacagtagagggggaaaacatacaacaataaaaactaaattccaaagaaggcaggaaatatgagggagaaaatttacagaacaggagagaaaagcaaaaagcaaaaataacacaatgtatttaataccccaaacatcaggaataacatttaatgtaaatagtccaaatatgatagttaatataaaaattgtcagactgggtttaaaaaatcaaactctgttatttatgagctagatagacagataaagataaatatacagaaatattataaccaaatggatagaaaataaatatgcaaaaactaaatacaaaacaagccagtgtaaatacatctgataaagtaaactttaagccataaagattactagatgaattgagagtcatttcataaagataaaaggttcaattgactgattgacataatgatttttaatttttatgcaactaataacatagttcaaaatatgcaaaacaaaatttgacctaactataatgaaataataataatacatctacaatcacagtgagagatgtaagttcacttctcccagtgactgagaaaactagtaatcccaaaattaataaggaatagaatagttgaacaccacctaaccagtgacctaatagaaacacaaaaaatatcttagccaataactatagaggacactttttttaagcacacgtgaaaagcgtgggccatatgcaaatctcaatgaaattcaaagtcaaaggactgaaatcatataggacaggatttcctactgcaaggaaattaagcttgtttcccctgccctaagatatattcacaccaaataagttattatcatatcaatgtgaaatgtccttccctacctcaataactttacacatcctacagtttgactagaattaaaccctttacaactaatcccactcttctggcaccacatcccttccaatataaaaacatacatacattccatacttgatgaaatttttaaatttttgaaaaaattcatgtaatataaggtctatgaagtctttcttgacaacctcacccaatcagaattaattgtatacccacaaagttggctgaatatttgtctactgtaatatttatcatagtagataaaatactgtgtttgtttgtctgtataattgaactattatcttcttatgattaggaatcataatttgcgtctttttacattctcaacacctaaaacacctaaagcacttaagacacagcaggcaactaatatgctaacatcatggaactaggttttctttggctgccaagatattcttgttgtctattctgatttatatctccaatagtaaattttaaaaaatatacttcagtttcttaatagtacatgatagattatcaattcaaaatacaaataagctgatgattctaaaaataagcatggatagatggcaatgttgcatctataaaacacggtttgagctaatattttacacaaaagtataactatggctttttcaagaaaaaaaaatcagtttgcctgtattgccacaaaaacagtagctagaaaatatggacagatatattgtttgaattgtttctaaaaattttaaaatttctaaatgttttgaacacaccaatgtagacattagcttattcaataattatttattaagatctggtatttttaagatgcagataatttaactcaatactttttatttctaaatatgtattagatacgtattttgtttgataaaaaatgttctgatttttacaacaattttatgtcacttttatccaaaattatgagttatataaaactaagaaaaaaacacaaacaatattattttggtaaaatattgggctcattttgttgcttcatgaaaaattttcctagtccacttttgttttccactattaaaagataactggagtatcaactgaaaagcagtttcataatttaatcctggagagattaaactgagttaccacttcttcccctaaagaattctcattatttttaaaggtgctgaataatattattctgaataatattccatttatacacacacacacacacacacacacatattacacaaacatatataacaatttatctgtttattccttgatggacatttgcattgattctgtatcttggctattgtgaataatgttgcaatgaacgtgagagtgcaggtatctttacaagttggtgatttcatttcctttgaattcgaaagactggggttgaattgttgcatcatatggtagtactattttaagttactttaggaacctccatatttttcccacagtagctgtaccagtctctattcacactcatagtatcgccagtacttccactttactaaaaatactgcttctcaaattattaattatcccatcaaatgagataatgaaatccacatactactcaggaattgttaaagcttcaattttagcatattctcctcctaatagtgtttacctactttcccaaagcagagttaatcacaccacacccagtccacttcaaccaaggaaatactacattgtaatgtgactttctgactttgcaaattaggtggccaaaccattcttcgagtaggtagccaaagcctatgtaaaggtaacagatataaggctgactgttaaagtagcttaaatttcagtgtcatatattatatacaatttcacatgaattttgtatttttaaagggtacttattcctggaatggccacaaatgcttgcttaaaagagtcaggggtatattcatctgaacccataaagaagcagacagaggcgatcatgctgttacatcttgaatcattagggcatgcgtcaaggccatgccacttatttttgcagctcctgaaacttgctgatggatgtactattcttgccttaagtgcaggaagacccacagattattggaatgagcccacccatctttttatgactccagtcttccagtaagtctaatgaggacaagaagatagcaataaagctgtcttgtatgtgtatctatgtagaagcccattcattttgaaagaaagcaaacacacaaaatattctgctcctagtaccacttctgaaaaatggaaaactgctttctaataagactaatataaacatctattttttattctgagtttcaaatgagtcaaaatattttgcaaagtattagtgcaattaaaattatttgaagtgaacttcaaataaaataaagaaacaattcagtccaattctgacaacttcagcagagtcattattcaactgggtaagatgaacgggagacactattttatggataatatttaattatgaaaattgtttacccagtcataaaatgttattgattctttaatagtattttaataaagatagtttttggttgacaaatagtagaagaaagcacatctgtgttccaagatagcattgaaagaagtaaggtaaattttgaagatgcaaaatttaaatagtattgccttgaatctgtactttgtcgtaacagatggtcaacaatccctaccatatgcaaagctagacaatattttaaatcattgtatatatccaggaaattcactgtatgaaacatttttcacgcaaatgttggcatacatttattatttaaaatataattttctttaagaaacttgtgctactggtatcttcaatatacctaacttttaaggtaggaattaacctaatcttcattatacataagtaatataatcattgttgaacacactcagcattcagaattacataatttactataacaaattataataatcttttatatattatatattacaactttttatctcataattccaaaatgaagtctcaaaacccaggtagctaaggtaactactcttggcatattagatgtattactaaaaagttgcatataatgctttcacattaacaaattatattaagtacattataaatgttttatacttaaatctttaaggtgagtaattttaaatgagactaatcatttcctgattcatataagttgtgataatgctattttgagtattataataatttatattcctttaagaactagtgaagcattaacgatgtacatttaaaatgcataaatagatgttggtgtttaaagttttgacctcagaatcaactatgatccatttattctttacctatttgggcacctttcagttagtagctcttgttttttctcttttctccttaacaaagtgcccttaaatttgaaagacaaattagctaacttcctagtcctgacctttggtctaatttcctagattataatcagtgtcccttcatttgacaaggagtcttatttgcaaccatatttggcataatcccaggatatccacatatcaaatactccccaagtaatcaacaatgcagatttctaagttagttatcatatagaaacctaatctagaacaaatttctgtagtccagtttaacatgaaacatttctttattttcaatagattttatatttcaaggaaactagattaatatttttctatcaacttaaaaattagaaaaaaaatgttttttttttctcgctttcttggacacatcttcaagcaatccttaaattcagaggactgtaacagtctgtaaaaaaaaaaaaaaaaaaagcagcaaaaaaaaccatttaccaaattatctccattgtatcttctgtagcagtcagggttaacaaactttttctatataaagctaattagtaaatatgtaggcgctggagtgtacatatgttctattgcatatttttcttttttttctaacaatccttttaagttataaaaaccattattccttctgcacaggctatatcagatttttcctgcggactatagtttcccaaccttatatctatattttatcctaattcatacatgtatgtgtacacacacacacacacacacatttttctcccatatggccttagaaatttttgaggaaaaatgaaaaataaatgcacatacacacatatacatatacaattttaaattaaatttaaaatatttttacctacagaaatattatagagaccccagatcaatcttgcttattatgataatatgatctatgcatacaaaaatagattaatgtacatttagtagaggtatacaacacctgaaaatccttccattttgggtacctctactaatgttgttatcactagcgtatgaatgacttaagaaaacaaattccattttccattttcctaagagctaaggccacagtcatatgacttagcttaaccaattcggtgctttttccctggatttttacttgtcagggacaatccaaatgcacaaggacaacaaaagggtattcatgacagctgcaacagaataatggggagacaagtagccaatagtaacagtaaactaggaatgctctctggtggagttggctctgccatgcttctcactgctgttccttttccaaagccagttactctgtcttcctgaatttttcgtgagcttcctgaaaaacctctaacaaattctattattgtctaagtcatttacagttagcttccgctgtttgcaagtaagaactctagatactacacaatctaatcttctaaattttatgtgagaaggatttaaaaaattacttgctttaatcaattatgaaagaaataactcattaactactcatcaacaaaataatcagaaaaacatcacaagtatactaggcctacaatccaaatttgaaaagaattttgtaaaatattccaccactaaaatataatgaattactaatttttttcttaattatatttgtattaagtatttaaatgtagtattttctcttctttttatctagttttaaaaataaatcctcaattttctctatcatatctatgaagtaattatatttacctcacagaactgctgtgaggatcaaatgagttaataaagacaagtgtacatttaaaatttccagcaaagtatacagttatatgccatataatgatgttccagtcaatgacaaactgcatatacactggtggtccccatgaaattatactaccgtacttttactctcttttctatatttagatacacaaatatttatcattatcttacaattgcctataaaatttagtatagtaatatgctgtacagatttgtggcctaggctacaaatacgctataccacctaagtttgtctaagtgtagtaggctatataacctaagtttgtcaaagtactctctatgggttcacacaatgacaaaatcacctaacaacatgtttctcagaatgcatccttgtcattaagcaatgcatgactgtatttcagcaaaaataatctattaggaataaaataattatgttatttataatgtaaaatcatatacaatgttagtgtaccattatatatgttccatgatatgccactatatatgtgaaaatagtaattctattaaaatataaactccacaaaggcagtgaatttaaatgttttgtctgctgttgtgtcttcaggacccagaaagggcctaacttatggtaggcactcaataaatacttgtagaatgaactgatcgataaaaattaataattatatcatgcctataaggcaggtagtgcacatttgtatataatttcataactttgctatgaaaattttattaagaaataatatttcccaagatctagcaagtgctagcagaataatacaaattattttattttattttatttggttatgatccatgaaatatgggcctgagtcctgtgtctataacttacaagttttgaaacctcaggcaagttatttgggattgtttataggatcaaatgaggtaaattacataaaatgtctggcacacagtgccaagccagaacttgaataaattatctgatgattctaatccactgtcaactttgaataacaccaaaaaattcacagtaagtaggatagttgattagacctaaatagttaatattgttttataataaataaaatagtctttataagagttccctatgattggtcagccaaggcggctcatacttgtaatcccagcactttaggaggacaaggcaggcagattgcttgagcccaggagttggagaccagcctgggcaacattgcgaaactccatctctataaaaaatacaaaaatgagccaggcatggcaacgcgtgcctgtggtcccagccactcaggaggctgaggtagaagaatcgcttgagcccaggaaggtggaggttgcagtgagcttagataacaccactgcagtccatcctggactacaggtaagactctgcatcaaaagaaaagaattgcctacgaacaagaaaaattaaaaagcaaatttaatttggtacacttaatctctaaaattttctaggcaacaagaacattctaaaaaaactccatatgaaataaataaatttttctctttttatctactcttttgctttggtcaaccatgaaagattctaactcatgataaataaaaacattttaaggtatttttcaaacccaattaatttgatgtttgataacataggttgctaccctgacaatcatagtagagaataatgattttatgtcaaaatgctaatcatttcagaagagctttccaatatcaacccaatgtccataaaataaagtgaaagtgtcagaaatattaaaaatttaatttaaaaggcatgtattattgataaaaacatgttttggatacagttttaactgttagtctgagggggatttccttatatgtgacttgaggcctttctcttgctgtctctatcattctctctgcttttgtcttttgtcagtttaactataacatgccattgagacgaccttttggggttgaatctttttgaggacttttaagctttctgtatgtgggtctatatgttttgcaagacttaagatgttttcagctattatttcattaaataggttttcttcatctttgtccatctcttctccttctgggtctttcaaaatgtgagaatttggtcactttaaatttctcattcaacaagtcatgaattgcttttctgatatctttgtattgtttaactgtgttcctttatatctcattgagttcctttaaaatcattaaaaaaatttttcagccatttcaaatatattttttcctttggaatctgtttatagagatttattgtttctttggaggcattatgtttcctgctttttcatgtttcttgtgtccttacattgacatctgtacatctggtgttaacagttgctttttccaaattttgtagggaagtactttttgttatagatgcatctacagtgttggttggataggatgctttgactttgaatctggtgggtgtagtggagtagtctcagtataatttatttgaccataattagcatcagaagtatctgtgagttcttcagtgcctgaggctgcagttgctggtagaggctgtagcaagactttgctggtgacagagacaccagtcaggccagtcctcagtcaccagttgtggcagtggtgggctagacatgctggtccttaggcctccacatggcatacatgggtggcagtagttatggttgtggttaggccagtccttgggcctcaaggatgttgtaattataaaagaaacagataaagagatgcatagggtgtgttgtgggggaagaagcatggagctttccttgaggaaccttcacttgttcagttattcagtgaaaattctgtttttaaagtactcgtgagataacgttagatccatctagataatctctcctaaggtcaactgattagtaagtcattttaattacatctgcataatatcatttgtcctgcaacataacatgaccatgcgagtaacaccagggaacaaaagccatgtgggtcacctaggaattctgtctaccacatgtgagaagagattaaataagatcaaatctttgttaccttgaaaccatgccaagtgaggacacaattggcttataataggcacacattttagtcaacatggttccaggcaaaagggaggaatgcccatggtgttattttcctcttttagtcggttaatataagtgattttctaatgttaaattaaccttgtattcctggaataaattatatggttataaggtattattttttctatatcattggatctaattttctaatattgtattcatgatttttacatctgtattcatgacactgacctgaaattttctttcttgtaacgtctttgtaagattttgatattaaggttttgttgatctctcaaaataatatgtaaagtgttttcttttactctctgggaaatttacgtaagatggcattatattttccttacatgtatagaatcatgcatcagtaaattcatccaggctcaatgtctctttgtgaaaagcacttcaagaatgtgttcaattttttaatgtatgtacaactatttagtatttttatttcttcctttgtcagcttgaaaattgtgtttcttcacagaattttttcatatcacataaaaaattgtaatttttgatataaagttgttcttattctctttcatatctgtagacttacagcaatgtgcctttttaaattctttacgttggtaattactctttgctttatcagtcttgctggagtactaccaatttctctccacaaataatgaattcttaaatatattaattttttcatgtgcattttctcatgtttattgtatatttgtattccatttcattcatttctgatactacttttcttattcccctttactctgtttgggtataacttctgctatttttctatcttcatgagacagatgcttagattcttgatattctagcctctctcttttgttcatacatgcatttgtagctgctaggcaatagttattattttgtcttttgctttcaaatattctgtggcaaaaactgccactcaattccaattctctttttaatccttaaaacagtagccaaatttcatacaggtgacaaagtgatcagataaaagaccctatttcttagctgccagtgtacccatacaactaaattctggccaaggaaatgtaggaaaggggaattctggctaacgaaatgtaggaaaagagaaatgcagtatatccggtaagggtgattaaaattgctgttataatcaggagatgtgcccctttctgccattcagtattgcctgtcttccagcataaaatcagatgtaaagattggaactctggcagccattttgaccataaatgaccttgaagataaaacacacaaattagaaaggtagattgaaaagttagaggaaggttggatccttgattttgtgcagtatcacaggcctggacttcttgaaccacagactcttctcacataaaaaacaaaacttctgcctagtttaagccaagatattggggatccctcttacatagaactgaattgaataagtaaaacatacaaatatattatttcttctttttttaattatcaaatttactaaagcttcaggaaattgtaatatatagtgatgattatgggcctccttatcttgctccccattggataagataacgtactattttgctattattttccaatatgtatattaatgtattttaatcatatttactggaaaatgcagtctaagtatcttagacttttctcgcttctgctaaaacctagtttattatagccctagcatttagatggttcctacattaacattacctgcaaaaagaaatttgcaaccatacaatcagacaatcagagttaaacatttttcctggaaaataagctgaaatttgtctttctaaaactttcactcactatacctgattcttttatctattttacttacagaaaatattcaacaatttgaggtcaactatttgaattgccttaaatttactcttctgatacttatatatccaagttcccctaatcatacctctcatgatatgactacaggatatttcatttctctccaccttatatgttttaagaaataaatatttatttaataaatatcacctaaaatgtgaaagtcacagaaatttagtttgccagaaatagttattgaatgatgctttcttttttttttttttttttttttttttagatggagtcttgctctgtcaccaggctggagtgcagtggcgcgatctcggctcactacaacctccgcctcctgggttcaagcaattctcctgcctcagcctcctgagtagctgggacaacaggtatgcaccaccatgctcagctaatttttgtatttttagtagagacggggtttcaccatgttggccagaatgctctcgatctcttgacctcgtgatctgcccacctcagcctgaatgatgcttttaacatgtaaacactactttttaaaggcactgtgggataatagttatggcagtgacatagttttctaatttctccagattccttcatagaaacaaacataacaactagaaggcaaatttttttaaatatctacaacagtactatgtgacaaggtatcctcgggaaatctaaaatgtgaatgaatggggaaaaatcatagacaattgtaagcccactgctgtgttagcaattattcaggaggaaacagacaaaagtaatgaggcatttgatggatagaaacaaaacaaatagaacagaagctaaatccggggtgggggggatgggcattagtgtgtgaatacaataaataaaaagtctatggtaagatctaaaggatctgaagcattccgggactctaaacccccaaaactaaccagccaaaactctcttacaggtcaaagcccaaagtgaggagaatttcctgggaaaataatagtaattgagtggcagagaaaaacagtgaaaagagagagcaaaatatccacattaacagggaggtaatagaaaccacagtcagagacagcagaaagagaaccacgatactgtggatgctacacaaacacaataggagtagttttaaatactaaaataagaaaagctttttcttaaagttcagaaaaactaattttatagaaacagcaatgcagaaaaatcactatctcgttctttacagaattataataagaagaaagtaaagagcataacaatatcattgtagacaatggaagcaggccagaaagtgaaccttataaaaaataaaaataaaattacacctattatttcaaaatgaacaaaaagatagcaagaaaattatataagacatgtaagagaaaatttagaaatgcagtgatagaaatgagaaaaaaatcagtatttaaaaactaattttatatataaagactaaaccagaaggattataattataaatgaaaacaacaaaaaatttcctaagtgaaatagactaaaataaggaatatttttaaaattaaaaagaaaatcagtagaaaaagaactaccatcactatgataaatgaatatgagtaactattcaacaaactatttcaacaatatatctccagtctaatcattaaaaaaatcctgcaacaaatcttgaattgtattaaatacattgttgatagtagtgtgtagtagtgactatgaaactattttgtgtatattgtaggattaagctaatgagtaaaattaataatgttggcaaccaaaattcaaagggaaatataatgttgaatgaaagcagtgaataaccctctgtgttggattaacatttggggtgttaacatgaaattatgatggaaagaataatccatattctgtctgctaaaatgagctaggaataatgacaccccaatagcaatgaatacatctagtttctagatcttactttccaaataccattccttactgaaaggactagagctgtttggaaaagctgacttcaggggtgttgttagaaaagtaaaaggagcatggaatttggaatgtgttaataccggaacctgatatttatttacatgcggtttcatctcttcataactgaccacaaatgaccaacacaaaatggctttctaatattgattcatatattagcctccccaccaagtttaaactcttaatgtttcatctgtaaaacagaaaatacagaaagactcaaaagctctgttttattaaataatataatggattaatgtacctaacatggtgctttacatatattgcacattcaataaattttgtttcctatattttttccattctttttccttttttacaacccatcaagacaaccaataatcctccccatgatctcagtatagctgcctttacgtaggtttaggaggctatcaatctaattacaacatttcattctaagaataaaagtatactttccttatattgtatcacccgtactagaaatactaccactctaaaagataatagcattaatcataataattttataaattttggccatatatatttcaagtacttaaagttaaaaatttcaaagtacaaaatatttgggtgtgaggagacatttctcatgcctagaaatagagacacaagaagactaatcactcggaccctaggttgtgggaatctatagttgcctctcaggggagctcttcatatttcctaattcttactttcacctttccatgcatgaatccagatctgatttcagctcccactgtctctccatttgttgatgtattaatcaattcagaaagtatttttgagcacctaacatgtgtcaggcattctgttacatattaaagatacagagtggaaaacagagatacagtctcatagagtttatagtaaatctggagatataggtaactatagagacgactataatacggtatggtaagagcttgtgataataaaagtatgtgaaacacatcaaagaggcaatatcccaaacatttgtcctaaacaaatagaaagccactggaggactttaacttggtgaataaaatgattaaatttgtatttttgaaagattactgtctgcatgctggaagggagcaagaaatccaaggaaaatttcccatggggccaaataacacagagagcactaaatataacaacaacaatgataattaaatttttaaggctgggcgcggtagttcacgcttgtaatcccagcactttggggggccgaggtgtgcggatcacgaggtcaggagattgagaccatcctggctaacacggtggaaccccgtctctactaaaaatataaaaaattagccgggcgtggcggcgggtgcctgtagtcccagctactggggaggctgaggcaggagaatggcgtgaacccggaagtcagaggttgcagcgagccgagatcgcgccactgcactgcagcctgggcgacagagcgagactccttctcaaaaaaaaaaaaaaaaaaaaaaaaaaaaaaaaaaaaaaatgtaatatctacttttgtcaggtgctaagagcattatattgatcatctcaattcccacaaatagaaataagtactttttttatcccctgttctttacaattttacagataaagaaattcaagcccagcatagataagtaatgtaactaatggaacagagctttaaagagagagaaaatacaaatcatcttgtcttgaaccctgccatatattattactgaaatctcttcctgcaaaactctctattcatacatgcttagtttttaaagattgttcccatgaacaaagtttttatctcatgttacatgagcgtcagtgagaaccttcattctaccagagaaaaaaatccctgggaaataacctaaaaacaagaccctttaattagatctgtatttaatataaaaagcacattaaattccaatgcaaaataaagacagaattaatattttaaataagtatgcacttttcagcaactgcctgattgattcttttgcacctcctttactcaggtaatttgacttgtctccaatgtgagattatgttctctcatattttgacctcagtgtggaaaattatgtggaaccacttcctcagaagtcggaggcactgtatttatggtcagtttcactacttattcctcatacttgtttctctttatcaggactattgccacctatgatttagcatatattggcttgtgctggaaggcattacatctcattgtgtctatcttaccacagaatgttgaatctcatttcagtgaaacttcctaatcttgctttatcaacaaatgtctgttttcttattccagatctacgtcaatcctatctatatttcagggccaaatttcatttctatcttctgaactttaccaattagaataagctatatgaatattttcatttagtttttcatatgtttgacatttggtatgaccaatactataaattgatgacagagtatcctatcatatctctgcaagtacaatgttgagaaattctagcaaaaaggtttccatttatttgcaaagcttagctactgcaaaggaatgcaaggaacaagaaaagaggaaaagacaactaaataaaggacaatatagattgacgtggtagcagatgtgacagcaaaattgtattcgcatctaaataaaatataaaatcttccatgtatgttccatgttttatattctattgtatcccattatataatccatggcttacatttgtatttatatggtaagttgaaaagaaaaaataaaatatcaaatgttgattatgttaaatattatattactatagagtctgtggtatttttcttaaagttaggttaaacagactataccattttaatgatagagaatacaaaaatgcaaattattggagaattgacttcttatcatttatttcttcaccttcttatttcaatattcaaatggtaaagaaaacaaaacatacctcaaattttttctaactaagaaaccacgtatccatctttgaacaatcaaaactggtgaattatgagccagaattgcattaatttttgaagtaatatgtttaatattattaatttcctcttcataggttgttccctgtataaagaaaatataattaataatttttatctttcatgaaagtattttcaaaagatattttaaatttggtaatctattggtttaaataaactaacaaaatgttcacaaggtcttacaggcattatagttaaattatgatatggttggatgtttgtgccctccaaatcttatgttgaaatgcaatccccaatgttagagataggggcttgtgggaggtattggatcatgggggctgttccctcctgaatggcttagtgtcatccctttgatgatgagtgaacttcttgctcatatagttcacatgagatctggttgtgggaccaccccttctgtctcctgctccctctctcaccatgtgacttgcctgcctcccattcaccttccaccatgattgtaggtttcctgaggcccttaccagaaacagatgccagcaccatacttcctatataccctatagaaacatgagccaaaataaacctcttttctttataaattacccagcctcaggtatttctttatagcaatgaaactgagtaataaaaataataaatacatttttattattagagtaaaagaacaataattagtagcatcaagtaatttcaattctctacacaaaacataagattcttgatgataactttttccattaaagattattttcccaatctgataatatatgtataaaattttaaccataatcattctgctctctaaatggtagtggcacaaacaggtgtccaatgaaactgcaaatactctgtcagcccccataaataaaattgatatactttgattcataaaataatgtatagtagttaaaaattttgttgtagcttaactagaatgttggacacttttattggaacacagcaaattatcttggaaaagatcctgtattggctttgagaaagatctcctttcctgaaaatttttagatttgagatcgtaggctcagtatatttcattgacaacttgactggttagaaataaggtcactgtttatgttttgaatgtaagataatgcattaaaaatactgacaattgcattgttcatgaagcacctcttctgaaaattatcaaccctattacacttaaaacatacaccttttctgcatatacactcaataaaaaagtttacaggaaacaaaaaaaaaatcacaacaccttgcagattagtgccgcttccgatttatactttcaaacactcattgctaattataaacttatttccttggctctgtctttattctattcccaacattagctactgaaaacctttgacactattcgatactcttccagtccattccctggagcttcctaaacactctgcttcttttttcacagagaaactagagccatcaagtctgaactccatcaattaactcccctccattctctgtaaatttaactatattcctatctatactgagtagaagtgccttctactcaaacttaaaacaagaagtaactctttttttgtctaagattggcactctattatgagtctcatatctgttttctaaggctctccctctgctagcactatctgttcatatataaagatgatataactttacctatccttaaatcctaactctcaatcctttatatctaactttcattaagagcccaaaatctagaaacagaattccatgtttgtttctcccactttctttttttttgttttgtttttctatctctcattccactggcttctatccctatcatccaagggcacttttttagagttaacattggacattccctccttgaaacacttgccttagattctgtactacacttctttcagttttcctctaaatcttgtttacttctgcactttaaaaaaaactatatataccatgtttatcacttcattgttacattgaaagaattttctccatgttgctttttaatctctacacatcctccaaatgaccacttctaagttcatagcttgaacactcacttttgtgctacagactctcagatttctatgtttaggcctgacctacgtaacaatatagtcaaactgatatctaactaaatacaactttcccaaatatgaattttctttcccaacctgctttctcatatacactaccttagtaaatggtaccagtgcccacagttgcctaaaccagaaaccctggaaccatcctaggttctctctttttttatgcttcctggcatgcaaatgttactagatgcagtacattcaacatcccaaatatcagtcttacctctctttttcttctattttctgccattgcttttcctatgtctttaacaccacttccgtaacttactaaaattctcctaacttatatcttcattaattcctgttcccccactttctccaaaccataaaatgcactattgctagattgagcattccaaaatgtaaatcttatcatatgacattctagattaatatatttattggcttgccaatgaaagacaaattacaaatgtcttggtttgccacacaaagtccttcttgatctagtcccatcctagctccttaatctcatctcaatttatcctacatagaattacctgataatcaaacttaaatgctttttgccatctgtatttcttgaactgcctttttcaatgatttgtctcacaattttagtctttgggagactcagttccttcccccaagaagactttcttgatgttgatctgcattcagtgtctttatacaatattatcctgtgtcgtgtgaaataattcatttgtcactctcgacaatgttgagttttacctgacccctgtgttcttggaaaacagtgaaagttaagaaatctcctcagtcctttgtttcaggaaatggcttactgaaaagaagcaccctgctctttatgactgacttaaataatactcttggatgcctttcttgtttgtttataacaagacctgacacagaccttacaaattcccattcttcccttctttaacaattagctgaaaggttttgtccccaccaatcaattggaataaaatatttgttagcccaactttagttgagattatttccttcccctgggcccctgaactttggcccaccatcagccccagccagcacacagtctccctttaacagcccctcttaagaataggtttttctcagggtaaaacagtctgtgctctaaggtcagaccataccacttttcttcattccacttccccacattcatttatttatagtcttgtttattcctccttataaatgagaaattcttttgcctaaccattatgacttttgcagatcttatggtcagaacattctccacattgtaataatcccactctgcctattgcaatagttcctttccctcacgtgcaatcagctttttgaataaggtctctatttattaatcctgatgtttttagctgacaaattattctttaatgcaatcattggtgtatcttctccatataagctcaccaaatttaacaactcttcatcctacatatctggactaactgagatatctggtctataactggcatttgattatcaattgactgttaaaatactaagtaatcattatcgttggcctccaagcgtgacttaacaatgtcaatcaatttattcttgtaactcaattattttgcatggctacaaagacatcacactctttttctcccttttaaacttttcttagtctgttttgctggttcattttcttctgcaaacatttaaacatttgatttaacttagattttcattctttttcatctttcttggctaactcttctcaagtgaaaaccttccttgtaatatcttactgcctcacatacctagattatccacatagctgtaatctcctgtcagacattctttcttaaattacaggcatataaaataaacttccaattccatttatttactttgatgtcaaaactataaataattatctccctaacttgaatcaatccacactcatattatattatctatatagtcataaaaacgattcttcgtcgtgtcaaccaagtaataaacccatattcctctttctctcgcacctttttccattcaataaatcactaaattctatcaaatagcccttcaatctgttccttatacactatacctgaactattataatagactcctaattcccctatattcaatttccctccactccaaaattacagaatacaggatgatttttctagaataaaaatcaggtcatataaatgcctgaaatgtttccccaagatcttgcaagataaagtcctgtctccttagtattacatataacaccctttgctattttaatcccgtttttgtctccagcatcatttgacatgcccaaacatatcctctaaactccaagaacacgaaactacttgttgtcacttgcatgtgccaagctctatcaatacctctgtgcctttgcaaatgctttccactctgcctcacaggctcttcactcatgccaacacctctatttgcctagtaatttcttacattcaaaaaattcatcagaaatataaatacttctgcattttttcctgtgattagagaattgaacttcaaagatttttaaagaaaatatatgtactttgctcacagaatttttcccagtactcagattcatggtgttttatccattatttcctgattattgcttctcctttatttgctttaattttctctaccgtaattccatcctatttataaatattacatgaatgtctacattgtttctcataactttatgtatttattctcattttggtgaagccactctgtcaaaggtcagtttctcatattgaattttttatttagcttatcaactatttcagttatgtggctgagtctaagttcttttctgaagctcctaactgctctcacacgagtcctatcatataccatttgatatttattgtaaccctgactgtacttgaatctctccatgaaacctattctgtagtaatggatcctgtcacttgttctatcgtcaccctgaaaacatagagggttttgcagaatttcctctagttcctgtgattttataatatttttcaggaagaatagcttaaagtcaggctgccttagtttcttcttttgattcagttatgtcttagtccatctgggtagctacaacaaaatacatagtctgggtagcttataaacaacagaaacttatttctatcagttctggaggctgggaagtccaagataaagctactggcagttttagtgttggattaaggcccatttcctggtccataaatggtaccttcccactgtgtcctcacgtaatggaaaggggacggatctctctggggcctctttacaaagaacacgaatcctatttatgagggttctaccctcatgacctaatcacctccaaaagtctccacctccaaataccatcatattggagattagattttagcatgtaaattttagactggccacatttagaccatagcagtctcaccttcatcgtatccgacaaaaagtctttgctatgtctagaattatccagagctaataatattttgtaagaatattatcttttactagtttctagtatagatgtgatttccacaaatctatatgtttgttaattacatttgtgctcatgatgccacctgtggcttaggattaaaggggttgagtgtaatgatgtaaaagtgcataagtggtggcaaggggatgggggtagaagtgttggagaagcagaaagaatacaggagggaatttagatgattagaaccaagtagccctggtcagaagcagttctcatcagtagagaaacattaagctcatattgcagtttacatcagagtcctgcttctcactgagtcatgaaaaattccttctcattaaagaaataaacagaatattcatcagctctgggtagtatgagtgtcccttccagagaacaagtaaactccagacaatacttaagctttctgatgtcataaaacaatgatcttgaaaagtaacaataaagaccctgcaaaattttacaaatgccataaaccatttgatgtctgaagatgaaggaatcctctttgtaaaataataataataataataatgcattccctccattaaagaagtgacggctctgaagaaaaactacatttgtttaaatcttagttctaccacttgctagctgtgtattatagggtaaataacctatctgtatcatgttttcatcatttgtaaaatggagataacgatggtacaactcactgggttgttgtgaggttttaagcatgcaaacaatgttatctttcaacagttttatagcaatacttaaaatgatatagtgttttagggtttataagggacttctacatacattattatatttgatacttacaaaattttatctaaaaagagacgtgtactaattaatttatccaaactaatataatgtaaaattatgaaatcaacaaattaactataaaagataatcactacaaatgttttcaatccaatcaaaggaattatagtaaaggcttagcaaagaacaaaagatgcttaggcaaaaaactatcaacaatcaataaaatgattggtagaataatagaaattctatactacgtgcctgaaatgaaacgggctattactaatcctggaacgaaatagagtgagacatgcaaaagaatattaaggacttttataattatgactcatatggatgacagtgttttgcatgtcaacagtaagagttgtttaaaaactaattctaaaactatatgctagtcacattgtataaaatgatgcaaaacaatttcccaattaatttgacattctaaatgcatattgtacttatataatttttatcttccctacttccacgtttttagttctacgatctagtccataaagtttatctttttctattttatttgtgaatattttccataagaatatttgatctcatagaagtaaaatgtagaacagaggatactagaggctgggaagggtagagggaaagaagagataggaaaagatttgtcaaaagacagaaaattacatgtacataggaggaataagttctagtgtttatatcactgcaaaatgactatagttaataataacatattatatagttttagatagctagaaggaagatagtgaatgttcccaacacaaagaaatgataaatgtttgagatgatgaatatgctaactatgctgattggatcactatacactatatattttgaaacaccatgaatgccataaatatgtacaattatatcagttaattttttttaaaaatccaaatttggcacacattttctcagcatatttgaaaagtgtaaaacataccaatcccataagtgtttatttcaaataaagaaaaatcatatcatttttacctttttatttattcttttaatattatgttcactttaatagtcccacaaaatggtaaaaaatctgtgtgaaacttcccacactagcatggaatcttttgcattatttaaatcagtatttataaggatcacttggtaaacactgaggtacaagatggctgtgttttattaactgtaaacccagggcatagaacaaaactgtaacatagtacatagtagttatataacaaaagtgagtactctaagtgtgctaggcagtgaaaatataatttttctattgttgaaataattttatataagtagcattattctatggacattcacacagattgctgcatgtgtatcaataatctgttaatatttctggttgagtactataccatggtagggatgtgtcaattcatttaaccattcactcattgaaggacatctaggtattttccagttcggggccattaccaataaaactgctttaaacactcatgtacaagcttttatgtgaacataagccttcatttctctgggataaattctcagtattgcaattgctgaatcatatgattattccatgtttagttttttcagaaaatgtcaaaatcttttccagagtggctgtactattttattttcctaccagttttgctgcatacatgccagaatttattgtcactctttttttttaattttagccattctgaatagtatgtagtaatatctcattgtggtttcaatttccatttccctaacagctaatgatattgaatattttttcacgtgattactttgccatctgtatataccctttggtgaaattcctcttctggattttgttcaatttttaattagattgtttcatatgtttttgacgtgtgtgtgtatgtgtgtctgtgtgtgtgtgttttaaggcttgagagttgtatacattttctatatactagtcttttttcagatacagggtgctataggctgaatcgtttcccctcaaattcatatactgaattactaacccccaataactcagaatgtgactgtatttggagatagagttctaagaggtaaataagttaaaataagaccatatgggtgggctctaatacaatatgactggtgttcttttaagaaatttggacacaaacactttcacagaggaaacaccatgtaaagacagggagaagaagagcatctacaagccaatgagagagtcttcagaagaaatcaactttgctgatgcctcaatcttggatttctagcctccagaattgtaaataaataaatacatttctctttaagctacctagtggtactttgttatggcagccctagcaaacaaatacatagagtttgcaaatacttgccccaaatctgtagcttatcttttcattctcctaacagggtctttcatagagcaaaatttttgaaaaaaaatttgattacatgcattttatcatttattccttttacaaagtatgcttttgatgtcaggtctaagaattctgtctagtcctagatgcccaaaagtattacttttctaaaattctgtaactttacatcttacacaactgcttgacctattttgagttaatttttgtataaagtatgaaacttagactgaggagttttgatgttattggtcttttggctatggatacccaattgctccaggaccatttattgaaaagacttttttacttcatcaaattacatttgtacctttgccaaaattcatttggacatattgcatgaacctatttttaggttttattttctgttctattgatctatgtgcccatgtgttatcaataccaccacagtcttgattacgatagctacacgtgtctaaaaataaggtaactgatgcatcccacttttttcttgtttttctaagttcttttaacaattctagtttgtttatatttccatataaaattcagtataatcttgactacatctacaatcttatggaattttgataagaattgcattgaagctgtatataaatttcggtagaattgagatctttatttttattttttaaatcagtgttatgtagttttcagcgcagcagtactgtgcatgtattgttagatttatatattaagtatttcatttctttgaatgatgataaattgtatttcaaattttggcttccatgtgttcattgctagtatatagaaatataatttttgtatgtttatctggcatactgagacaatgctaaccttacttattagttctaatatattctttgtagattcttgaggattttttacataggtgatcatttgatctgcaaatagagttgtatttcctcttttccaatttcttttccttttgtttccttttctcaccttgttgtactggctattttctggcactatgttgaaaagagaagtgacagtggacatccatgctttattcccaataatgtgggaaaagtgttctttcaccattaagcataatgttagttgtaggtattttcttgatgtttttcctcaagttgaggaagttgccttctaaacatatttttctgaaagtttttgtcacaaatagatgttgaaatttgtcaaatttttttctgcatgaattggtatgacatctcttctttagtcttttaataaggtggattgcatttattggtttagaatgttgaaccatccttgaatccctatacttggtcccacttgatcatagtatatatttttatatactgctgaattgtattcgctaatatttttaaagatttctatgcttatgctcttaaggaatattgatctgtggttttcctttcttgtgctgtctttcattttggtatccagataattttagcttcataatataaattaggaggtgttccttttttatttttattttttggaatatattgtacagaattggtgttacttttacatgtttgggataattctccagtgaagcaatctagtcttgtatgtttctcttttgtgaattttaaaactatgaaatcaatttccttaatagttatacaattattcaaattatctatttcatggtgggtgagtttttgtagtttgtgtttttttttctgtagaagtgtttcatttcatccagactgtctagtttacgtgtgtagaatatttagtattattattctgttaacatttgcaaggcctgtgatctccctggtttcatgcatgatgttgataatttgtctctcccttttcctttgtcagtcttgacaggtttgtcaattttattcactttttcaaagaaccagatgcttgttttcctaattttctcaacttctttggtttttcagtttcactaatattcactccttatcattttgttccttctgctggctttgggttaattttgctcttctttttctagttcttgagtgggaagcatagatcattgatatgatattttccctcttttccaatttagtgctataaattttcctctaagcattgccttagctgtgtcccacaacttttaaaactttgtatttgtatttttattcagttaaccatttctttatttcttttacaccatcctcttttgggctaaggacatgaatagacaattctcaaaagaagatatacaaatggccgacaaacatatgaaaaaaatgcttaacatcactaattgtcaggaaaacacaaatcaaaaccacaaggtgatatcaccttactcctgcaagaatggccataataaaaaaataataataatagacgctggcgtggatgtggtgaaaagggaacacttttacactattggtgaaaatgtaaactattacaaccactatggaaaacagtgtggagattatttaaataactaaaagtagatctaccattagatacagcaatcccactcctggttatctatccagaggaaaagaagtcattatacaaaaaagatacttgcacttgcacacagatgtttagagcagcacaatttggaattgcaaaaatatggaaccagcccaaatgcccatcaatcaacaagaggataaagaaaatgtggtatacatataccatggaatacgactcagccataaaaaggaatgaaataatggcatttgcagcaacctggatgaaattggagaccattattctaagtgaagtaactcaggaatggaaaaccaaatatcgtatgttctcactcacagtgggagctaagctatgaggactcaaaggcataagaaggtgataggttcataggtgcagcaaaccaccgtgacacatgtttaactatgtaacaaacctgcacatcctgcacatgtaccccagaacttaaaataaaaataaaaattaaaaaatacgacactctaaacttccacatatttttttttaaagaatgatacaatggactttggggacttggggaaagaagtggttgggctgggggtgagagataaaagactgcatactggatattgtgtacattgctctggtgatgggagcaccaaaatctcagaaatcaccactaaagaacttattcatgtaaccaaacagcacctgttccacaaaaacctattcaaatgataaaatacactaaaaccactgaattgtacaattaaaaacataaaataaacacacacacacacacacgaaagaattcctccttgactaatggatttattagaaatgtgtaatagtttccaagtgtttggagattttcctcttatctttctgtcatcagatagcacaccctgtatgatttaaattctattaaatttattgatatttgttttagggatagttgctgatatttgatttaaggatatatatagtctgtatagaatttcatggacacttgaaaagaatgtatattttgctgttgttgggtggtgttctataaatgtcaattacatactattggttaatagggtgctcgtattttctatatatatcctaatttcatatctagttgttctaatttcctgtctagttgatagagagaagtattgacatctccaactatatttgtagatttgcctatctctcatttcagttttctgtccatatattttgttgctttattgtttaatgcatccccatttagaatggctatgccttattagtagattgaaacttttatcatgatataacatctctctccacctctgataattccctttgtgctgaaatttcctttatcagatattcatacagctactcaatcctacttttaactaatttttgtatgatacatatttttccatcattttattttcaatttgcctataacattctatttgaaattagtttattgttaacaacgcatagctgaataaagttttgaagcccaatttgccaatctctttcttataactggcatatttagaccatttactgtaaattttaatgtaattatagacaggttaatgcttaggactaccattttattttttgttttctgttagattcctgtttttttctttcattgttttcttctcttgatttcctatgggttacttaaacatttttggaattccatttagatttatctatagtgaggttttctccctcagttttcctgacatataattagcatacacaaaaagcctaaacataattatgtatggacatatgtattacttgtgttactatgtccataatcaaggtaataaatatatccatcacctctaaaagttcttttggttgtcttgtgtcatttttattttcttttgtttgtttgtggtaagaacacttaacatgagatctactcacttaataaacttttaagtttacaatacattattgcaagctttaggctctatgttgtaccacaatttgtaggaacttcctcatcttgcataactgggtatttgtaaaccttgaacaacacttcccacggtgtcctccctatcccctggtaaacatgatttgattatctactgctgtaaatttgactatgttagatgcttcacataggagaaatcatccggtatttgtccttccatgactgacctgtttcaccttgcagagtatctttcaggtccatccatattgtcacaaatggtaggatttccttctttttttaaggctaaacaatattcaattgtgtatgtatagtttatttctgtattcatctctccgtgaacgtgcaggctgtttctgtctcttggccattatgaataatgttacaatcaacatggaatactgtttaagatcctgattttaattgtttcttatatagacccagaagtagaaatgctggatcatatgatagctctatttgtactttgttgagaaacctccataatgtttccataatagctgtaccattttacgttgccaccaacagtgtacaaaggtttcaatttctccaacacttttttttaagagacagggtcttgctctgtcacccaggctggtgtgccactggcaaaattgtagctcattgcagcctcaaactcctggactcaagcaattctctcaccttagcctcccaaatagctgagactacaagtgcacgccacacctggttaatttcttaaattttttgtagagacagggtcttgttatgttgtccaggttagtcttgaactcctggcctcaagtgatccttctgcctcagcctcccaaaacactggaattacaggctgctttgttgtgttttaataatagccatcctaggaagtatgcaatggtatctcctcattctttgattttcatttctcatatgattagtagtgttatcttttcatatatcttttttatgtattcatttttatgtattctttggagaaatgtctattcaagtctgttaaccattccttattcgggttattttttgtttgtttgtctttgctattaaggtataagagttccttatataatttagaaatttacccctcattaaataaatgatttgccaatattttctcctagtctataagttgccatttcactctgttgattgtttcccttgctgtgtagcagctttttagtttgatgtagtcttaatggactgtttttgcttttgttgattgtgtttttagtgggatattggagaaaccattgccaagaccgatgtcaagaaggttttcccctttttccttctagaagttttatagattcagatcttacctttaagattttaattcttttttgagtatagtgtaagacaaaggtccaatttcattctttttgatatggatatccagttttctcaacatcatctattgaagagaatatcttttctctgctgtgtattcttggcacccttgctgaaaattagttgaacatatatccatgggtttatttctaggttctgtattccgttctattgttctatatgtctacttgtatgccagtactacactgttttaattactatagatttgtaacgtattttgaaaccagtaagtgtgatgcctccagctttatttggtttttgtgtttgttttgcttaagattgttttggctattcaggatcttttgtggtgccatattaattttaggatttttttccatttctgtaaaaaagtacttaggtattttgataggaattgatcaaatctgcattgctttgggtgggatagacattttaacaatactaattttttagtccatgaacccaggataccttccaacttatttatgtctactttagtttttccattagtgttttatagttttcagtgtacaagttttcacctccttggataggtttattcctatgtattttattctttctggtgctattttaaatgagattgctttcttaatttccttttcagattttttattattaatgtataaaaatgtaactgagttatgtgtaactttactaaattcgtttattaattctaacagtattcttgtagcatgttttaaggttttcaacatataagaccatgccacctgcaagtagagataattttacttcttccatcctaactttcatggcatttatttatttgtttagtcccattgctttggcttggacttccaatactatgttgaatagaggcatctttaccttgttccatatcttaggaaaaaaaacttaaaagtttttcactgttgagtatgatgttaactgtgggctttttatatatagtccttatattgcattgagggaaactctttccatacataattgttgagagcttttttaatcataaaaggtgttgaatttttgtcaaatgtttttctgcatctatggagataattgtgtgatttttattattcattctgttaatgtggtgcatcacattgattgatttgcataggttgaaccatccatggctcccagagacaaatctctctcagccacagtgtgtgatcctttcaatgtactgttggattcagtttcttaataccttggtgaaaattgctgtatccatgttcatcacagatattgacctgtagttttcttgtgttgtttttgcctggctttggtagcagtgtaatgctggacttataacatgagtttagaagtgttcgctcttctttttggggggcagaatttaaaaataattggtattaatgctttaaaattcatatataaagccatctgaccctggacttttctcattagagaggaatttgattacataatcaacctccttatttgttataggtatgttcaagcattctattttttcttgatttattcttgggaggttgtatgtttctgggaatttatttatcatttcttctaagttgtccactttgttggagtatgttttaaatgagtctcaaaatcttttttatatctgtggcattaattgtaatgtctcttctttcatttctgagtttaagtcttctttttttctgtgttattattgctgagtttgtctatcttgtttgtctttttaaaaagccaactgaattttgttgaatttctttgctattccgtatttcatttatttttgccctgatctttgtttctttatttctgccaattttaggtttagtttgttaatttttctagttccttcaggtgtacagttggttgagatcattttttcttttttaaaatagatttcactataaacctcccttatcatactgcttttactttatcctataagttttggtaggttgtgttttcacaaattttagtaagttcattttcacttgtatcagtgttttataatttcttttgatttctcttttgactcaatagttgtttaatttccttgcatttgtgaattttcccaatttccttttgttaatgatatctagttttattccattgtgcttagaaaatattcttggaataaattcaatcattttaaatttcttaatacttatatgtgactatgtcatttattctaaagaaggttctgtgtgtgcttgaaaggaatgtatattatattactgctggattctgtgtacatgtctgttaggtatatttggcccccagtgttattcaagtctgctgttccctatcaatttactttctggatgatctatcaattgttgaaagtggggtattgaagttttgtattattgtgtttctgttttctcctaataactgctaacgttgcttcatatattacataatttaatgttgagtgcaaatatatttatatttgttatagcttcttgttggattaacccttttatcattatttgatgacctcctttgtcttttgtaagttttttaattaaagcctacttttttaataaatgtagacactcctggtatcctttggttatgattagcaagaaatatgtttttccatttctttcccttcaccaatatgtgaggatttaaatccaaggaaaatctcttgcagacagcatatagttgggtctcggttttttaaaaatccattcaggccaggcacagtggctcacgcctgtaatcccagcactttgggaggccgaggcaggtggaccacgaggtcaagagattgagaccatcctggccagcatcctggccgtctctactaaaaatacaaaaaatcagctgggcgtggtagcgggcacctatagttccagctacttgggaggctgaggcaggagaatggcatgaacccaggaggtggagcttgcagtgagccgagatcacgccactgcactccagactgggcaagagtgagagtccatctcaaaaaaaaaaaaaaaaaatccattcactccctccttatcttttaactggtgagtttaatccatttacacttaaaataattattaatagtaaggctaatgattaccattttattgttttgttttgtagttctcttgttcttcttctcttgtagtctttctctgtggcttgataatttttatactgctatgctttgatgctattttatcttttgtgtatctaccataggttttttctttgttatcatgaggtttgtatcaaacctcttaataaagtctattttaagctgctataaattattgtcaaacacatgtacatttctgcacttttactgtcccctcccatattttgtcactgatatcatacttttcatattgtatattcagtaacaaattttgtttagacttaatattttgtttcaattgaaacaataaaaaataataataataaaataaattttgtttcaattcaaaaaacttccttcagcacttcttgtaaggtaggcctagtggtgatgaactccttcaatttttgtttatctgtaaatgtctttatctctcttttattttttgaataagcattttgctaggcatagtatttttggttgtcacgttttgggttttttattgttgtttatatggtgttctgaatataccatctcattttcttccagcccacaaggtttctgatgtatcttgatgtaaatttctttcatttctatctacgtgcagatttttgggctgcctaagtataggtatccatttctttctccagatttgtgacgtgttcagtcattattttatacactttcttccctcttttctctctgtctctcttaactttgtaagatatccataatgcgttatattgttttacttgatggtgtctcatcagtcccatagagtttcttcacactttttttttcttttcttttcgtctctctgactggacactttcaaatgacctgtctttaatttcactaattctttcttctgcttgactgagtctactgttgaaactctctattgaatttttcagttaattcattataacactgaactctacaatcccccttccgcccttcccctcttccttccttcctgtttttgacaggagtttcactcttgttgcccaggctgcactgcaatggtgcgatctcagctcactgtaacctctgcctcccaggttcaagcaattctcctgcctcagcctcccaagcagctgagattacaggcacctgccatcatgcctggctatttttttttttttttttgtatttttagtagagacagagttttaccatgttaaccaggctggccttgaacttctgaccttgggtgatccacctgccttggcctctgaaagtgctgggattacaggcatgagtcactgcacccagcctacaacttcattttggttaatgttttctatttcttgttggttaatagtttctatttctttaacatcccattttttatgtattgtttttctgatttcatttagttatttgtcaatgttcttttgtagttcactaagattctttcagaatattattttgaattctttgtgaggcagttagcagatttccatttctttaggtttggttgctagagagagctttattagtttcctttagtttcctttgatggtagaatgtttcccttattcttcattgtccttaaatacttacgttggtgcttgtgcattttaagaagcagttacatctaaaacaatcttctcatcttcataggctggctttaggaattaaaggtcttcaccagtcagtgcaccctgggattctggggctctgactggtgtctatggctggtgaagcctgctgaccagcgtctactggctctgaagtcagatgaggccgatggggtccaaggtcaggtgaggccagctggtctgctggggccaaatggaagaagatgttgttaggtgaagatgatgacaggtctacagtcagtcaaggccaatggtaggggctatggggctactgccaatatctgtttgcccaccactaacagctctaccctccccctttttttgttgttgttgttcctagttgtcccgtgatgatttagctgtgctaattctcccatattctgactgaggcaagatagaagtgcacttctcaggcaacaccctgaaatgctgaggaaaatgaacattcatctcagactctccttcccccactggataaatgggaggccaaaaagatccttctcactgtgatgctctgctagcttggggaaagggtgacacaagtaaagtaaaattgttccttttatccttttaacattcttccccagattttgcactctactgggtgctgtaacctctcccctgggttctggaattctcacaaaggcattattatccatgaatagttactaaattggtgcttctgagggagggctagaactgagaatctcctattcttccatcttgctgacatcacactcctctctatatattgtttttgtatatctctttgtacagctttcttagtagatgctttaacataccacagtcaactaatgtcacaaccatgtaatgtcactaatttaccagatcaggtgaagtatggaaaccttatccctcttaacatccctttacactcctgtttataattcttaagtatacattctatatatatttagaacaacctgagacagtgttataatttttgcttacacagtatttataatactcaagagaaagaaagtgtatttcgtttacccatatttttgcttaccatgttctttcttccttcctgatattccacagccttcttttatcattttctttctatgtagagcgcttcctttagctattattttaggggaggtatgctagtaatagattctcttagttttcctctatctgagtatatattaattccttcttcattcctgaggaatattttcattgtcatagaattatgatttgatagtgttattttctttctgagcttgaaaaatattttgcaacttgcttatattctttacagtttttggtgcaaaattttgtcactctcattgtttttcacctataggtaaagtgttgtctttcttgttttccagatttttttctttgccttcagttttaagaagtttaattaagatattttttggcattggatttctttgggctgatttggggttttctcagcttcttaaatctgcatttatgtctattgcaacatttgggaagtttttagccattatttcttaatcaggcaccttttcagtgctgcactctgttttctcgagactctgatgacatgaaagttatatcttttattataattccatggatacctgaagctatgttcatttctcagtattttttttttctgttgtttatgtaggggttatagctcctgtgtggtcttaattggcacagctttaggggtagccttgttatcacccagcaatggtaaaagtcttgatctccattagtgtcagaggagtctgacaccacctcagcagggaggggcaggaatgttgtactacaatgggttagtaagggcttataactggccaacagaaatgaaatccctggttccttacttggcctcctttgacatcaccctacagggtgttgggttgcttcacttgagtctcaaaaaggtagaggtctaaactccccacccagactttgctgcatgggcgaatgtgagaccacagatttttctgtactttgactgcagtagagtggttattttctaaaagttatcagtcttgctatgttgatcctttcctgttcatttagatagagagagcaggcttctgttactttttttaatatgtatttttttgtttgcaccctttgtcccttctgtgttgctgaactttgtcagcttcaggttttggatatatgaaggtgtaggggttctttcagctgctaagtatgtctatgccaattatgtaggctggcactggggaaatgactggcctagcctcccagcctacatctttctcctgtgctggatgcttcctgccctcaaacattggactccaagttcttcagttttgagacccagactggatctccttgctcctcaagcttgcagacagcctattgtgggaccttgtgatcatgtaagttaatacttaataaactcctctttatatatatatctatctatcctattagttctgtccctctggggaaccctgactaataaagaagaagaaaaacaaaccaggaaaatgaagaatttaccactgtgtcattccttgcgtttcaactgttctatcgagtctgcctcttctctttacctttttagtctcctgatgtttgttttgtgtataatttttaagatattaatatgtttattacatataatatcttaaggaattatatgttttacattatatgttttaaggaacatatattttaatgttttagggaattaatatgtttattacagatcatacaatttaattatataatacatagtaattactactatataatgtccaggatatttaattgtacttagctagaggaatatctactctatcttcttagaaatgcaagccctatgtgcttatttttccacacataatttgttgacataaaaatgttatgttttccttccactataatattttctatcgatttattcttatatttatcaaagtatttatggtatatgtttttgcataatactattgtgcacattaatggtcagaactaaaatatcattattgtggcagttactttttatatcaatgaaagagttcctatctatgccatttaatgctttatatactgaattctacattgtttgaaactaatgttaagtatttgctttgttctacttaatatatatttgcttagcattttatgttcatctgttcaccattactttggtttttggaatcaatcttgccaataaacaactttatttcagtttttacattcatttataatacacttacaatttacttacatttacattcaggtaacatccataaatgtaaacatgtaattttcataagccataatcttacttttgacacttttatggtttttttcatatagactgtttaactgtatattcttttttatcttttgtattttttgaaagcaaaaacacgttaaattttacaaaaattatttaatctatattactctattgagtgaattataaatttacttttaaatagtttttggtaattatacatatgatttttatattttgtttgacatttacattaaaagaacaaatggatgctaaatgctcaagctaaaaatctctaccttaaaatatcaaccttgtactgcattatcaatttgtttttctctgtgtgacagaaatattagttgccttacaagaatcttccttcttttttattaatagaatattggttttgtttaggaagtaaatgtgtccacttaaaaatactcatcaaaccagattccattctacctagtggtagtcatgtgaggcagttccagtcatagaagtctatcaagtaagacatttgcaggagctattatttcctaatataaaatgaacggacttcactggcatgtgatttttgttctcatcaatcccttttttctgccctaagcacattcttggatgtgaagttcattgcctatgagaggtagggggactgttcacttgctaaaggtggcagagcaggaagctagaataaacttggtccttcatgatttccttgagcaactacaaggaaggacttcctatatcctaactttctgtaacatgatgaaaataaaatccttgtttagatggatttctattacatgtaaacaaaacgcaatactggctgatagcactggtttcttgcccatatcactctgatctttaaaaagttacatatatacaacaatcaaaatataaatatatatccttctatgatatgattttagataactaagcacttcaaatttgtaaagttactttgatttcgtatagcaaagaagaacccatgcttcctcgtttttttctgactcaaaaaataaaggttagaaatcattttatgtcacaattaaggataaaatccttctggatatttttattgtgttataaggcacaagctttaattacactattagatttgtctcttttcaaatgagcatatgcttctttaatttctatattcaagctctccttgaatgtagaataccaattatataaaataattgtgtgaactcttacaaggctcattatttttctgttttcataatattcttatactcattaataagtgcaatgttctaaaacatatatttcaaacattactaaataattatctccatcggttcatatttattccttctcaagagttatttttgttgctgtaaattaaataaaatacaaaacatttcaatgatcaaagaataatcaaaagaactttgcttagtggaagtaatgaacacaaatttataggtggcctcaaaaattgttattcaaacagatttctttaaatcttcacaactcataaaaatcatgtcagcatttggtatgcctatatctctttaagtcttactccatttgtgttaccgtccattcatacttcttcacaatgattttctccaattatttcttcatttatgacattttcagtctctttctctttctaatcaaaactcatttatcctcagtttataaatatggtaaattatatatttggtaagttaaagtgaggcaagtaccacttcactttaataaatctttcataaattctatttcctatagttaaagctttatttttcttctgtccaaaatattctcagtaaaggttctatacttggcagttatatataacccaccacaatttcatgtccaacaactgcaagctattgaaattctaaagatgcgacatcctctttaccataaaaaattcttccaatatgtttttttcttttctatttaattttttttttactcttacctgctgagatcaattatcctttatcttcattggttacactgctttctacccacaaaatgagacagtgccccaaggttgtgtccttagttttcagcctttattgatccctgtatttacctgagagaactaggctttaactatgaccccaagcaaatactcctgaatttacaatcaagtccagaacactatttctgaatttttgtttttcatttccaatgtctagttattatttcttctttaatatcctgcctcaaagaagtatgaccaaacttatcttttcaccaaaagtctttaagtgctgccatttctgttaaataagttcttttctgtcccagttatccagcttcaaaatagtagaggagtatttccacacttattcttctcctctttccacactcagtgtgaaaagtacactcaaatctctgcactgtctgtcatttgtgatgcaatgttgactgcagacttgttgaaatcccacctcatgactcatttgctgtccaatattgggtaagttcctaaacctcactatgcttcattttctcctgtaaaataagactaacatttttccacatccaaggaaacaatgaggaataaatattcttcaaaaaggccttccccatccaccctagctaatgtagcccaaatctctacccctttcagtctgtgttaatgccttactttcttttctttagcaactaacactagctgacattttatggttgtttagttttatttttgtttccagatttgtctattctctgtgcctttcccttggacttaatgaggacaagaattttgtcagtattatttaccactgaatctccaagtcccagacagtccttttcatatattaggtactcagtatatacttggtgaaagaatgaagaaataaaatgtataaagcgcctaccacaatggcattcactgaatatgtgtctgtcctctacactgtgttctttcttctttattactggtatctgcctatatcaatcctaatcacatcattttgaacctacagtaattgatccccttgccctcatttggcttctatcctccattaatctgctagcaaaatgttgggttgatcaccttttaaaaaccttgtcaataccatttattcatagagcacttactatgagggacctaccctaattttcctactcaaataatttcaattaatcttcattatattcatcaagtctaagctctttagtaggtcatccaagttctttctcaatgcccactgcccaactttccattacttccttaaatgaatctgtcacttcgattatccttaaaagggtcatgcctgttgccacctttcattatgccatactacgcaactgaagtacctaagtgaaattctttatttagggcccaggttaagatatcagacttaaatactaccttgttttttatatttttaactattagtacaaaattattaccaaaatcctaaatttttaaaactattacaaaatcactaatatgtccctaattaaaaaaattatatgcagtaataaaattcttccaactttgtaattttcagtttttccacgcataatcactgttcaatgtttatatattcttttagatatactcactgttcaaaattatgttctattcttcctcaaaatttctacacacatatatgtgacttcacatatctttagaacatattacaaacatttcctgcaacttattgttactatatcttgtacctaatttaaccccctcttttgaactcttaaatgatttgttctaatatttattcatgtgttataaagaacgtttccttatgtttttgtaaatccacttaattagtctgtatccgttaacttggtatcaacttttcacaatcacttcttctaacattttataaatcaatagataatgatggttttatcttgtcaaataaccaaatcaattgtgtaagaattaaatattttatcttctaataataatctaagtcatcctttaacgctcttaaaaaacattaagtatttctcaatggagtctttcatataccaaattctgaataaattagagatttactttcaatttaaaaaacaaaaatttgtttctctacaatttgatcatttcaggctttgtttaatgtagttggcatgcaaacttttatcaagtttcagatagaaagacattacaaatatattcattggtttatattattttatataaatgatgcaaaaatattaaaaagtttatataatttagatatagaactcagaagctaaaatttcccttttatacatttaattaaaatgaaaccctaaagaagccaattacctttctcaaagctgggcagaaattaaagaaaagtcgatggttacatgctttgaatctttcaggaagatgccagttctgaattatttcttcatcagaaatcacatgatgatccagcgctttgagaggccatatactgttaacaagaacatgtctatatccttttttaaggcttactggacaatcaaacatagtgagggcaatgagggttggacaggcagataatacacatatattctttaactttgcaaacccattgtcatgaagatagagtagttttaggttcttcaatccattccaaaatttggtatttggtagactctttatctgaaatattattaaaaatcttttaaattccaaaattacttttttcgaatagcacagaaaatggtaaaatattacacatataaaattcaatattccccaaatagcaagtttctaattaataagcaaacagagtatttataattatccaatgatggccagttgaaaaccataatacactgggtatctgagataatttattattattcgcatagtaaaatgcataaccatacttttttgttcaaagaaaatttctttgtaataggttgactctttaaacttttctaaaatactttccttacctaaggaaaattaaggaatcatgaggcattcttaatccaggctatagatttaagaagtgaaacataccagattacacactatttatgtattttcatttacatcaaagtgtccgtatttatatacatcttacatgcttttaatttattgttaaatttttgtttatattttagacaaaagaccatgttgaagaaatactgtggataggtaacataagtacttattataagactgaaatttcgtttatatgcaaatatctgaaatggctattgcttacctgatttccatggagatcaagtttgattaattttatacaactttgaagtggatgaatatctgtaataaaattgtttgagaagatgcatactctaagagagatgcaagactgcaaattttccatagactttaaatgaaggccattgaacttcacaaaaacaaaatctttttgaccttctcttatgttttcattatagtgactccattcttcatgactggttagctcttctgtgactgttccatgaaacatctaggaaagataagaaagtgctttgatttttttttccactttcaaaaatttacctgaaaacaaacaaaattttgccaagagatagcgcaagtaaaaagtgttattaaagttaaaatttaaaaaaactcattcttatagaactttctatcccaaaataacttaaatatctaacatttcaataacagccaatcagaatgttatcactgccctcaccagtgaacgaactaattagcaagaggaagacaaacttccattttcatagaatatttgaaaaattcagtgaagaaactgagataaaatcatcccttctagacaagacaactaacaacaaacaaatgaaaccatactttatataactcgtatgataatttttgttaaaatatactgttaaagaaatacactgaataataaacaagtcaggagagtgataatctttgttaaagaggctaaacaatgcagccagataaaataaaggtgctatacaggccttcaaatgttatcaacaatatttgtgtcttacagagaaaatttgttgtcaaaatatttacattcaattcaattaggaaattaggctcagaattctaatagctttaaattttgactacttaaatttatctaaaatatttggataaatggtttttaatataattttacacagtatttctcatatatgtgaattttcacttattaagagtaatttcagctttcataaaaggtagtcagtgataggtgagaagagaatgtatgagctgaagtggtctatttggaagtatgttttaagatcaacattccccaatggaagaatcgatttctacgatgtgcagataaactaaatcagtgtgattcaaatgagaataaatgtgaaaatccagatacactcttgtactctttcaagacactggttactttatatatcacaaccaaggcctaaaactagaatcctccagctctaagtgtcaatgaattaattagaaggcagattcatgggccccatctcatatctactgtatcagaatttctgggctaagggcataggaataatgttaacaggtgatcgacgaacaccttatgaaagattagcctcaactacaagtaaaccagtcttaaaaatatagagtcagatatggaatacacagatataaataaacctttacaaattaaactcatgaagctctattggtgctgggatgtaggataatatacacatcatttggacttccaaaatagaaaagatataagtctttcctcatttaaagaaagcttaaatttaaggttcctccaagtctttagaaaaataactcattttttaaagtactgaataacattccatcgcatggatgcactatggtttggtttatttatccattcacctattgaaaatgtcttggctgtttccaactttacacaattatgaataaaagtgctataaaaatttatgtgcaggtttttgtgtggatatgttttcaacttacttggataaataccaaggagtttgtttgctgaatcacataatatatttcattttgtaaaaaactgctactgtcttccaatgtggttgtaccatttggactcccaccagcaatgaatgagagattttattgctccacaacctcaccagtacataatgttgtcaatgttttgattttggtcatattaataggtgaataatggtatctcattgctttaatttgcaattccctaataatatatgatgttgagcatctttcatacatgtggcttattagccacatgtatatcttccttggtgagttatctgttcagatcttttgtccattatattttgattgtggtattgtgttattgttgagtttgagtactttgtattacttcagataccaatcctttgtcagatatgtgttttccaaagtttttttttcccattctgtggcttgccttttcattttcttaattttcatttcatttttagctcataaatgcataaaaagtccttgaaagggccgggcgcagtggctcacgcctgtaatcccagcactttgggaggctgaggcgggcggattaccaggtcaggagatcaagaccatcctggctaatacggtgaaaccccgtctctactaaaaatacaaaaaattagccggacgtggtggcgggcgcctgtggtcccagctactcgggaggctgaggcaggagaatggtgtgaacccaggagcgtgcactccagcctgggcgacagagcaagactacgtctcaaaaaaaaaagtccttgaaaaaccaacaccgatcaacatggaacctcagagatctcatttcttcacataatgctaaaggtggctttatactgttaatcatggcattagtacacaaattatatatatgtacacaaaattatatatataattatatttaatatatagctatataaatatatataaatatttttatttcaaaggatttatttctcacattgattattccatctcttaacagtctattttgaaatttctttatgaagatattatcttcttcctggcatttattttcagggattctcaacagtgctattaatcaaatatagttagtaatgtctatagattcatccaccaggaataattgtttattttaaaccttctgcattaatgctatctatatgccatttgaacatgccaatgaactactaatggtattattccaaagtggagttttttctattttccttactgatctcagatatattagagaattttccaaaatgagaggttctacacttgtgtgagacattcaaattttagctattagatgaataaccttgttagtagctttgtgacattaacaaatactgttgtaatgaacctgataaaataacattgtcccctcccaccaaaattcttaaatatgttcaaatatttttctacataaaatttgtaatatataataagggaattggtatgattggcactattgcctcacttgaaaacttcttgtaaataagacatagagtttgaggaagaaatgaaatattggttcacacaaatccaaatttgggataatgctcatgatattacttaattcaatgccttttttttccattttgtacaacagtttacttttcagtttcaatcaaaaagatgtctattagaaaaaaaattgtaagaattaagtactagtgtaattaaggatatattaaattcaaatttgagatctttttgatgttacttaatgcagtgtcttttcctccattttgttcaactgcctactttttagctttaatcaatgactattataagcaagaaaaaaaatcactaatcatcagggaaatgtaaattaaaaccttactcctgcaagaatggccataattaaaaagtcaaaaaacaatagatgctgtcgtggatgtggtgaaaagggaatactgctggtgggaatgtaaactagtataaccactatggaaaacagtatggaaattccttaaggaactaaaggtagaactaccatttgatccaaaaatcccactactgggtatctatccaaaggaaaataattcattatataaaaaagacacatgaacatacatgtttatagcagcacaactcacaattgcaaagatatggtacaaacctaagtacccatcaactaattagtggattaaaaaaatgtgagagagatatatagatatatatatataggtatatgtttacacacacacacacacacacacacacacaccatggaataccactcagccacaaaaaggaacaaaacaatgtcttctgcagcaacttggatgtagcccagaaggctattattcaaagtgaagtaactcaggaatggaaaaccaaatatcataagttctcacatataagtgtgagctaagctgtgaggatgcaaaggcctaagaatgatataatgtactttgaggactcaagggtgaaggttgggagggtcacgaggtatagaagactacatactgggtacagtgcacactgcttgggtgacaggtacactcaaatctcagaaatcatcactaaagaacctatccatgtaacaaaatagcacctgtaccccaacaactattgaaataaaaattaaaaaacaacaaaaaaagtcaaaaaataacagatgctggtgatgtggagaaaaaggaacgcttatacattgttggtgggagtgtaaattagttcaaccattgtggaagacagtgtggcaatttcccaaagacctaaaaacagaaacaacatttgacccagcaatcccattactgggtatatacctaaagcaataaaaattgttctattataaagacacatatacgtatgttcactgcaccactattcacaatagcaaacacatggaatcaacctaaatgcccataaatggtagactggataaagaaaatgtggtacatttacaccatggaatactatacaaccataaaaagaatgagatcatgtcctttacaggaacatggataaagctggaggatattatcctcagcaaaaaaatgcagggatagaaaaccaaatactgcattttctcccttatatgtggaagctaaattatgaaaacacatggacacataaaggggaacaacacactggggcctactagagggaggagagtgggaggagggagaggattaagaaaaataactaatgggcactaggcttaacacctgggtgactaaatcaattgtacaacaaattaccctgaaacaagattacctatgtatcaaacctgtacatctatccctgaacttaaagcaaaaatttaaaaaatccaaactattaagaaccctggcttcttagttaatgaaatgtgctaacctgctatcttaggatgttacacttctctctcagtgtaaccttctttggcaaattattgtctagtcattatttagactctgattctatccacacatccccaatttagtgattacatatttatatatgttattatttaatggccctgttttccactaaattatatgtaccctgtgaacagaaaacttgttttatggttaggtagtttttcaaatttttccataggacctgaactagaactgagtcaggtttcaataaatgtctctttcatacacatgtctgtcttttcctttcctcagagaaacagcaaactatggggaaggaacctgtaaaagacttctaagtacaaatgacaaagtctctcccatttcggtagaaatctattgtaaattcctttatttttaattctccacagccaataatcacttgcaaaacaacaaaaaaggtttatttttcaattatttatgtagtgtaacaaatcactccaaaatttattggcttaaaataaccatcattttgttactctgaagattctgtgtgttgactcagttgaagtaagcagttctccaactgacagtggctgaagcatcagttagttcactcctccagtgaactgctggaaggttaggttcagctggaatgctgagatgaaccagtctttctttccatactgtctcaggacctctctatgttgacctgtcctctccatgtcatctatccatgtgtgtctgaaatagggtagccagactttctacatgcttaagggctcccaaagcataaaagcagaacctgtccaaacttcctaaggcttaggttcaactgaagcgtctcctcagccacattctactggttacgacaagttcattttatttttcaagcaccctataaactaagtacagaaaaaggaaatgaaatgtaagttgttctgagattggtgatctcaagtaaattatgtatgctgtgcctcagtttccttatctgtaaaaagaagataataataacagcccatagaatttttatgaggacgaaataagtcaacctaaagggtttagaacagtgtttggcacttaatgatatggttgggctgtgtccccacccaaatctcatcttaattgtagctcccataatttccacttgctgtgggagagacccagtgggagataattgaatgatggtggcagttttctccataccgttcttgtggtagtgaataagtctcatgagagctgatggttttataaggggaaacccctttttctttgttctcattctctcttgtctgctgccatgtaagatgtgacttccaccttctaccacgattctgaggcctccccagccacatggaactgtgagtccactgagcctctttttctttataaattacccggtgttgagtgtgtctttatcagcagcatgaaaacagactaatacagtaagcactacaaaattaattgaatgcctagttccattaacaattcaagataaaatatatgcttcaaaaagtgtatcaagggacctgcagtttccagtatggcatgtaaggagcttggagtagtcactccatcctaacaacacattagaaagctgaacaaactaaaaatcaacaacttttcttagctacacaaagtaaggtcatagggtaaactgctgaccacaaaattggagcaacagacaggcagtacagaaactcatcaggaacagacacacagatgtcagggatgttggaaatatcagactgggaattgaaaacaactaggattaatatgctaatggctctaatagaaaaagtaggcaacatacaagaacaaatggataatgtaggtagagagatagatattctaagaaagaataaaaaagaaatggtagagaccaaaaacattataacagaaatgaagaatacctttgaagggctcattagtagatgggacatgactgataaaagaatctctgactttgaggatatgtcaacaaaaacattcaaaactaaaaaccaaagagaaaaaaaaagactgaaaaaaaacataacattccagaagtgtgggacttctaaatgtgtaacatacgtgtaataaaaatgccaaaaaaggaaaaatagaaaggaataaaagcagtatttaaaacaataatgaatgacaatttactctaacatcggacactaagccacagattcaagaaacagagaacatcatgtaggataaatgtaagaaaataaaaaaaaaacaacctcacacctagataattaatatacaaacttcagaaaatcaaaggtaaaaaaaaaatcttggaaaaagccaaagaatttttaaaaaatcttacttataaaggatcacagataataacgacatttgatttatcagaaaccatgcaggcagaagatagtggagtgaaatatttgaagtgttaagagaaaaaaaactcactgacctagaatttataaggggaaacccctttcacttggttctcattctctcttgtctgccgccatgtaagatatgccttccaccttctgtcatgatgctgaggcctccccagccacatggaactgtgagtccactaaacctctttttctttataaattacccagtgttgagtgtgtctttatcagcagcatgaaaacagactaatacagtaagctctacaaaattaattgaatgcctagttccattaacaattcgagataaaatatatgcttcaaaaactatatcaaggacactgtatggtgcaaaattattctttaaaagtgaaaaagaaataaattctgttagataaatattgaagtaatttgttgttggtaggcctgccttgtaagaaatgttaaaagaagttctgagagaagagaaatgatataggtcagatactcatatctatgttaagaaagagtgttgggaaaggaacaagtgaggataaaataaaaatctcttatttttcttattcttagttgaataatttgtccaaaataataatagcaactagttttattttaattcatccaacaacaacagaatatacattcttttcaagctcacatggagcattcactcaccaagacagaccacattctgggccataaaacatgccttatcaaattcaaaagaacagaagccatgcaacatcttctctcagaccacagtggaattaaactagatatcaataacaggcaaacagctggaaaattccaaaatacttgggagatttataaacacacttctaagtaacacataggtcaataaaaatttaaagatattttgaactaataaaaataaaatgtaaaatttagcaaaatttgtgggatatagtacaagcagtgcttaaaaggaaattcatagcactgaatacatatattagaaaagagcaaagatctaaaatgaatcatataagctgccatttctagaacttgaaaaagagcagcaaatttaatccaaagtaaatatgagaaaatttttctcatatttttcaagaaaattgtaattcttaattatattctcaaatattctgggaggaggggcatattttatcatcatctcattccagaagagtccataaagatctatagtctctataaaaaataaatactctactcagattatatgtaggttcttctacaatgtaaagcatctaaccattaacctgtagttcacatgtttagtgaagagtggggaggtctttccatatactcactgtggttacttttaccatgcaataataaatctcactccaaaatgtatcctttccttatctgttaggacattcagagttaatttttttccaacttttattttagaatcagggagtacatgtgcaggtttgttacaaaagtatattgcataatgctgcaatttggagtatgaatgaatttgtcacccaagaagtaagcatagcacccaacaggtagtttcttttcagcccttacctgtcatcctctctcccaattcttgtattcctctcaaataccaaatcttatccgaaatatgtgtctaaaaacatatttttcagttcctctttactgatttttgtttcatatgtattcaatattttaaaatcttctcaactggtttctttttagttgatgtgatatgaacactaaaataatttagtcttataagcagtcttccccatacactatattaatttacattcattttctctattaatattcacctctgccaacaatatgtatttgccagtatataaacaaccttaatatttttaaaaattacaaaacagaacataataatactggttattgctattaaaaggaaagattaacatgagtaataaattacagaaaaaactagtattctatattcagaatataacgtatgtgtcagttatttatattattcagctacatattctgtcgaactttccaatcattatggaaaagtggggatttttcatattttgttttaactaccacatgcagcatttcaattttgtttctcattatttatttatgttgtacatctgaaaactggaataactcaaatgaccaggccccagagcatgtcccctgaatcatatcattgcagctatgggcccatatgattctactgcctaccaagggaagctaaaaaccactacaattgatatatcctcctctaccaagttggaagccctttaccacttgttgcaaatttaaaatatgcacatagaggaggaatctagtcactttcattcattttagactttgataattttataactattttgtgaaatgtatatacacatttgtaaattatcaagttcaaataataatataatgttcaaaggcaaattaagtatagcaacacgttacagaacgtatcaagtctccaaccacagtttcaaagaaattctgcagttaaaaataaatcagtaccattatcagcaaacctttccttagtttgtatcaactaaagtaccaatttaaaaattatcctacattttaattgcactatataaaccatgtctataaaataaaatgcacatcagttatatctcatcttcacacccaactttgatggcaaacacattaagtgtaactatacaaggttataactcatgaatatttaaattaaatattaagaagtaaaaactatttattttgtatatttatttcttttccaaatgtgatacataataaatattgggaaaaaagttttcaaagaaagtctttgctgagtgtactaattacctttagacttaacacttattcactgaagctttcagatacttggaagacagatcatcattattttaagtaatatattaaaatattagatttgatggtctacatgaaagtaatttattttataagcatgaactataatattagatggaaatctgaatactagactccagaattatcacaacagctgttatctgcatataaaatcaaatcataaaaaaagaataaaaagtcttagtttttagaaaatctaattgtaaggattctaatcagtaacattttatacatattgtgattacaaactatttttagtttagaatgtctgcaacatattaagtgcatctctattaacaaaataaagaaattatattttttaaatactttttatttggataacagatttgttaagtaacgactgttttaataaagaattgccatgggccggtgcagtgactcatgcctgcataatcccagaactttgagaggccaaggcaagagaatgcttgagtccaggagtgagctatgatctgccattgcactccagcatgggtgaaaggttgtctctaaaaataaaaatcctgtctctaaaaatataaaagaattgccataattttatatcacagaaaaaatatattttaaaagttaagaaggggagagtctagtagaacagtcagactagtacatgtgtcctggaaaatgaacacagaatatagtgcatttataacttaatataaataaccttggtagcacaaaacattatattttcatggcatattctatatgttttcaaatgacatgaaaagtcattcagaacaaggaatcagaattcatttgtaattataactttttttctttaaatatattggctttttgaattttagaaggttatatacttctgttcagaaaaaaagcttttgtgagacctcatttttcaatttttatttttattccaacttggagactgcaaaagcataagcctgaaaaaactaaaaggtggtgagccagaagatggatattaaacagccaaaattaataaaaacattcacagaaaataatctgcacagaaatcacaacctcttaataaagaaattagcacgacaaatatttcttctagcccaaaacattccttggttagctttcatagaacagattttggatctcctaaaattaagccattaatacctttttcttaagtgtcataaatattgtattacattaattaaaatttaattcttgactctactaatttatattcttcaaccacttgccctctccctatccctttcccctccccgaaacctcatcctggtatttggacaaagtagattatgattacactactggggaactccatttggaaaaaaaatctacaaaaatactaagggaggaagtataataaaagttcaggggtgggagaatgtttctctgcactacagaaagttgaggggtgtgagggttcctccaacagggcatagtgagaaaaaaaatatttaagaaataaattgagaacaggctagctgagtaaataaatcgaaataaaacaaactgcaaaaagacaatttttgctttcgttgcatgtcaggaagggtaacaggaggaaacagtggttaaacagagccatgaagcacaaggactggaaacaagtacagccctagcttggcctgaccacagcatgcactacgagctccacagtatataatccaggaccctattcatttggcttcaacttcctcatataaagaaggggggaaaattaaaacattcttctctataatttccacacaacagtcatagttatatgcctgtagtaataaaaaaacagtgtaactggcattaactgtaaatgggttggaagacattttaatggggggatgaaaatgttctaaacctgtacctcaataaagttgctttaaaaaatctatctcattcttccttatggcagctcttcagatactctctactctcctcctggaaataaaaagcccaaatgcctccacagaatataatttttcaatttattatagtctagtatgttcaacatctttttaaaaatgtggaatccaaaactaaacagattatttcctgtgtgtttgatttgtgcagaattaatgggcttacagcttggctggattgatatattttactctggtaaaatgacattctgataaatacctggaaaaactctgtggcgaattctctagtataataatactctggtagcttaagatgttaaacagtcatatcacactgttttattatagtgaatatgaacttaaataaaatccctaaactttttttgcctccaacaatcaactgccacggaaatttactcctactcatatatatagtattttttaattttttttttactaaaaattaatattaatgaaaatttgagaaaagaaagaaaacagaagccatagctgataatatggtatatttatttccagcaaattttgattgcatgatatagtcatattgagaaaaaataatatccaatttctatggccatccttcccagatccaagaaatactctaatattctgtatgataccgtcctagatccaataaatactctatttaatattctgtatgatagaatctaacacatcactctgtttgtctcctcacaattgttaccactggattttttatttggttacttcttccttctttatttcaccttattagaatatacagaccccaaacatataggctctgctgaccttcactcccttgggacctcacttagttccacagttaaaattaattctatcttcttgctgacaattcccaaaattgtatctctagcccagacctctctcctgaattctagactcgtatgtataatgcatacagacacatacacacacaaacttccattacatattcactgcatacacatgtctctttattccacatgtccaaaatcaaattctggaccctattaccccaaaaaccttcctcagtcggaaacttacccatcttaattgatggccaatccatcccaaggcagtcattttgactcctctttttctcttacagtccacacccattaattccatcagcacattttattgtttttgtcttaaaaatatatccagaatctgaccaacttctcaccattcccactgctaccatcctggtcaagccttcaccagctctcacctgcaatattgcagtaacctccaaagaagtctccctgcttctatcattgcctcatcccccattataatctattctcctatctccgagtgatctctttaaacataagccaagtcacttcaaaaccctgcaatggctttgtttccctcaagagtaaaaaccaaaattcttcctatggccctttgttctctctctgaccttctctcgctactttctcctttggttactttcactcaagtctctgtattttctaaatgttcttcaataagatactgtttttttaattaatgaagttttaaatgtaaaactatgaaagagtaatctaatctgccattttatccaaatgtttccactattagaacacgattgtataacaagtctgagaagaaaaactaagtaaatttatgacaagagtttatggtgccctgaatgtctacgtacctaatgaagacgttgatacagagaaatcgtctcaaaaaatcaaacggtatggtgaaataccacaagttctgggtttgggattgaaatatatttcttaaatcttttattacttactaattgtgataccttgactaactcactattctctgattcagttttcttctgtgtaaagatgaagtggtctgtaaaaccaagaaacctcgtgttctataacaggaacacctttatatagctacccaaaaaaacacctaaaaaggctgacttattcctaagagtgttattgaacattctagattaatctgcatatacaaaagaatgccagagaagaaaccaaaataccaaaaatatttggagcctggttgcggactgaattttatacaactttcaaagacactatttgagaggctgtcgtgtgtagcctactaagaaaaaacagaggggtggggtggctcactctctaggaaccacaaacttaaggttcctagaaagagcagagattttaaatattcagactgtgtatgtatcatgacccagggttgggggcagatggcccggggtggcgggggaaaggagagatggcggagatcttctatcaggctatcctggggaactgctccaggctgaaacaaaccaccagttaggacgaaccgcctttgatgtgaaagctgggaagctagaatgtagtttcgccttatccttagcgggtcggttctaacaattttgtcacccaaactgaaccactcaccgggtcaactgggctgcaagcccttatgagttggagacaagtggcccagccccaacacagtcagacaaatcgctgggcggccatctgctcctgagaccgttgctagagaaacaagacaacatccaagttctccacatcatggttttccgggcgccagccaaggcgctccgggggcgtggttacgtgggcgac

SEQ ID NO: 2015 - DNA, 66859 bp, Homo sapiens
cgcaggcggaagggcgcggaggaggtgacgcgataggccagcgccggcgtcgcggcagccgcttcagaggaagctcggcggctgtggccgcggcgaacaggccggacgcctcgtcgctggcggggcttcccttggagctgacgaaggcggggtccgcggtccaggctgctgccgcgacggggccggcggcggggcagctgccaggaacgagggtagcaggtaagcggggacgcgggcagacgagtgacggactcagcgatcgcctggcggggctggctggggccattcccgcgccggtgcgccacctcagcgcccggtccggaggcctcgagccgccctcccccgcccgagctggaggccgccgtccgtctcggccacagcctccctttccgggggaggcgagcgagctcgtcccgaggggccgctgccctgcgctctcgctccagccgggctgtgcgtcgcaggcaccgggaagctggcgccccccagctcctcctgaagccgggaaagctctgagaggaggagccgctgtcacaggcctccagctccggccgccgtggaagtccggggtttttatttgcttagaccgctctgcctccttccggccttcgtttctttcctcgcgctccccgggacccttttccagagagcccggttgggcatgagcgcggtgggagacgtcttttcccttcggtctgctctgagcggtatcagcctccgctctacgccctgtggccactctgtcggggtggagggatgcggagaggatgtgggagttttggacttagagcgagaatagccgaggtgaaatcctaccctgctctctggtagtgtttttcatctcatgctagatagacatttcgacctttttcaccgcaggtaaagtgggactttcttctaccaatgtaaattataatgtttggagaattaaatgaagaaagcagacgttagttatgaaatgttttgagaatctggttaaatttaatttaagaatatccaggacacttcatgataggttcctacttatgttttttttttgcattttgcccggaataactaagcttggtatggaaaaggttgcctagagatgccaggcgctcgtgtggtcagagcctaactgcagtctctgttttgggtgggcagcatcaggaagaaaccagactctctcctagccatccacatgtctcacgcttattgatggcatattattggtatatgagggatggcttatatcagttttgatctttactcaagatagctttttcccagtgcatcttttctaggagaaaagcttggtatgtagaggagggtgctggggaggggggcttcatttacacctgggctcacaatttttttttggaggggggacagggtctcactctgacacccagcctggagtgcagtggcgcgatcttttcagctcactgcaacctcctcctcccaggttcaagcgattctcctgcctcagcctccagagtagctgggattacaggtgcccgccatcgcgcccggctaatttttgtatttttagtagacatggggtttcaccatgttggccaggctggtctcgacctcctgacctcaagtgatctacctgcttccgcctctcaaaagtgctgggatcagccgggcgcggtggttgacgcctgtaatcccagcactttgggaggccgaggcgggcagatcacctgaggtcgggagttcgagatcagcctaaccaacatggtgaaaccccatctctactaaaaatacaaaattagccaggcgtggtggcgcatgcctgtaatcccagctactcggaaggctgaggcaggagactagcttgaacccgggaggcgaggttgtggtgagctgagatagtgccattacactccagcctgggcaacaagagcaaaactccgtctcaaaaaaaaaaaaaaaaaaaaaaaaaggtgctgggattacaggagtgagtcactgcgcctgggctatattactttctaaatcagcctttttttttttttttggtaggccattatgtgaatccttcaaaaatcatagaaaaattgaaatttaacaatattttgcttttattctagcttgtcataaacccagtgctctatacacaggcctgcctttctgcctccttcatcctggcatgcatggccatttactttgtgttattagccagcttcctatggagctcagtttgagaacggggttctgtgcttctctagttgccaaacatctgattgaagtagatcaccttggcatttgcgatattaagcatgtctttgcgaatttttagttcctttttcttttcttggttagattgtactctgtcactgatttaaagaatttggtagacgctcagaaagggtcaactggtaaggtggtcacagtgctttacatgtatttttcttacctattatggtgaaacccttgtgactttttttgggcgtgggtaatattttcaaaattaaggtaaataggccatcaggctgcgttgaactttctcttttagggaaatatattcattctccaattattctttggtagccttcttattgctttagcaattcctactctattattagtagagccggaaatggaccctacatcacagattctccaaatatactaaattattttttctctaaaatgatcatgtttatagcatgttgattttctttttttttcttttgagacagagtttcactcttgtgcaggctggagggcaacagcttgatctctgctcactgcaacttccgcctcccgggttcaagtgattgtcctgtctcagcctcccaagtagctgggattacaagcgcccaccaccacgcccggctaatttttgtatttttagtagagatggggtttcaccatgttggccaggctggtcttgaactcctgacctcaagtgatctctccgtctcagcctcccaaagcgcggggattacaggtgtgagccactgtatccggtcagcagcatgttgattttctacaaccagatgacaaaggatatcctaaagtcagtgatttaaaaagtcatgttggcttggtgcggtggctcatgcctgtaatcccagcactttgggaggccgaggcgggtggatcacgagtcaggagttagagaacagcctggccaacatggtgaaactccgtctgtactgaaaatacaaaaaaattagctgggcatggtggcgggcgcctataatcccagctactcgggaggctgaggcaggagaatcgtttgaacccatgaggtagaggttgcagtgagccgaggttgcaccattgcattccagctttggcaacagggtgagactctgtctcagaaaaaaaaacaaaaaacaagtgatggtaacacataggttgtctaatacattcagagtctagagagacctggtatgtatctgagaaaccaaatagctgaatctctaaaattttatttttgtgtctggaataccttaattctgaagttttagttgttgttgaatttcacattctgacaggagacaagtagaggtacatgtgaagggttagtatgaacccagggttacagtttcaatctaaactgatactgcagagttaacattgaaacaaagcagctctagggagctggcaaaaattgaaggttagaagtcacttgctggctcttgaggcagtcttctgactctgaaactacttgagactaaaattttcaagaattttttaacttaattttgtaaagatataatttacggcctggtgcagtggctcatgcctgtaatcccagcacttagggaggccgaggtgggttgatcacctgaggtcaggagtttgagaccagccaacataatgagaccccatctctactaaaaatacaaaaattagctgggcatggtggcacacactcgtactcctagctactcaggaggctgaggcaggagaatctcttgaacctgggaggtggaggttgcagtgagtcgagatcaggtcactgcactccagcctgggtgacacagtgagactccatctccaaaaaaaaaaaaaaaaatacagtcaaatacatagaccttaagggtttttattttttaaagcatatgtacacaaaatggaagacagaaaaatagcaaaacattttggaagctggaatgcagattgatttaagcagtctgcccgccttggcctcccaaagtgctgggattacaggcgtgagccaccacacttggccgatataactttttcgtagtgaagcttcagttaacctgtacggtggctgcgctgtgaactttcacccaaatattgggctccttaaggggctgtttaggcttggggctgtcctagggtcggtgagtatctagtaagagtgtaaaccttctatttcccttgtgtgcgtgttttatctttgaaggaatgttgatatttggtcagtatgaacatacagcagcatggctgggaatacaggggcagaaatgtaaaggaaacgcatgtgaagtttgcttttaattactggaccgttgtattcaagaaccttcaatggcagtatcttgtctttgctccagggtcagattccctaaagaagaagggatctcctacttggagagtacaaattgggcttccagcagtctggcttctatacttagggaaaggctggaggtcttagtattcgttatgtaaacactcattcttgttcatttaactcaactattttcagtaagatgacctcattctcaactggaccagttgaaaagctttccagtccaggaattctttgtttttacataggattgttttaagctgctacgtgtggttagtggctaccatattggatagcggagctgcactatccagtgtggtagccactagccacatgtagcagcctaaatctaaataattaaaattaaaggtttagttcctcacttgcactagacatgtttcaagtgctcaatggccacatttgcccagaggctaccgtattgggcagagcagatatagaatatttctgtcattgcagaaattttattgggctgtgctgttctagtctagagaagaagactccaggtgtctgcaaggatgggtaggggacagttggctggttttgtggcatgtgggaggatatttaaatcatttgaccaatccttttatttttagcgtcatattcatattcacatccctctgtagaacaattcctgacctgttttgaggtattgttctttagattgctttcctccctgcaagcttgagatttaactttttttttttttttttttttggagacggagtctcgctctgttgcccaggctggagtgcagtggcgtgaacttggctcactgcaacctccacctcccaggttcaagcaattgtcctgcctcagcctcccaagtagctgagattacaggcacatgccaccatgcccggctaatgtttgtattttagtagagacggggtttctccatgttggtcaggctggtcttgaactcctgacctcaggtgattcgcctgcctcggcctcccaaagtgctgggattacaggcgtgagccaccgcgcccggccccagccgagacttaacgtctttagatctttaagtcaatccacattccaactttcaaaatgtttttgctgttgttcggtgttccattttgtgtacatatgctttaaaaaaacaaaagcccttcaggtttatgtatttcactgtaggtaaattatatctttaaaaaattaagttaaaaaattcttggcagccgggcgtggtggctcacgcctgtaatcccagcactttgggagtctgaggcgggtggattgcgaggtcaggagatcaagaccatcctggctaacacggtgaaaccccatctctactaaaaatacaaaaaattagccgggtgtggtggcgggcgcctgaagtcccagctactcgggaggctgaggcaggagaatccttgaacctgggaggcggagcttgcagtgagctgagatgtgccactgcactatagcctgggtgacatagtgagactccatctcaaaaaacaaaacaaaacaaaaaacataatttaattttaattagttatttaggaatgggtcttgctgtgttgcccaggttggtctcaaattcttgacctcaaaggatccttctgcctcagcctcttgagtagctgggattatagacatgcaccatggtgcctggctggttttttcttttaaaaaattaatttattggctcacacctgtaatcttaggtactcagaaggctaagtcaggaggattacttgattgagcctgggagtttggggcttcagtgagccatggctgacagaatgagaccttttttttttaaaaaaaaaaaaagataaaggacaatttttttattcttaatgaagttttaagagggaatgatggtaaaatgtgtctgcttaatctgcagtctttatccagaagtaaagtgcttcatcagaatttaaacatgtataagaatctccactaaaaaaatgtttgagctttacccaggcttcttgaacaatttttatatatcgccttttttgttccaccttggtttttgtcctttccattgtactaaaatttctcctgcaaatgtcaagagaattcagtgaacacttttaatccttatcttgctcgacttctcaacaacctttaactgaccatttccctctttttagaaacctgttctagctttgctgataccacctttacctgatttttgaccttatctccctggtcattttttttcactttcctttgcttagtctttctttatttcttaaatcctggagttccagctgggcacacctgtaatcccagcactttgggaggctgagttgggtggatcacctgaggtcagaggtcgagaccagcctgaccaacatggagaaacccggtctctactaaaaatacaaaattggctgggcgtggtggcgcatgcctgtaatcccagccacttgggagcctgaggcaggagaattgcttgaacccgggaggcggaggttgcagtgagctgagatcgtgccattgtactccagcctgggcaacaagagtgggaaaaaaaaaaaaattcctagagttccttgggctattgccctagggtacattctctcattctcttctaccttttacaaattctttctaggtgatcttatcattttctatagctttggttactctaagctgaaaactggaattcacatgatgtcctcttttcagaattcttgaactgtatatctagctgtatatatccacttggacttctaatggtcatctcaaattgaacatgtgaaagactaaaggcatagtcagtataaccttcccctaatcgatctccgtctgtgtttcgtatcagtgataccactatctacctagtagctgatactggaacatttacccccaacagataggcttttgacaaatgacaagtcctgtcatttctgtgtcctgaagattgattcactttgctacatcctcccagtttttctcttaatccaagaagctgtcccactgtatctgcattgatttacctgtaacagattcctaatgggtttcttctgctgtggccttctccttgccattctgcacattgcaggtagaatgatttttttcaagaatatgaatcagatctttgtctttcagtggcttcacaccaaccttatgttaagtgtcagcatcgtgaatttagctcttctgttcctcatctaccccttccgtgcctctaagtgttactgaagttctttccattccttgaaatactgaattccctctctttcctaggaactcttgctcatcatttgtctcagctgaaaaataatttcttcagagaaaaaataatttcttcagagaggtgtttcctgacccttttgccagatatttccattgtaccctgaatttgactttttttaatttttattttatttttttatttttttgagacagggtcttgctctgtcacccaaactagagtacagtggtgtgatcatagctcagtgaaactttgacctcccatgcccaagcgatccttccacctcaccctcctgagtagatgggaacacaggcatgtaccaccacttttggctattttttttggagacaggatctccctgtgttgcccaggcaggtgatcttgaaatcctgggctcaagcgatactccacctctgcctcccaaagtgctgggattacaggcataagccaccatgcctggccaatattggcagtataccatagtaagcgtttatttgaattacatgtttatttcatattaagaagtttgtttatatagaagtgatttttccactgataaagtaaaatatgatattctaaactagaggttcccaaactttctctgtttacaccctccttaatatattttttacatgtccctaagcttaacagtttgatttattaaataattaggttcagacagcttaagaagtatttatgggccaggcgctgtggctcacgcctgtaattccagcaggcggatcatgaggtcaagagatcgagactatccttgctaacacagtgaaaccccttctctactaaaaatacaaaaaaaattagccgggcctggtggcgggcgtctatagtcccagctaggctgaggcaggagaatggcgtgaacccgggaggcggagcttgcagtgagccgagattgcgccactgcactccagcctgggcgacagagcgagattctgtctcaaaaaaaaaaaaaaaaagaaaagaaaaaagtatttatgttctttcaacctaattgacatctaagaaatacacaaattggaagacaaagtcagatagatgtgatggctcgtgtctataatctcagctctttcggtgggcggatcacttgagtccaggagtttaagaccagtctgggcaacatagaccgtatttctacaaaaaaaaaaaaaaaaattgccaggcgtggtggtgtgtgtctgctgtagtcccagctactcaggaggctgagggaggattgctggagcctggaaagttggggcgagctctgattgcaccagtgcactccagcctgggtgacagagtgagacactctcaaaaaaataagaaagagaaagacaaaattacattttgatttcattcttaaataaccacagttatttaccgtatatacttgttgggcactacaaaacccaaaccgtggaatcatattggactctgccacccacattgcttactttttaattaaaacaaatttgcttttggctgggcatggaggctcatgcctataatcccagcactttgggaggttgaggtgggaagatcgtttgaggccaggagttcaagaccagtctgggcaacatagtgagaccccatcttactaccttattttattttttttaatttttaattttaaatatttatttagagatggagtctcactgtgtcacccaggctggagtgcagtggcatgatcttggctcactgcagcctccactccctggttgaagcgattcttctgcctcaggctcctgagaagctggccattactggtgcccaccaccacacacggctaagttttgtatttttagtaagagacagggtttcaccatgttggccaggctggtctggaactcctgacctcaggtgatctgccctgctcgaccttcaaaagtgctgtgcttacaggtgtgcgccaccgtgcccggccactatctcgctattttaaaaaataaataacatttgtttacatctttgttttctccactcattttttgctctaaattgatatttgcacagtatttttttttaaatcacagcaaccaatagatactcagctttgcaaagattatgatatcatcaaaaggaacatagtgtgatctattttgaagctgaactgtcttgaactagtagtttataaggtgtttgacaagtatagaagattactttttccctgtaatttagaatttcctgttgtgctctcgtgagttctctacagaatcccaggttgccttgggcacagtttgggaactgtgatcctaaacttttgatagtttggtgtatatgcttttagacatttttctccaaacattcaagcatatgcatatatttttccttttaacaaaagtgggctggtacatattggtcagcaacttcattttttccattcagcagtgtatcatggtaaaggtggtggattgaatatatacgtttaattttatgccagcctgaaaatttcattaaaacaatggaggacttaaaaaccctctagataacaaagaacaggaacaatgagaataacaacaatatcgtgaaagctggaaagcagaaaagactaatggcaactaattcgccaacttgagaaagctgtatcctaaaccaacagtggagagagccttcaaatagtcatgttatgttaccaaaccctttaaaagtctcaagattagctgtgtcctgtactgtggaggtggaggtgggacagaaaatatgaggagttgtttgaaagtctgtttcagaaaagtttccactcctgacctccctttcttctccccgtagacataaatagggtaactagagacttactatctggagtagaaaacgattattatctggactgagggataccatgcatagttaaggataaggtactgtgccttatagtggaaatctatatgctgaaggtagaaacctctagctttttttcctgacatagttctcagaatcttgcccctttctgctgtttcccattcaccaaaagcagcctctttcaagtctttgaggtattgttttggtataaacaacatgtctttaaattacctttttatttttatattttatgagatggagtcttcctgtcacccaggccagagtacggtggcatgatctccgctcactgcaatctccgtctctcgggttcaagtgactctcctgcctcagcctcccgagtagctgagattataggtgcccgccaccatgtctggctcatttttgtatttttagtagagacaaggtttcaccacgttggccaggctggtctcgaactcctgacctcaaatgatccgcttgcctcggcctcccaaagtgctggtagtacaggcatgagccaccatgcccggcctaaattacctttttataatgtaacttgtgattacttagtttatgctttatctgttgacttgaagatgaagattgttcttttttacatctgttccccacgtctgtgtacttgcatacttcttatcttccctccaagataccactgtatcttcccactatagggatgctataaggggcagtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcatacactttagaaattctatcaggatcacattcttggagccttttgactgacttttgaccgctcccttctggattggtggccctccaggcttaaggcacattgtcattctgcatctatttttactgttatctttagtattctttttgcctgactcttgtttttggatctcatttcctgcatcctgtgtattcttgacttactcccatatttgccagagtaccttctcctgtgactctctgagaaggatgcatgggaggtaaatattttgataacttacatctctgtaaaccttttttgttagttgttatgttagtttcagtctgtcattttgtggtactttctgggagattgctcaaaattttaaatgttttaatgttttacttttaacttcgaaataacttcaaatttaccgaaaaaaattgcaaaatattacagtttttctatatgcttcacctagctttgctccgaagttttgtttcagttttttttgtttgtttgaagacatggtctcactctgttgcccaggctggagtgcagtggcgtgatctcggctcactgcaacttctgcctcctgggttcaagtgattctcctgcctcagcctcccgagtagctgggattacaggttcatgccaccgtgcctggctaatttttgtatttttggtagagacagggtttctctatgttggccaggctggtcttgaactcctgaccttagttgatccacccacctcagcctcccaaagtgctgggatcacaggcatgagccactgtgcccaaccttacttcagtttttttaaggagacagagtcttgctatgttgcccaggctgatcttgaactcttgggctcaaacaatccttctgtctccgcctcccacgtaggtgggtctacaggtgtgcaccactgtacctggcctctccaatgttatagaactgcagcacattgtcaaggccaggcaattaacgttgagagaatactgctaactgatctgcacaccttattccaattttgtcagttgtcacatgacttttctttttctgaactgagactcaatccaggattataccttgtttaattgtcgtctccttaatctcagtctttcattctaggacagtctgtctttgtctttcaggactttgactgatgtgattgaagagtattagccagttattcttttttttttttttttttttgagacggagttttgcttttgtaccccaggctggagtgcaatggcgtgatttcggctcactgtcacctgcgcctcctgggttcaagcaattctcctgcctcagtctcccgagtagctggattacaggtatgtgccaccgtgcccggctaatgtttgtatttttagtagagacagggtttcaccgtgttggccagactggtctcgaactcgcgacctcaggtgatctgcccacctcggcctcccaaagtgttgggattacaggcatgagccaccgcgcctggcccttttccttttttattttttttttgagataggacatcactctgttgcccaggctagagtgccatggtgcaatctcagctcactgcaaccacaaactcctgggctcagttgatccacccacctcagccttctgagtagctgggaccacaggcacatgccaccacacttggctaatttttatatttctttgtagagatggggtttcatcatgttgcccagagtggtctcaaactcctgggctcaaacagtccacccatctcagcctcccaaagtgtgagattgtaggctgagccacagttccctgctggttgtttttaatattttgctattataaacaatgctgcaatgaatagccttgtacatgtgtatatttgtattattgtaggcatgtcttcaggtaaattccttaaagtggggttgctggattaaaaggtaaatacttttgtagttattaaatgttaccagattaccctccaaaaagattggatcaatttgtagtcctcctaacaaagtgtggaaaggcccttcttccccaccaagagaatgtgttataatttttgccaattgtcttataaatgaatttggacatctttcttaagcttaaggaacatttaaaaagctttatttgtaaattgtctccttatgtatttttcctattttccattaggctttttttcagttatctcttaatttaagaggtctatatattagggatattaggcctttatgatacatgttgcaaatatttttttctaatttatcagctgtcttttcattttgttcatttattattttttttaacttccaagcttaattgagtttttaatttctgctattatttttaattttcaagacccctttcttgtttttggccattcctttagaaaaagaataacaccctgttcttttttttcaatggatgtaatatttgcttttgcttctttgagatagtattagttttttttttttttttttgagacagtcttggtctgtcacccaggctggagtgcagtggctcaattttggctcactgcagccttcagaactcccaggttcaagcaattctcgtgtctcagcctcccgagtagctgggattacaagcacgtgccaccacacctggctaatttttttgtatttttagtagggttggggttttaccttgttggccaggttggtctcgaactcctgacctcaagtgatccgcctgtcttggcctcccaaagtgctgggattataggtgtgagccaccacactcagccccctctttttttttaattgtggtaaaatatacataacataaaatttactattttgaccatttttaggtgtacagttcattggcattaaagtacattcgcattgctgtgcaaccatcaccaccattcatctccaggaacctttttatcttcccaaactgaaattctgtacccattaagcaataactcccttttctccccctccctgttggtttataaaagttgactttatatagtttttgcttttatctgtttgttttggtctgtttttatccctagacatctggtgattcttggtcatcctttattttttattttatttttttgagacagagtcttgctctgtcgcccaggctagactgcagtggtgcgatctcagttcaccacaacctctgcctcccaggttcaggcaattcctgtgcctcagcctcccaagtagctgggattacaggcatgcaccaccatgcccagctaatttttgtatttttaatagagatggggttttgccatgttggccaggctggtctcgaactcctgacctcaagtgctctgcccaccttggcctcccgaagtattgggattacaggcgtgagccaccatgcccagcccgtctagttgtttttaataatgaccactaagaaactgcttgggaactcttaacacatggtggaatgtgtcaactttggggtacactgtgggccattttgtggggtaatatctgtatctttatggattttttttttttttttggtggactagttatagtctccagaaaagaatcttcagtctgcttgtatgggtgagacagactgctagcattctgggagatgagtggcaaagtgtgttcggagtctcatatgcagtatataattccatcttcaaattatgcctggagtccctgtgtctgcagactttccattttactcttttttgcattttacatttcactattttatctaaaggataaacttccaatcttgggtgggggagggtcacttacctgccatgtggagttaagtagggatctggagtctaactgcttcttaaactttaggccaccctattgagtcattgttcagacttattttgttgtgacatccccaaatatcactatctgttggttttttctccgtgaatgatctgttttcccccagggactagtcgccttcttgtgggtatagagcttcttgccagtcttatggaagctgagtggggaagggcctggaggggaattcacggtgtaaactcatttatcctcctggtatacccctgtgctcagctgtacatgatatactggactatcctgggtcatcctcctcagaaagtgaaactttcatcatctgccacggtaggagatggtatctaggagtttcactgcttcttattcagactttgagccagcgtttccttttcaacaccacccatactcctgactttcataggtatatgttgcctctgcttctgagcctttctgctttctgaggtcctatagctgctgcttttttttttggagacagagcttcactcttgtctcccaggctggagtgcagtggcgcaatcttggctcactgcaacctccacctcccaggttcaagcaattcttctgcctcagcctcccaagtagctgagattacaggcactcatcatcatgcctggctaattatttttgtatttttagtagagacggggtttcaccatgttggccagtctggtctcgaactcctgacctcaggtaatccatctgcttcggcttcccaaagtgctgggattacaggcatgggccaccacacctggccctgtgttctcatgtgtaaaatgaaggacggggaagggagaggagaccaaataccacttaagactgattccatattgacttaattataatttgctcatagcaaaataattagtttcatacagcagatttttaaaagagcaggtacttttgttctgtatagtcatgcaccagtagatatttagtaaatacatgtgaggtcagcatctcaagagggaagccacgctcctctgttaccagtcaaagactctgggtagccatgcaaggacaggactttatcaaatgctctcacccagtgatggttctggatctcaagtgaatataagaaaaaagaaccaacacaagcatacacacatatactgcaggaacacactctagaagtagatggaaatgaatgacagtcaaatccaaacaataacttcccctcaggatttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtgaaaagaaaggacgctaaacacttcatttcctcctcaaagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggtatgcacttttcctttattctccctcaaactccaagctcacatttgctgtgcattatccttgctaataagagtcctatttttttctcccactcatgaatatttctttaaaccagttagtctgcttgaagccttttatattgctgcattatgtagatgttccatcatttaatccttgtagacacttgcattgattccatttttttcataagctaatagtgcgatgaaattatgtctttacatttatacatttgtttctgtaagctaaattctcattattagaattgatggtgaaggaatattcacacttaaaattttaagataattaagttaccctccaaaaagttgaaccagtttacatttgttaagctttggcagtcttacagatcacagagttttgttttaatttgcatttttgagttttaagtttgaacatctgtttctgtgtttattggccacttttttgtatgtgcatggttttcctttgcctatttttcttttttttgagatggagtcttactctgtcgccaggctggagtgcaatggtgagatcttggctcaccacaacctccacctcctgggttcaagtgattctcctgtctcaaccccccgagtagttgggattacaggcacccgccaccatgcctggctaatttttgtatttttagtagagatggggtttcaccatgttggccaggctggtctcgacctcctgacctcacgtgatccacccaccttggcctcccaaaatgctgggattacaggcgtgagacaccgtgccctgcccctttgcctatttttcaactggattgtttctgtttttttttttttaatataggagacgctcaatgtaccaggcactgtgctggttcctaagaatgtagcaatgaacagaatatatgaccttcagggaacttggtgtcattctagtcataaaaatgtttaattgctgattataaatgtcataagaatggtccctcacgaaaggtaaaagccttcagtaccccaaaattgtttgatatttttgcttaataggagttttcagttcttacatagtaaaacttatctgtctttttttattttttattttttggagatggagtcttgctctgtcacccaggctggagtgcagtgacgcaatctcggctcactgcaacctctgcttcccggttcaagcagttctcctgcctcagcctcccaagtagctgagactacaggcacacgctaccatgcccggctaattttttgtattttagtagagacagtgtttcaccatgttgcccaggctggtctcgaactcctgagctcaggcaatctgcccgcctcggccagtctgcctaaagtgctaggattacaggcatgagccactgcgcctggcctaaagcttacctatatttgactttgaggcttctagtttttacgtcatgctttaagaagccttctcttgtcaaaaatctatcccataaggtaaactggtgtaaacatttctttggaagacaatatgatagtataaattatggcccattcaggcaatagtttgctagcagctgtttaagaatatagatctatattttgatactgaaagatgtctatataaagtgaaaacaggccaggtgctgtggctcacgcctgtaatcccaacactttgggaggccgaggtgggcggatcacctgaggtcaggagttcaagacgaggctgatcaacatggtgaaaccccatctctactaaaaatacaaaaatcagccaggtgttgtggtgcgtgtctgtgatcccagctacttaggaggctgaggcagggagaatcgcttgaacctgggaggcggaggttgcagtgagcttaggttatgccaccgtgctccagcctgggcgacagagcgagactctctcacaaaaaaaaaagaaagaaaaaaagtgaaaacagtaagttgcaaaatggtatgaaaccattttgttaaaagatatatatgacatatgtaggatgagtgtgagtatatatgtgtgcatatgcatttgtataggacatctggacagatattattaccattggctttggggagctagttaggaggtttatttcttggtagttgaaacagttctgagcactttctctttccaaccattaagtataataaattcttctggctgggcacggtggctcatgcctgttatcccagcactttgggaggccgaggcgggcggatcatgaggtcaggagatcgagaccatcctggctaacatggtgaaaccccgtccctactaaaaatttaaaaaattagccgggcgtggtggcaggcgcctgtagtccccactacttgggaggccaagacaggagaatggtgtgaacgggggaggcggagcttgcattgagctgagatcgtgccactgcactccagcctgggcgacagagcaagactctgtctcaaaaaaaataaaaataaataaattagtaaataaattcttcctcatagaaagacacaaagtacagagtcctagcaaattaaaaaaaaaaacaacaccaaaaaacctcttgtctatactgtcctagagtaaagccagatttccctactgaggttagcagacccatgatacttacacctgaaaagaattagcatttacccacaaatgccagttaacctttatagatgtaacactttcaagtacggttgataaattgaatatgcacgtagtaaaacctgtagcatgacctgaggaagtaggaattcttacagaattcatgtgtagtgacaatataattcactattttaataggccaaaggggaaaaaaatggtatctcagcaagtgctgaaaaacctgttagtaaaattgtttccttttgggtttaaatctcttagaaaactagtaataaaggaagcttccttgaattactaaagaatatcaatcagaagccaatagcagtttcaggtttaagagaatgaagtaagctcatggactctcttcttcctcctaccaaatccatagaaattatgaaaaaatattaaaaacacatgtgtcttcatactcacaaatgaggagacagttttggtagatcagaaactgagaatcagctcccactgggcaaaaagtagagggaaggtccaggcgggcagaaggaagattagtacagggaagtggtgtgatactgagtgctcatatttctggagatggtggaagtggagaggaaaggggacacccatggtaaggactgagtagttggggaatctctccctgcctgtgccacatgtcagcaaagaacaaatctgttatcaagccaaaattctaaggacaagagacaggatactcacccacacacgtacaccttgtaacacttggcaagagtgaggaacatccattttcagaacagctgctggggttcttagtgtccttattcccactgaaaatagttcaaggcagagcagcagctactgcccattatagccctttgccctcaattctcagcaagttacctaagtagagatgaactaacagtctatcaccatcctctgagaaaagccaacacaatgaaatagacaaattcagcaaataacagaactaaacctcagtattgattaatggggcaatgagtacaatagataatcctttaagggacttctacaacattagccactattgagttctgtggggtgctgaatgctggcttgtctctaatatgactgcacattatgctcctttcagttgatttacatgtttaagagtcagttatacttaggggagatttacttgttgcagtttcataattttattcagtattacataaaatgatgaaatatgagtgtaagaagaaagctcctcctttgaaaaacaaggtgaatactttgcaatgacagtagcgggttgctgcaaaaaaatgaatgctgatgcgctcatgcaggacagctgcaaaagatttgagggcgtgcgtgaaagtctaggactctgcactgagattactttgcaagttctttaagttcttgcttcgctttaaagttctaacctctatgtcatgagtatgccaggagataatggaagggaaactgaagaaattaggaatgttttctagaactgaaaagaaaggtctgagtctaaagttgaaaggctttgcaagtgccaatcaggattaaaacacacaaatacatacacaaactcacactaaatttagtgtagtaaaattatagcacatccaagagaaataacttggatggttacttcttttggagggaaaagggatagattcctgtgccgcaaaacattccagatggattaaaagtttggctaattaaaaccaaatacacagaaatgtgtacacgaatgcttgtaacagcattgttcataatatccagaaagtgaaaacaacctaaatgttcaacacctgatgaatggataaataaaatttggtatatctatacaatggaatattattctataaaaggaataaacaccgatatatacttaaatgtggatgcaccttggaagcatgctaagtgaaaagccagacacaaaaggccttataacatatgatttcgttcatttgaaatgtccagaataggcaaatacatagagatataaagtagattaatagttgccaggagctgggaagaaggggaatgagaggtgactgttaatgggtatagagtttctttgtggggtaatggaggtgttctggaattaggtagtagtgatagttacacaatctgaatatattaaaaaacagtgaattgtgttctttaatggggcaaattttgtggtgtgtgaatcacatctcaataaagctgttaaaaagaaacaaatataggccggccatggtggctcacatctgtaatcccagcactttaggaggctgaggcagaaggatcgcttgagggcaggagtttgagaccagcctgggcaacatagcgatataaatacatagagggatgtatatagatttagcgagactctattgctacaaaaaataaaattatctgcatgtggtggtgcatgcctgtagtcccagctcctcagatggatgaggtgggaggactgcttgaagccaggagtttgaggttgaagtgagctatggtagctcgactgcattccacgctgggtgacagcaagaccttgtctctctcttttttttgagacggagtctcactctttctcccaggctggagtgcagtggcgtgatctttgcttactgcaacctctgccttctgggttcaagcgattctcctgcctcagcctccggagtagctgggactataggcatgtgccaccacgcccggctaattttttgtatttttagtagagacggggtttcactgtgttagccaggatggtctcaatctcctgacctcatgatccacctgcctcagcctcccaaagtgctgggattacaggcgtgagtcaccgcgcccggccgaccttgactcttaaaaaaagaaaaaaaaaatacaggaaatcattctttttaagtttttggtttctttgtttgtgacagagtctccctctgtctcccaggctagagtgcagaggcgtgatctcagctcactgcaaactccgcctcccgggttcaagcgattctcgtgcctcagcctctggagtagccaggaccacagaggtgcgccactatatgcctggctaattttttgtatttttagtagagatggggtttcaccatgttggccaggctggtcttgaactcctcacctcaagtgatccgcccggcttagcctcccaaagtgctgggattacaggcatgagccactgtgcctgacctaaagattatttttaattgacaaaattctatatatttatggggtacaatgtgatgttttgatatatgtttactttgtgaagtaaatcaagataatcagcatatccatcactcacttcgtcgtgagaacatttaaaatcaattctcatctattttcaagacacagtacattattattaactatagtcaccagactgtacaatagatctctaggaccacttcctcctgtctaacggaagctttatgacccttgaccaacatcttccaattctctgccccacccccagcccctggtaactaccgttgattctctacgtctatgagtttgactttagattccacatgtaagtgagatcatgcagtatatttttttgtgtctggcatatttcacatattatgctccagattcatccatgttgcagatgacaggatgttttaaggctgaattgtattccattgtgtatatatactacattttctttctccattcatccactcatgggcattgaggttgatgccatgtcttggctattgtggatagtgccgcagtgagtatggggtgcaggtacctcttcaacacactgattttattgtctttgaaatacactcagaaatggaattgctggatcatatggtagttctatttttaattttttgaggaacctgtatactgttttccttcatggctgtgctaattcacattcccaccaacagtgtacagggttcccctttctccacattcaagtcctttgcctgctttttaaattgggttatgttcttgctattcgttgtttgagcaggagaccatttttataatcttatattgataagacatttttgcccataataggaagctcagaagcaatgaaaatataccaaattgactctacagacatttaaatcttgtgtgcatgtgtgtgtgtatagcaaaagttagatgaaaatttaaaaatttagatatgcatgcccttttacccagaaatttaacttgtagtaggtgtgtccaagggaaacagtagaactaggatagatcaagagttttaattgttacattatttagaggtaaaaataaatggccatcagtagggaattggttacaatacagtatgcattttttcaggcaaaagagaactgtccatgatatagtgaatggaaaaaagcagcttcaagaagagtaagtttaggccgggcgcggtggctcatgcctgtaatcccagcactttgggaggccgaggtgggtggatcacctgaggtcaggagttcaagactagcctgaccaatatggtgaaactccgtctctactaaaaatacaaaaattagccaggcatggtggcatgcgcctgtagtcccagctacttgggaggctgagacaggagaattgcttgtacttgtgagttggaggttgcagtgagttgagatcgcaccactgcactccagcctgggtgacagagtgagactctgtctcaaaaaaaaaaaaaaaaaatttagtgtgtttaagaaatacatgttcaaagggcttgaaagtccagaaggaattatgggctcactgccatttatttaaaaatatttatggtcgtgtatgagaaaaaataactacttaaaaggttgtttccacatataaagtaaatgtttataaaaatgtccaactctttttttctagatattaatgtggtttttttttttttttttttttctggagacagagttttgatcttgttgcccaggctggagtgcagtggcgtgatctcggctcacggtggcctccacttcctgggttcaagcaattttcctgcctcagcctcccgattagttgggatgacaggtgcccgccaccacgcccggctaattttgtatttttagtagagacagggtttctccatgttggtcaggcttgtctcaaactcccaaactcaggtgatccgcccgccttatcctcccaaagtgctgggattacaaatgtgagctactgcccccggcctaatgtgttatttttaatttagtgctttggaaaaaagttaaggtagatccttacctcattctttacaccaaaatgaattccagctgttaataaaatatttagttgcgagttctttttttttttttaaatttattcccatgggtctgggaaccaatgaaattagttggtagttctaatactgtttattgagtgatttgctcttttccctgtggttcagaaatgcaacctaccacagagtctctttggatttgatctctattccatgctggctctatttgccttaattagcgtagttttatcatttgacaggacctggcgctccttattcacctctctcctttaattcttttcaaaaatttctaggaatttctcacatttttgtcccaaggtaaattttggatttattttgtaatcttttaaaaaagtatggtttttacttgttgttgcattatatttatagattaatttagggacagttgctttcattgcaaaagacttcctgtcccttagtcatatttcgcatcttttcacttaggttttgcgcattgcttatgtttgttcttagatactgtataccttccttactgctgatgggcccgttctgaggtatgcactgtgttttgttggagaaccatgtgcttgcatttcttacgtgcacagcacggggaacctcattccacatccagggtggaatgtgacccaggtcagttgcatcaaacgaaaactgtccagtgccgttagtttaacatgatggctacttttaacttctttttttttttttttttttgagacggagtcttactctgtcacccaggctggagtgcagtggcataatctcagctcgctgcaagctccgcctcccatgttcacgccattctcctgcctcccgagtagctgggactacaggcgcccgccaccatgcccggctaattttttgtattttttagtagagacagggttccaccatgttagccaggatggtctcgatctcctgacctcgtgatccacccgcttcggcttcccaaagtgctgggattacaggcgtaagccaccgcgcccggccttactttaacttcttttttttaaaaagttcttttttattttttcagttatttttgaggcagggtctcgttctgttgcccaagttggagtgccgtggtgggatcttggctcactgcagtctttgcctcccaggctcaacccatcctcccacctcaccctcccgagtagctgggactacaggcatgtgccaacatgcttggctaatttttgtattttttgtagagaagcggtctcactttgttgcccagactggtcttgaacttctgagcttaagcaatccttctgtctcagcctcccaaagtgttaggattacaggcatgagccaccgtgcctggccgggtactttaaattctaaaatgacacctcaggttttgttttttatattactaccttttgtacttgcagagtgctctgtaatttgaactccagtttttgtttgttgtttattcctaacattttatcctttgtttcttgggtcactttgaaattttagtactttgggagtaaaataaattgtgtataccaattgcatttttccttttttagttgatcagtttagtgaaagcaagtgggtaaagaatggtggatttaactgtcattttataaaatctgtttctgagtaaaataaattgtatataccaagtgcatttttccttttttaattgattagtttaatgaaagcaagtggataaagaatggtggatttaactgtcattttataaaatctgtttctggatagttcttggcccacagatattaaaaaggaaaggtgaagaaccaagttgtttttgtagagaaaagataacagatatttcttgctttgtaagtggcatgacatgatagttaacagcccagtttctgtagtcacggtacctacaatcaggatcttagttctaccatatgctagttaagtgcccttggggaggtaacaacctctcaaagcttctaatgtctccatttgattgactggttgattgattgattgattgagatgaggtctcgctctgttgcccagactggagtgcagtggcataatctcggctcactacagcctctgcctcccaggttcaagcgattttcctgcctcagtctcccaagtagctgagattacaggcacgctaacatgcccggctaatttttgtagttttagcatagacagggtttcaccatgttggccaggctggtcttgaattcttgacctcaggtgatccacccgccttccaaagtgctgggattacaggcatgagccaccgcacctggcccagtgtctctatttgtaaagtagggatactatcttaacacccagggaggctataagaactaaatgagacaggctagtgcttgtcttatgagtattttttaactgttgttttacttctggtcccagtgagataatggtgtgtgtaagtgagacactgtcatctagggttctccttgaagatcgtaccttgaagggcatttctaccgaataagaaatccatgtttatcatctgaaaatgaaaataaagatacagataagaggaaaatgtgtaataatttagaatctccatcattctaccaccagaaataacattgttaacaagagcaccatgatactagtttgaaattcacatccatatcccattgtgggggacactgccttcttatttgaggagcctcaatcaaagttgtggggcctaaagtttaatttttattgttgttaggggtattattttacaacgaaaaataattctcaatgcagtttctcaaatggtgggattccttatcttccactgggcccattcccccatgtagacacaaggttatgattaggtaactgtaagatgtgaaatagtaaacactagaggcaagtatatggtctgttcctagattagaagccccaaatctttatctgataccctgatgaagttggagcatgggactatcttcctgtctactgtatttgcccaaagcctagagcagaatggacgtgagaaaggacctcttttctgtttactgtaccctgacctttgctcctatgttaagccttgaaaattgagaggtactctggtgggagattaacaggaggaaaaataaattgttcacttctttgtctgtctctcccctcataaaagacaaaacacttcattcccaagacactcttatcatcttttctatcctgtttatatcaatgcatggcagaggccattcttggagttacaaagggagctggttaagatatgtggctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtcttaaaaaaaaagaaaaaagaaaagaaagaacgtcctgggtttatttcctggggcttttctaggttcagtggatcattcagggatatatataagcacatatacatgttacttacatttacctgaagactgtcctatggtgtggccaaaaagccacctttaaattttatttctcatcttgggaggctggagcgaaaggatcacttgaggccagaagttcaagaccagcctgagcaacatagcaagaccctcatcttaaaaaaaaaaaattaaaaaattagctgggtgtggtttcacttgcctatagtcccagctaactatccaagcaggaggatggcttgagcccaggagtttgaggctgtagtgagctatgattgtgttactatgccccagctgggatgatagaaagagaccccatctccaaaaaattctatttactgtcttaaaatgtgcttcactagctgggtgtggtggctcacgcctgtaatcccagcactttctgaggccgaggcgggcggatcacaaggtcaggagatcaagaccaccctggctaacacggtgaaacccctcgatgatagttccattcgattctatgcgatgattccattccattccattggaagatgattccattcgagaccattcgatgattgcattcaattcattcgatgacgattccattcaattccgttcaatgattccattagattccatttgatgatgattccattcgtctctactaaaaatacaaaaaaattagccgggcgtggtggcaggcgcctgtagtcacagctatttgggaggatgaggcaggagaatggcgtgaacccgggaggtggagcttgtagtgagcagagatcgtgccactgcactccagcctgggcaacagagcgagacgccatctcaaaaaaaaaaaaaaaaaagtgcctcactagctgttatccagttgagctcacctcacagcgttatttggtgtcatgagtataataacttatcaagatgtatgatattgtcccttgctgatactaaagtacatacctttaccaaataatagagtcacagtgatctcatcagttaatgctaattgtgattttaaaataataattctttcagttaccaaaaggataggcacatttgactatgtgattaagccctttagaagtcacgctttaagagaaggttaagctgtgggaagctgttagtatttccttctagctatccattccttctctaacaatgcttcagtaacttaaaaatctaatgtgaaatgattcctcacagtatgtctctctagattgcattggttagagcctaatatattttattttttacaaaagacataactttaaaaatatagtatcaatattatatagtaatataggttaaccactgtatgtgttaagtgctgtgtataggttaagtgtttggagaatgactctactgaaaatggcttgtttttccatcttaacttttctttcttcctttatttaaggattcctagatgaggttatgaagaagtatggcagtttggttccactcagtgaaaaagaagtccttggaagattaaaagatgtctttaatgaagacttttctaataggtatataaatgatgctaaagttaagcccttgaaaataaaatttttggcatatatgacttttctcttgatttacagaagaaaagatatttagcagtaaattgagaagtactcatgttttttttaccttttgtttcaaaatctttctctttcagaaaaccatttatcaatagggaaataacaaactatcgggccagacatcaaaaatgtaacttccgtatcttctataataaacacatgctggatatggacgacctggcgactctggatggtcagaactggctgaatgaccaggttagtatattgtagtttttcagtgtggagaagttgcagaggatgttagtcaataaaatataatctctagtttggcttctcagttgtcttttggaataaggattcttcattctttactggttacttgccccaggatccaaacggtttgattactattggcagtaataatatattatttattctgattgggatgtactgaattgtatagggttagtagcctggttttatttatttattttgtttttctttctccaacttaactggcagagatagtaagctggttttatgttgactttttataggtcattaatatgtatggtgagctgataatggatgcagtcccagacaaagtaagtgaaaacttcctcttctgcaggagagagtgttcttgtgtattaaaatgagtagtttttttgtttttacatttgatgtaattatctgacattccttaaattttttaaaagaagagttcaattttttcttgatcatgtactgggcttgatcgtaagttccatcaaatcacttctttttgttctttttgagatggagttttgctcttgttgcccaggctggagtgcagtggcgtgatctcggctcattgcaacctccacctcccgggttcaagcgattctcctgtctcagcctcccgactagctgggattataggcatgtgccaccatgcctggctaatttttgtatttttagtagagacagggtttcatcatattggtcaggctggtctcgaactcctgacctcaggtgatccacctctgccttggtctcccaaagtgctgggattacaggtgtgagccacagcgcctggccccatcaaatcacttcagcataagaaaatcactgtgcaattgttttcctatttatttgtgttagggtaggtatgtttgttgatatctggagagggcctttttttggtggggagatgtgcaaaagggactggctaagctttttacatttatgtatttattttacttttttttttttttgagaccgagtcttgctctgtcatccagactggagtgtagtggcgtggtcttggctcactgcaacctccacctcctgggttcaagcaattctcctgccttagcctcccaagtagctgggattacaggtgtgtgccaccatgcctggctaatttttgtatttttaggagagacaggtcttaccatgttgggcaggctggtctcgaactcctgacctctggtgatccgcccacctccccctcccaaagtgctgggattaaagatgtgagccaccatgccaggccagctttttacatttaacttaaaatcttgctctctttaaaaatgtaaaaaaaaactcatctttcatttttccttagataaatctttgatactcagttcaaatacagattgaaccctcataaactctaaattctcttaagagttttgttacatatcaaaactatttttttacttaatgtatttttctgagtacacaaatgcctgatgggtgcaaaaatttccaagtgctgtataaaacttaccaatctaataaagtaacataaatactaaaaagtcagattctgataccgtttatgaatatagaaaatgttttatgactttccacttaaattataaatctgttatacatttataaattggaatcatgaggctaatctgctagatgctctattgtcaaattctcttaatcatcagaaagtttaaacaatatagattatctttaacataaaagtattaatttcaagggtttcatttaccaccattgtacatttaattctaaacattcatggagtcaaaaggacacttaactaaggcagtggttctcaaagcatggtccccatactagcagcatcagtatcccctgagaacttactagaaatgcacattctgagactccatcccacacctactgaatcagaaactggaggtgggggaccaccgatttgtgttttgacaagctctctagatgattctgatggacaccaattttgagaatcactgctctagagacagctactataagctctttcttatttatttgtttttattaaaattataaaacataaccttctttttagagacactaaaaagacactccaggctggaatgcagtggcacagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacctctgcctcccaggttcaagagattctcctacctcagcctcctgagtagctgggattgcagatgggtgccaccacgcccggctaatttttgtatttttaggagagacagtgtctcaccatgttggccaggctggcctcgaactcctgaccccagatgatccacttgcctcctcaatcattgtttttatgaagaaatttttccttcctttttgtctgctttacattcaaacattttaaaatttcctcttttgaagttaaatctgggcacagcctaatataatctggttgcttgtgtttgttgtctgttctaggttcacttcttcaacagcttttttcatagacagctggtaaccaaaggatataatggagtaaaaagatggactaaaaaggtattctctttatttcttttttattccaaatttgaaacgcagatgataaaccactttgtgtggaaggataagtactttaatgccaatacgatgttaagtagaaacagactttttaatgtgacaagttttaaatttgtttcttttaaatcttattgtttgaaagaccttaattgcctactggtcccaattatagtggtagaacagtgggatgataaagaaggagctgccatcatttggtgttatctggtaggcttgtcagcagacagcagaagctttcaacaattttttgctggtgctgggcacggtgcctcgcacctgttgtcccagctacttgggatgctgagaccagaggatcacttgagcacaagcatttgaggccagcttgggcaacatagccagatcctgtctcttaaaatgttaactgatccatcaggagaaataacttttatatcacaatctattcataaaatcttatacatacatgtaattgaaataatttccaaaaaccatgtacctaatttactatgtatgatgtactctagtcagagagtggtaagtgctatttgctatggaaacatcagaacacagtatgagaatacaaggtaactgggatagggtagcaggaggaagatgggctagttcttttagataggcttgtcagcaaaggcctctttgaagagatcccatttcactgaaaactgtgaagatcagaggagcattcccagtagatggaagagtgaatgttaaaggccctgaagcagaagtgagtttggtatattggagtattacacacatgagatcagggaaggaggcagggatcaagtcatgtggcgccatataggccctggtaaagagtttggatcatgagggcaatttgaagacattagagagtttaggccaggtgcggtggctcacgcctgtaatcccagcactttgggaggctgaggtgggcggatcactgaaggtcaggagtttgagatcagcctggccaatgtggcgaaaccctatctctactgaaaatgcaaaaattagccgggctgtgatggtgggcgcctgtaaccccagctacttgggaggctgaggtgggagaatcgcttgaacatgggaggtggaggttgcagtgagccgagattgcactattgcactccagccttggtgacagagcgagactccatgtcaaaagaaaattaaataaaaaataaaaatgaagacattagagggtttaagcagcaggcaaggagtgtgtatgagtgtgtgtgtaaatgatagataggattgtccttagcaacattgattcattcattcatcatttatttattgatttattttttgagatggagtctttcaggcgctatcttcgctcactgcaacctctgcctcctgggttcaagcgattctcctgcttcagcctcctgtgcagctgggattacagtcacctgccaccgtacccggctaattcttgtatttttaatagagacgggatttcactatgttggccaggctggtctctaactcctgacctcaggcaggtgatctgcccgcctcagcctcccaaagtgttgggattacagggtaagccaccgtgcccggcattaaacatttattgagtacctgttatgtgcctatatggaaaaacttttttcctttgctgtcacaccacaacagtagtcagcacagaagacttctgtgaccaaagcaagcaagcaagcagttctgcagcgaccactggctggatgccctctaattcaattccgacctgtctacctggagacagtgccacgtcccatagtttgagggctcatgcctcaagagtgccccccacccacttcagacaccagttgcaagtccaggcttctgaaacttctgaccaacagacttcaagtgagggttcccatgccgccctccttgaatttgattaatttgccggagcggttcacagaattctgggaagttcttacctacatttagcagtttattatataggatattacaaaggattcagatgaagagatgcatgggaagagatgtaggggagtgggcacagggattctctaggacctccacaggcacatcaccctccaggaacctccacatatttagtatccagaagctctcccagtgcagtcagtttttatggaggcttcattacataggcgattgactaaaccagtgaccattggttaacctttagcttctcttctctccctggtggttggggggttgggtggggctgaaagtcacaatcctctaattctgccttgctcttatcctaaagccacctagcagctgccagccatcagttaatcatcaacatacaaaaagacatcactttgggcctgggtcatgtccccgtaatcccagcactttggaagtctgaggcaggcagatcacttgaggtcaggagttcaagatcagcctggccaacatggtggaaccctgtctctactgaaaatacaaaaattagctgggtatggtggcatgtgcctgtagtcccagctacttgggaggctgagacaggagaatcgtttgaacccaggaggtggaggttgctgtgagccgagattgcaccactgcactccagcctgggtgacagagcaagactttctaaaaaaaaagaaaaaaagacatcagaaattccaaggactttagggagttgtatgccaggaaatgaggtcaaagaccaaatttattattttacagtatcatagtgccagacattatagtaaatcaagaaataaagaggtaagtaaaacaatattagagacagtttttgctttcacaaagtctgcagtctagtggtggagacagcacctaccacagtttgtatttatatttttggtggtgtaattatttgtttagtgggtacaaaagaaaagtactacaggagtgtattggaatgcaggtttggttaacctagcctgagggtaagggaatgtttctcataggaagtaatatttaagcagaaatatcaaagatgaatacaagttaactaggtaaatggagaataggggtatgtgaaacataggcagaaggaataagtatctggtagaagaatgggaaaaggctagtgtagctgaaatgcagagagttaagaagacagtggcatgaagtgtacctgatccacagatcagggccttgaggtttgtattttggattttatcctaaatgtaataggaaaccattgaatggtttttagtgacattatccactttgtagtctttgttctaacagtactgaagaagatggatgggtatgggagcaaagttgatgtgggcagaacaggagaccatttcagattcatggtactttgaagtagaatgatagcaggagagatggaagatgagtgtgatgtaggaagtaaaattaacaggatttggtgataagttggttatggagatgaaggacaaggaagtgtgaaagatgacttccaagtatgtgacttgtatgactggacggcctatggttgtatttacattagaaaaatgtaggacaactagtagaggattgttcaaatttaaaatgtacagtcatataattggatgctacttaagcaggaaaagctgtgtagataatgaacgatgggccgggcacagtggctcacatcagtaatcccagcactttgaggggccgaggcaggcggatcacgaggtcaggagatagagaccatcctggctaacacggtgaaaccccatctctattaaaaatacaaaaaaattagccgggcgtggtgacggatgcctgtagtcccacttactcaggagactgaacccaggaggcggagcttgcagtgagccaagatcgcaccactgcactccagcctgggcgacagagagactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaagtatacataaaataatatgaaaaagaaaggttgaaaatgaagtgacatttaaagaggctgggcgctgtgtctcacatctgcagtctgaacactttgggaggcctaaaattactgtagatgggaggattgcttgagcccaagagtttcaaatcagcctaggcaaccaagcgagaccccgtttctataaaaaatttaaaaaacttagctggccatggtggcagcctgtggtcccagttatccagaaggctgcggtgggaggatcacttgagcctgggaggtcgaggctgcagtgaaccctgatcacgccactgcactcctgcctgggtgacagactgagaccttgtctcaatttaaaacaaataaaaaaggcaactacaggaaagttaaacaacctgttcctgaataactcctgggtaaataaagaaattaaggcagaaatcaagaagttctttgaaaccaatgagaacagagagacaatgtaccagaatctctgggacacagctaaagcagtgttaagagggaagtttatagcactaaatgcccacatcgaaaagctggaaagatctcagatcaacatcctgacatcacaattaaaagaactagagaagcggctgggcgtggtgactcatgcctgtaatcccagcactttgggaggctgaggcgggtagatcacctgaggtcaggagtttgagatgagcctgaccaacatggagaaaccccatctctactaaaaatacaaaattggctgggtgtggtggcacatgcctgtaatcccagctacttgggaggccgaggtaggagaatcacttgaacccgggaggtggaggttgtggtgagctgagattgcgccattgcactccagcctgggcaagaagagtgaaactctgtctcaaaacaaacaaacaaaaacaacaacaaggaaatagagaagcaagagcaaacaaatccaaaagctagcagaaaacaagaaataactaagatcagagcagaactgaaggagatagaaacacaaaaaaacccttcaaaaaatcagtgaatccaggagctggattttttgaaaaaattaacaaaaaatacctctagctaaactaaagaagaaaagagagaagaatcaaatagacacaataaaaaatgataaaggggatatcaccattgaccccacagaaatatacaaattactatcagagaatactataaagacctctacacaaataaactagaaaatctagaagaaacggataaattcctggacacatacaccttcccaagactaaatcaggaagaagtggaatgtctgaatagaccaataacaaattctgaaattgaggcagtaattaatagcctaccaaccacaaaaagcccaggaccagatggattcacagccaaattctaccagaggtacaaagaggagctgataccattccttctgaaactatttcataacaattgaaaaggaggaactcctccctagctcattttatgaggccggcatcatcctgataccaaaacctggcagagacacaaaaaaagaaaatttcaggccaatatccctgatgaacatcggtgcgaaaaattctcaataaaatgctggcaaaccaaatccagcagcacatcaaaaagcttatccaccatgatcaagttggcttcatccctgggatgcaaggctgattcaacatatgcaaatcagtaaacataatccgtcatataaacagaaccagtgacgaaaaccacatgattatttcagtagatgcagaaaagaccttcgataaaattcagcatcccttcatttaaaaactctcaataaactaggtattcatcaaacatatctcaataataagagctatttatgacaaacccatagccaatatcagtgggcaaaagctggaaacattccctttgaaaactggcacaagacaaggatgccctctcccatcacttctattcaacataatattggaagttctggccagggcaatcaggcaagagaaagaaatacagggtattcagatagaaagagaggaagtcaaattgtctcttgcagatggcatgattctatatttagaaaatgccatcgtctcagccccaaaaccccttacgttgataagaaactttagcaaagtctcaggatacaaaatcaatgtgcagaaatcacaagcattcctatacgccagcaatggacaagcagagagccaaatcatgaatgaacccccattcacaattgctacaaagagaataaaatacctaggaatacagtttataagggatgtgaaggacctcttcaaggagaactacaaaccactgctcaaggaagtaagagaggacacaaacaaatggaaaaatattccatcctcgtggataggaagaaccagtatcttgaaaatggccatactgcccaaagtaatctttttttttttttttttttttttttttttgagatggagtctcgctccattgcccaggctggaatgcagtggcatgatcgtggctcactgcaacctccacttcccgggttcaagcaattctcctgcctcagcctcccgagtaggtgggactacaggcatgcaccaccatgcccagctaattttttgtatttttagtagacacagggtttcgccgtgttagccaggatggtctcgatgtcctgacctcgtgatccgcctgcctcggccttccagagtgctgggattatagatgtgagccaccactcctggctgcccaaagtaattaatagatttaatgctattcccatcaaactaccattggcattcttcacagaattagaaaaaactactttaaaattcatatggaaacaaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaactatcatcagagtgaacaggcaacctatagaattggataaaatttttgcagtctacccacctgacaaagatctaatatccagaatctacaaggaacttaagcagatttacaagaaaaataaaccatcagaaagtgggcaaaggatatgaacagacacttcgcaaaagaagacatttatgtctgtagtctcagctactcgagaggctgagacaggagaattgcttgacctgggaagtggaagttgcagtgagccaagattgcgccactgcactccagcctgggcgacagagtgagactttgtctcaaaaaaaaaaaaaaaaggacatttatgtagccaaaaaacatatgaaaaaacctcatcagttgggcgcggtggctcacgcctgtaatcccagcactttgggaagctgaggcagttgtggtggtgggggcctgtaatcccagctactcgggaggctgaggcaggagaatcgcttgaacctgagaggcagaggttgcgtgagctgagattgtgccattgcactccagccttagcaacaagagcaagactccgtctcaaaaaaaaacaaaacaaaaacagctaatcactgatcattagagaaatgcaaatcaaaaccacaatgagataccatctcatgcgagtcagaaatgacaattattaaaaagtcaagaaacaatagaagctggcaaggctgtggagacataggaatgcttttacactgttggtgggaacgtaagttagttcaaccattgtggaagacagagtggcaattcctcaaggatctagaaccagaaatatcatttgacccagcagtcctattactgggtatatacccaaaggaatataaatcattctctatagagacatatgcgtgtgtatatttattgcagtactcatagcaaagacatggaaccaacccaaatgcctatcagtgatagactacataaagagaatgtggtacatacgcaccatggaatactatgcagccatttaaagaatgagatcatgtcctttgaagggacaaggatgaagctggaagccatcatcctcagcaaactaacagaggaacagaaaaccaaacactgcatgttctcactcataagtgggagttgtacaataagaacacatggacatagggaggggaacaacatacaccggggcctgtcagggggttgggggcaaagagagggagagcattaggacaaatacctaatgcatgcagggcttaagacctagatgacagcggggtgcggtggttcatgcctgtaatccagcctgggtgacagagcaagactctgtctcaattaaaaagaaaaaaacaaaactagatgacggattgataagtgcagcaaaccaccacggcacatgtatacctatgtaacaaacctgcctgttctgcacatgtatcccggaactttaaaattttttgaaaattcaagttttcattaaaagaaaaaataaaaggtactaggcagctgggcgtggtggtgtgtgcctgtagtctctgctactccggaggctgaggtgggaggattgcttgagcccaggagtttgagactgcggtgagcagtggtcacaccactgtaccccagcctgggtgacagaccttgcctctaaaaataataatttgtttgaaaattgtagaaatttaaaggtactagacaaattgaaacaaaaacagaaaggaatattaatcatattaatagcagttgaaatagaatttaaggtgagaagcaaattgtgtaattatcagatttcaatataaaggagatataatgaccaatctttatgcaccaaagcacacagttgctaaatatgtgtaatacaattaaaacagaaacaagaggaccttggtaaaatagtgatagtggcagacttttctcataagtggataaatctagtagacaataaagacatatacaaaaattacagtcaatataattgatttaatagatgtttatgctccttaagagaatatacatttattgctatggttcaggaatatttgtaaaaattgaacatgtacttagccacaaagaaaattattttttattagccgggcaaggtggcatttgggagcccgaggcaggtgaatcatggggtcaggagttcaagaccagcctggccaagatagtgaaacctcttttctactaaaaatccaagaaaattagctgggtgtggtggtgtgcgcctgtaatcccagctattcgggaggctgaggcagagaatttcttaaacccaggaggcggaggttgcagtgagctgagatcatgccactgcactccagcctgggtgacagagtgagactccatctcaaaaaaaaaaaacaaaaaaaactagtaagaccctgaactcagtagaagactcagtgatgaaaaggtttataagaaaggcttttttttttttttttttttttgatggagtgttgctcttttgcccaggctggagtgcagtggcacaatcttggcttgctgcaacctctgcctcctgggttcaagcgattctcctgcctcagcctcccaagtagctgggattacaggtacacaccaccacacctggctaatttttgtatttttagtagagacaggttttgccacattggctaggctggtctcgaactcctggcctcaagtgatctgcctgcctcagcctcccaaagtgctgggattacaggcatgagccactgtgcctggccaagaaaggctcttaaacatataaaaagttgcataacttcacagtaaaagaaaagcaaatgaaaaccacactgagtgacagataaatgcagtaagttaatcttgattggatcctggactggaagagatgcaatattttgggtaaattaggggaaattttagtatagactaatatattcaggggtcagtgatctttttctgaaagagccagataataaatactttggattttgcagaccttatggtctttgatttatctactgacctgttacagcacagaagcagatgtagataatacccaagtaatgagtgtggctgtgtttcaattaaacttaataaaaactggcagtgggccatacttggtcattcatgcattagatgatattagtaaactgatgttaaatatcttgtgtgttcagagatagtgagattgtggttatataggagaaaacatctaaagtaggtaggggtaaaatattgtgattgatgtctccctccaaaaaaattgtacaagtatatgcaaaaaaataaaaagccaggcaaagtggtaggtgcttatagttccagctactccggaggctgaggcaggagcattacttgagcccagaggtttgctttaaaaaaaaaaaaaaaaaaaaaaatatatatatatatatatatatatatgtctacacacacatacatatgtgtgtggggaggggttttataagaattggttaagctgagaggaggaggagcaagatggcagaatagtacccttcaaccatcgtcctcctgcaggaacaccaaattgaacaactatccatgcaacaaaataccttcataagaaccagaaatcaggtgagtgatcctagtacctggttttaacagcatctcaaggaaagaggcatcgaagagggtaggaaagacactcttgcattgcctacaccaccccttccctatcccctggcagtgtgcggagatagaatctgtgtgcttgcaggaggaagagcaaaatgattgtgggactttgcattgaaactccagtgctgtcatatcacaatggaatacaacacagggcagaattctgccagcacccatggagggagcattcagactagccccagccagaggagaatcttccgccccagcggtaggaacctgagttgcagctagttccaccaccagttgagtaaagtggacttgggtcctgaataaatttgaaaggcagtcaggccacaggactgcattcttttggcacgtcctggcactgtgctggggtcagagcctgtggatttggggtgcacacaactcagacaccagctctggtagtgaagggattgccactcccacaacttgaagcagtggagcttggggaggtgctctttccatttggggaacggagaggaaagagtacagaatattgtgtcttgcaacttgagcactagctgagccacagtaaaataaagcaccagtcattcctgaagcctccaattctaggccctagaccctggatggtatttatagccccaccctgggccagaagggaacctactggccctgaagggaagggcccagtcttggaagaatttaccacctactgagtaaagagcccttggaccttgaataaatatcagcggtcgccaggcaggagttgccacatgccttgggcaagacccagtactatgctgtgttcagttgtgacccagtccagtgccagctgtggtagccatgggagtgcttgcaccacccctccctcaactccaggcagcccatcatggagagagagactatttgggggaaagtgaaggaagagaatgagagatcgcctaataatctaggaaattcctctccatcttacccaagcacaccaaggtgagacctccaggagcctgcaagggtcacagtcttactgggcttggggctccctgtagtgcagatacggctgcagtgaccaaagacttagattacaacactcaatttcctttgaatacctggaaagccttctcaagaaggacagataaaaacaagtccaaactgtgaagatagaataaatacctaactcttgattgcccagacgtcgatgaacacctgcaggcatcaagaacatccaggaaggctgggcaccttgggtcacgcctataatctcagcactttgggaggctgaggcaggcagatcacctgaggtcaggagttccagaccagcctggccaacatggtaaaaccctttctctactaaaaatacaaaaaaattagctgggcgtggtggcgggcacctgtaatcccagctattcaggaggctgaggcaggagaattgcttaaacttgagaggtggaggttgcagtgagccgagatcatgccattgcactcaagcctgggtgacaagaatgaaactgtctcaaaaaacaaacaaacaaaaaaaacatgcaggaaaacatgacttcaccaaactaaaggcaccaatgaccaatctcatagtgacagagatatgcaacctctcagacaattgaaaatagctgttttgaggaagcccagagaatttcaaaataacacagagaaggaatttagaatcctgtcagagaaatttaagaaagagattgacttttttttttttttttaaagacagagtttccctcttgttgcccaggctggagtgcaatggtgtgatctcagctcactgcaacctccatctcccaggttcaggcaattctcctgcctcagcctcctgagtaactgggattacaggcatgtgccactatgcctggctaattttgtatttttagtagagacagggtttcaccatgatggtcggactggtctcaaactcctgaccttgtgatctgcctgcctcagcctcccaaagtgctgggatttgagtgaccacacccagctgagattgacatatttttttaaaaaaataagcagaggctgggcacagcgactcacacctgtaatcccagcattttgggaggcctaggtgggtagatcacttgaggcaaggagtttgagacaaacctggccaacatggcaaacccccatctctactaaaaatacaaaaattagccgggcgtggtgacacaggtctgtaatcccaggtatgcagaacgctgaagcacaagaatcgcttgaacctgggagacagaaattgcagtgagccaagatcatgccattgcactccagcctgggcaacagagcgaactctgtctcaaaacaaacaaaccccaacaaaacacaaaaaacaaattctggagctgaaaaattcagttgacaaactagaaaatacatcagaatctctcaacagcaaaattgatcaagcagaagaaagaattagtaagcttaaggacagactgtatgtaaatacacagaggagaaaaaagaatgaagcaaacctacaagatctagaagtcacagggcaaatctgagagttattggtcttaaagaggaggtagagagagagagagagggtagaaacttcactcagatagtaacagaactttccaaacccagagaaaggtatcaatattcaggtacaagaaggtcctagaacaccaagaagatttaacacaaataagattacctcaaggcatttaatagtcaaactcccaaaggttgaggataaagaaagaatcctaaaagcagcaagagaaaaggaacaaataacatatgaaggagctccaatacatctggcagcagacatctcagtggaaactttacaggccaggagggagtggcatgtcaagtgctgaaggaaaaaaacgtttatcctagaatatcatacccagcgaaaatatacttcaaacatgaaggagaaatactttcccagacaaacaaaagctgtgagggattttgtcaatatcagacctgacctataagagatgctaaggggagctctttaatctgaaaggaaaggacatgagtgagcaataagaaatcatccaaaggtacaaaactcactggtatcagtaagtacacaagaacagaatggcttgacacactaattgccgtgtgtaagccatattttgagtaggaagactacaaagcctatcaaaaattataattacaattttttaagcgataatataaaaagataaatagaaacaatggccgggcacggtggctcacacctgtaatcccagcactttgggaggctgaggcaggtggatcacgaggtcagatcgagaccatcctggctaacacggtgaaactctgtctctactaaaaatacaaaaaaattagccgggcgcggtggcgggcgcctgtagtcccagctactcgggaggctgaggcaggagaatggcgtgaacctgggaggcggagcttgcagtgagccctgattgtgccactgcactccaagctgggcgacagaacgagactctgtcaaaaaaaaaaaaaagtagaaacaacaaaaagtcaaagagggggatggagtttggagttaaactgtagagttctgttttcgttttctcttgactttttttttttttggtaacgagttatcagtttgaaatagttgtttataagatgttgtttgcaagcctcatgaggcttttattttgaggtaaccatgtaacctcaaaacaaaaaatctacaacaggtatacaaaaaatgaaaagcaagaaataaaactatactaccagagaaaatcatttcaacgcaaagaaggaagggaggaagggaagaccataaaacaagtagaaagcagataacaaaatggcagtaggaagtccttacgtatcaataataacattgaatgtaaatggactaaagtctctaatcaaaagacacagattggctgaatggaaagaaaaataagacccaaccatatgctgcctacaagaaactcacttcacctataaagatatacacagactgaaagggctggaaaaaccagaactcctctttttccatacaaacagaagccaaaaaaagagagcagagtagctatacttaatgtcaggtaaaataggtattaagataaaaattattaaaaagagacaaggtcattatataatgataaaaaggtcagacaatataaaaattatgtatgtgtgtatctatctatctatctatctgtctccacacatacctaacactggagcacccagatatataaagcaaatattatctgagctaaagagagataccatcacaaagaaggcaagaaaacaaacaaaaacggaaaagagccagagagagagagagactcaacaatgcaataatagctagagacctcaacaccccactttcatcattggactcaaaatcaacaaagggccaggtgcagtggcttacgcctgtaatcctattagtttgggagactgaagtgggtggattacttgaggtcaggagttcaagactggcctggccaacttggtgaagccctgtctccactaaaaatacaaaaattagccaggggtggtggcaggcacctgtagtcctagctattcgggaggctcaggcagaagaatcgcttgaaccctagcagcggaggttttgttgagccaagattgcaccactgcactccagcctgggctacagagtgagactccatctcaaaacaaacaaatgaacaaagaaacgtgaccaaccaggggcggtggctcacgcctgtaatcccagcattttgggaggctgaggtgggctgatcacatgaggtcaggtgttcaagaccagcctgaccaacatggagaaaccccgtgtctactaaaaatacaaaattagctgggtgtggtggagcatgcctgcaataccagctacttgggaggctgaggcaggaaaatcacttgaacccaggaggcggaggttgcagtgagccgagattgtgccattccactgcagcctgggcaacaagagcaaaacttcatctcaaaaaaaaaaaagggagggatcaagattttttttttcttagtatacttttcttttccaatttcattgctttggcaccattatagaaagtcaactgatcatatatgtgtaggtctacttctggattttctgttctcttacaatgatgcctattttttatgttaacactacacagtattactgtgtcttcatagtgtgtctcaaaatcactgtgagtctggcagctttatcctttttccagattgttttggcaattctgagtcctttgcattttcatataaactttaaaattagtttgtcaaactctgttgtttagtaagcatgctggaatgattgggattgtgtttatacattagtttggggagaatggacatctaataatagtaagcctttcagtgtatgaacatggtatatatctttgcatttattttttctcagtattatctgtaatttttagtgtatacatcttacatatacattcttgttaaatgtatccttaagtatttcatgtttctgaattggctatgaacagaattttaaaaaatattatcttctagttgtttgtatatagaaatacagttgatttctgtattttgactttgtatcctctgaccttaccaaagtcatttattacttctaggagcttttttgtatattctgtgaaattttcatagacacttataagtagtgacagttttatttcattctttgcaatctgtatgccattttttccttgccttactgcactggctaagactggctgcagtgttgaatagaagtaatgagagaggacatctttccctagttctcagtcttggaaagcattcagtttttcactactgtgtatggtgtcagctgtaggctttcctattattcctattttcctgagagtttttaatcataagtaaatactgaatttcatcaaatgcttttcctgcatctaagcagatgaacctatggtttttcttctttattctgcgaatgggacccaaactgaaggagcagcacctttcctgagacatggcagtctcacatggtagctctgaaagtttcaatctgatcgtgacataacttcacttctgcttattacatccttttgattaaagcaaatcacatgacaggactacacttctctctttgggagggcagagaagtcacatggcaatgggcaagtctgtataatcttctcacagggagggcaacaaataattggggtcagtgatacaatctgtcatgcacattgttcttaattatgtgtacaggttaaatatcccttattcaaaatgcttgggactagaagtgttttgaactttggactctttcagattttgtaatatttgcatatatataatgagatattttgggggtagaaccaaagtctaaacacagaattcacttatgtttcatattcaccttagatgcatgccctaaaggtaatttacaatattcttagtaattttgtatatgcaacagtttatgtacattgacccatcagaaagtaaaaatgtcactacctcagccacccctgtggacagtctgtggcatcatgtcagcactcaaaaagttccagattttggaggatttcaggtttttgggttagagttactcagcctgtataaagctctatgtatgtctatgttagtgtgttagaagaagaaaatgatttggaaagataggtgaagtgtatctttttctgtattttctaatttttatacaaaaatctgttttacaatgtagaaaacattactttttgagaagaatatacatctggttttatttactactgtattctaaatatgattccttgttttagatactcggaattaaaaaaaaaaggatactcagaatttttaatctggaaaggaacattgtttattattttcactatttccttctacccacctcactcccccaggtttatggatgcagaaactgaaaagcttaagtgattttgctccaaggtcatgaagacttaacagaagattcatttagagcaggacactatttgagtatcagaaagcgagaaggaaatcttgggaaattagtttcagagaatataaggtagtttaaaatgttttaacccaagtaatcaccaaattatgctaaaaaatacctgagaagggaaattgattcactcttttacaaatgtatgtggagcacttactactttatcacccactctacaactggaattttgagtggaatagcaagcatttctagattgtaaagggatatatattatgatataaaatatgtgttaggattgtaaaggatgcataaggtattatcaaagatgtttttctcaattttgacatttgagagacccaagcaagtaatcataataataactaaggtatttggctacttataatgtgctaaacagagttgtatgcattttacacatattcttttattactcttaaaaacttcataaggtaggtactattttctatccattttattagttgcggaaatcaaggtgcaaagaagctaaggaaattaccagtcatgtgactaatacgtggaagagccacaatttgaacttgagcagacttgcttcagagcccatgatcttaactgctgcttatatcatgtctgttgaacgagtctaacttgagcagacttgcttcggagcccatgatcttaactgctgcttacaccatgtctgtagatgcagtttcagggtctcactccgtcgcccaggctggaatgcagaggtgtgatcatggctcactgcagcctcgacctcctgggctcagtgatcctgctgcttcagcctcccaagtagctgggactgcaggcatgcaccaccacacctggctgattttttatttatttatttttcttgagacaaggtctggctctgtcacccaggctggagtgcagtggtgcaatctctgctcagtgcaacctccgcctcccaggctcaagccatcctttgaacctcagcctaccaagtaactgcgactaccagtgcacaccaccacgcccggttagtttttgtatttttttgtagatacagtgtttcgccatgtcacccaggctggtcctgaactcttgagctcaaaccatctgttggcctctcaaagtgctgggattacaggcgtgagccactgagcccggcctgattttttatttttttgtagagacagagtctcattatgttgcccaggctggtctcaaactcctgggctcaagcagtttttccgcctcagcctcccaatgtactgggattacaggtgtgagccaccgtgcctggccccttataccattttctaatactatgattcctttctaaacaagagttgaatccaggttaaatatgtatatgagaaaatgaggtaaacaaggagccaagtcttcaggcacttgacacacaggtttagtagattaactggaaaactgtactttgtatatctttatttttgtattattgttgtgtattatagcttaatagttacaagcatgggcttagagtaagacctgggttcaaattctggttcattgcttcctacttttttgcccttgtgcaggtcaaaggtcagcaaatggaagctgctggtttttggtggtttggatagcctgtggtgatggctgcatttctttctcttttcttgatcaggtggatttgtttaaaaagagtcttctgttgattcctattcacctggaagtccactggtctctcattactgtgacactctctaatcgaattatttcattttatgattcccaaggcattcattttaagttttgtgtagaggtaagttaatatactgcctattttttcatttattttgtaattggccaaatagcatcttagctctagatagaacagcagcagtcaaaaccatataggaacagtttatgtcatgaaaatcctccaaagtgttagctgagaaaaggactagaagaggaatctctggctgaggagaggatctgtctaggatccagatccccctctgagatactccacttggattttctctgcttttcccttaaaactacatcttgaatgtggttagaaattgtttttctttgatcatcttagagctaaaattggcctgtatctgcaaaataactcctgtagaataaactataacctaatggaatcaattgacaaaatattagtgttcagctaataaacagatggtgggatacaaaatcaagaaaaatgagtaggtttccggattttcctgcactaccaagaaccagtaagaaaatgtaactgggaataagattccatttataaaagaaacaaaacataaataacccaggaatatgccctaggaagaaatgtggaaattctttattatgaaaactcctaaagctttaagtacttaaaagaaatctgtacaaaactgtaaaagtatttgaatgaaatatggaaaatgttatgttcacagagtggggaaggacttcttaacatggaaccaaagaaaagacataaggaacaattggataaatttaaccacctaataatttaaaacttctgtatatcataaagttaaaggacaagcaacagacttggagaaaatatgtatgatgcaaataacagacaataactatccagaatacatggaaaactcctacaaatgaataaggggaggataaaaggacataatagaaatggacaaaggctaatttagtaaattttaggaaaaatgcaaatgaccatttaaaaacacagagaggtgttcagccttaccagaaattatagaaatgcaaatgaaaactacatcagttaaattttttgcccattatgttagaaaaagtgatgctattcaagtgtctatgtaagtgtaaggaaataggcattctcatattttctggttagagtgtataaattgatacagccgcttggggatagttgcagttctcatcagttctaagtgctttgtaaattaaaaagatacaaattctgttgcatatcagttccatttcttgttatctactgcataaaaatgcttgtatatgcacacaagaatgaggcatgtgcgaggatgttcatggcagcattatttataatagtgcaaaataaaacaacccaaatttagctctagcaagagaatagctaaatacactatggtacggtatacccatactattaaactgaccatagtagttaaattgaatatagtagaccttcaagtcctcaaatggaaagatgtccaaggcatagagctttaaaaagccaattgtggaatgatacggtatagtacacaaatacatgcaggtgtatgtgtagacacatatatacatacatatttgtaagtaaaaaggtgggaccttaccattttttatatcaatgattattacctttgggtaagtgtagaaaagcaggactaatagttaaagaggatttggcctcattttgcgtttttttttttacaaggagaatattttcttgtattatttgtttaattaacatttaatttaaaaattaagtataatgcaaactatgaggaaaatcaagttttcgaaatccacattttcatttccaagaaatccaggaaaaaaaataccccaaaaacaagaagcctcgtgggcccagagttctcacaataccagatgtgagcgtcttttccagttcccttcccctaattccttgcctttctctcaaccaacatattcccatacctgccagagcctgtctatattgtctctttcctagacagacctgcaaaggtataaccaaaagtgcagccatatcagtgcctttaagactcagattctgacaggcagaggagagcagaggtgttgggaaaactgtttcaagtaggaactatttactgtgcctcttgctttgtgccaggcactgatgctagggagtcaggtaggggccagagaaacattcgccttcatggagtgaatgatggttaaacaggattttgtttgtaaaacatgcagttgggtttaagtcgattttgaatcattagggcctggttctgcacagtaataaaaattcatcttctgaatttttgcccaagccctcctgcagagttcttaccttttcagcaaaattacaattggcctaataattttgcacatttgcaaaaagaccctaagaacagactccttttaggtgatagctagaagtcatttagagccaaatacagttcagtcatctggccaggtggggtcaagctgtttttagttttaagaggatgtaggggttgtagaagtggctcttaactaaggggcctgtatttccaaagaattgacaaaaagtgttttaaacagtcaccacataaatgtgtagattccatgacagcagagactacaagagctttattcactagtgtccccagcacttgaacccttagagatgctcagtacattttgagtgccggtgaccatttttaaggacaaatcctttttgcctgtattttacttaagaatgtacatatactggccgggcagggtggctcacgcctgtgatcccagcactttgggaggctgaggcgggcggatcagaaggtcaagagatagagaccagcctggccaacatggtgaaaccccgtctctattaaaaatacaaaaattagctgggcatggtggtgcacgcctgtagtcccagctactcgggaggctgaggcaggagaatcgcttgaacctgggaggtggaggttgcagcgagccgagatcgcaccactacactctagcctgggtaacagagcaagactccgtctcaaaaaaaaaaaaaaaagaatttatatatactgcttattctgagaacttgaagttacttctttagagggagcagtgcaacatgctgtcatactttgttggatattaagtatttgctttcatcatgttttttcttctgaagaggtggcttccagtccacctttttttttttttttttgagtcagagtctcactctgtcccctgggttggagtgcagtggcccagtcttggctcatggcaacctccgcctcctgggttcaagcgattctcatgtctcagcctctggagtagctgggattacaggtgtgcaccaccacacctggctaatttttgtatttttagtagaaatggggtttcaccatgttggtcaggctgatcttgaactcctgacctcacctcatgtgatccacctgcctcagccacccaaagtgctgggattacaggtgtgagccaccgcgtctggccctggtccacttttgttggggggtggggtgggttattcacataacctctgacttcactcttgatgtggagagagacgcacagaggttgagagcactggggacattttgaaactccagcaggcttcatcttggtagatagttcaacagtggacttgagcatatttagtattcagaaggaattttagtattactttccagaagctgaatgttaaccttttctgcagccctcaaaaataaggagtgtatcagaatatctaaggctggaatatttttcatttagttttagttattaatgatgtctgccatgggttcctttcctctgttgagcatgggcaatgatgaagactttctttttgacttgccagtatgtaagtttcaaatgcagcaagctgacttactgctgggaagggctggctaaccatctcataaaacgttctgattacacaaatgccagcgtccacagtcttgatgcataccttgaatacagaaggtctgactcccccttaacaatatgaaatgaagagtctgaaataaagtcccggctttagccgggagcggtggtgtacacctatagtcccagctacttggaaggctgaggtaggaggatctctgaagcctaggagttcaaggctgcagtgagctatgatcacgccattgtactccagcctgggtgacagagcaagatcctctctttaaaaaaaaaaaaaaaaaaaattgttccagcttcttaatgcatattctgcccagttatggggccacagcctcctcctttccttctgtctgctatgggcatgttccatttttcaccaactgatggaacacagcatctgtgttgtggtttctttttaaccagaatataagaaagtatttgctgactgaagccagagaaaaaaatagacctgaatttcttcagggttggcagactgctgttacgaaggtaagtatgtgataacaatgaaacccaggcatgtccaggggatggaattatctaagggtgggtgcctttaagagcatttgaagactagtgacagagataccaaggagagcctggaggctccagggaggcagctgagaatgaacttcagttgactattcatcatcgctgctcagttgcccagtgcttcccgggagcaaatcacttcagtcatttcctccctgaggaagttgctaatgatgtgtttgctcttctggggaaaaaaaaaatcttttttgggtggcacttgcctcttgcatcatggctcttatttccagatgacccatatagacccagagaaatgctgaaatgactatttggatccactgagggggagaaagtgcattgagctacttggcaggcatgtggggaagatagtagcccaagcgcttcagtcccaccactgtctggatgcagcaccatgcttggcccatgacattcaaactgtggggcagagtgcccaggcacagccgctcattcctgtcgtaaataccagtgtcttcattgatggtgggctgtgttgtttccagtgtttttgtgtattggatctcatttgatccttataacctgtgaggtaggcaggtcatttagggataagcatcgtctttattttgtaaatgagaaaactgaagcccaggtgtgattttccccaaaggacatcaaaactattgatacagagtcaggtccttgaacacaggtctgtctggatcattgacaggatgttataggcaggatcttgaaacaaacctttaacccaaacccaaagagacaagatttattagttcacccttgaaccgaaccaaatgctaaattttaaaattaagcttaagttttgtgttttgaataacctagtataccagttcaaaccagaactagtaaatttcctgaatttacccaactaaaaaatctgggtattctaaatttagtcaggatcttctgtattaccgctttgagcagaatacagtaaccagttcttttaaaaacatactgttggccgggcacagtggctcacacctgtaatcccagcactttgggaggcaaaggtgcgtggattgcgtgagtctaggagttcaagaccagcctgggcaacatggtgagacctcatctctacaaataataaaattagccaggcgtagtcccagctacttgggatgctgaggtgggaggattgcttgaactcaggagactgagatcgtgccactgcactccagcctgggcgacagagtgagaccctgtcgcgaaaaacccaaaacaaaaaccatactgtttaccttcacgatttctttcaaagaataggacagggtcgtgtgatgtgagatcagaagtgaagactgctcagcggagttgtcgccatcctagcatccagaggctgggcctttgttctcccaggcacagttccattttgactccactgtcaatgaattgatagcagagctcagtatccaaatgcatgttttaaaacaggtttttacatttgatttcccatttctcatatttaggtaaaacattgtcctataaattggggttgccacctgatagctctttttatgtggccaggtgcctccataaaattagatgcttgagatatcagatataccagctgtcctggagagagaaaagtttcctatcttttgcgcatttttccataaaggagtttttcttatctgaagagaagtaatggatcttgttttaatgactattttgtttttcccttcagtgtattccacaacagaaaaacgacagtgactgtggagtctttgtgctccaggtaaagaaacacttgcttttcggaacttacaatgtgtgaattgagtctgttgggttgagaggggagagatggcagttcctgtatgtgtatatgatgctaggtacgagcaacggagtactttccctcccctttattgctgaggagcagtagtttctgcatgttcagatgttatcattaggaagaaccaccttccagggatcaagagtgaagtgtgggtgtcatccatgtctcactggaggttattagtaagccacattggagactgacttgaatttgtccatatcataaccattggcatttgcataaaaaaaaaaaaaaaaaaacattggcaagcaatctgcaggtctttgacacagtgattagattttaaataaggtccacgttgagaaactgccatcttgtgctgtagatctccttagagatcgaaaagggctatggaaaaaaattcagttatacatatatttatgttggaaattacagaatatgatgcatgaatttagagatttgcaaagatcttggaagaccggttcgtttgtatacctcatgcatgtttggggttttataaacaaattcaagttcccattaagggccatgatgggtctagctgcactccagcaggttgcactttgggaggaattgaggccttttcatcagttgctgcttttcacagtattgggtcaggagggagaggagatcccaagccatgcactagcttggtcagtcacctataatttgggtaaatgcttaaaacagtgtatttttacagtagtttaaacagacatgaaaatgctgccttagatcggggtcccaaacccctgggccacggacagatactgtccacattaggttctcttaggagtgtgaaccctgttgtgaactgcagatgcgagggatctaggttgctcaccccttatgagaatctaactaatgcctgataattcatcctgaaaccaaccccctctcccccaagtctgtggaaaaattgccttacacgtaaccagtccctggtgccaaaaaggttggggtcttctgccttagacactattaggtctgcatttagtaaaacagaatgggctggtccacaactccaagtgccactgaagtgtttctgggacctttttttttgcagtactgcaagtgcctcgccttagagcagcctttccagttttcacaagaagacatgccccgagtgcggaagaggatttacaaggagctatgtgagtgccggctcatggactgaaactcagcagggactctgggaagtctgaccaagttggagcagatggtttgttacttgaatctccaaacacttagttgaatttttacagatatttcagatcagtggtgttgggccactattgttacctcaaatttattttttgcccttattcatttctccagctaccatgtactattgtttaatgttcagtttggtttcatttttaattttatggttctgtgcgtcccccatatttaatatttattattcaaacgcatgcatatagacagagcatgcagtgaagagtattaaaaaaaaaagcttagtagatttggtgcagcttttgaaacttagttagacgtgaactgaatacaggtttcaaatttactcccagaacctaaaaatgcaagatgtttttgatacaacataactctgagaatagtaagtgttccctggggcattaagggtagctgggggtggttttgacaaatccagtcctgttttactttaccagcggcaactttcaccaacttccctctccaagtgagtcttagagagtgcagtccattccttttgaagggtgagatggaagtggtcgtaaactgactggtgtcttctgtttctggaggcacacttgtaagcacagtggctgctttgggaggagtaaggtgtgagaaaaagcaaccttggaggccagtaacaatgacagatttcaatcgtggttttaggaattataatacgtggcatacatctcataaaggcttttgctgggatattgaattccctgaatttttctgttttcgacctgttaaaaaaatcttaacatccatcaaactagtggtcaaacaaatgagaatgcagctgttctcagagtaatttttaagttgtcatttccctgtgttgcctcccaattggaagaagttaaggtttaccaaatgcatttctatttcaagggtatctgaaacgtaaacattcaaaactgaaggctgactgacttgagatgttttgcaggtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgccagaaatttgcctctgattttttttttttttttttttttttttttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttgtttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacccctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataa

SEQ ID NO: 2016 - DNA, 92792 bp, Homo sapiens
cgtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggtaagtgcacacaggccggccggcgcgggacgcaggccgggtctcttcctcctccttccttctccgtggcctggcgggcgggagcggcccgggacggccgacctgccccgcgcggggccggggagccgccacctgcgtgctgggagccgcagctcctggggcggtggctcattgtctgctccccagggccgttttcttcgctggctttagccagaaatgggaagctcgctgggctgcggaggtctgactcttcctggacccagccctgctctgaacctcgcggcaccacggtctctgccgactctcggtcttccctcccctcgcgtttcaccctcttcctttgctccgttttcttaatgctggaccagactctccggttttgttccttgatttttcctctcactgattctcagcccctgcttgctcgctctctgttcacccgtttcactgctcaggaatattgtcgcgagtagcttgactgttttctcagctccagcctgtaacctcttttccacattccacattggtaaaaacgtagagcgtcccgggcgcttgagggccaccgcttacgaactgatctttcggagcttctcctcgctcctgtttgagcttcagcctaggggtgaaatttgcttctttagataacttaggtgaagttaagattggtttttcaccatgtttggctctcttggaaacacacgcacgcacaaacacaaaacgttgccactcaaccttttaactaattctttaaagataagtcatccaagaacagaagcgtgtcatcgtcagtgggtgtgaggttgtacccatccttgtatcttaattttagtagtactctccctgggcagtgtgagcgtgatttgttgtcccttgataaataacgaactccggttgatatcattatctcacttctgcgttacaggcgatgtgtcctttctttgttttcttttttaacctttataaaaagacaaaatggttaggcctaaaattaaactacgaagagctgtgttttggatcaaggttgtgcacgtcacgttttttcccctgctgtgttcgactcttccgctcttataagtaggcaggatattgaaatgtacaagaatttgctctggggattttgtttttgtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggtatttcacttcccttagggccttggtttatggtttactctcattcagagagagatactattctggactccgtgctatttaatactaaccttgcaaacccaaattcaaaattaagtttatagttcgagtatacaggcgatagggctctctgatctttatgatagacaggttcccaagtagatgcggttaacaattaatatttcttttttttttttttttttgagacggagtttcagttgcccaggctggagtgcaatggtgcgatcaccgcaacctccgcctcctgggttcaagcgattctcctgtctcagcctgctgagtagctgggattacaggcacgcgccaccacgcgcggctaattttgtatttttagtagagatggggtttcaccgtgttggttaggctggtctcgaactcccgacctcaggtcatctgcccgcctcagcctcccaaaatgctgggataggcgtgagccacggcacaccaccaacagtttctatttcaattatactttttaagagagactagaacttgttcaggtagctaaagataaactttcaattatacttttctaatatttaagaacttcaagtagccaaggataaaatgagtaggaattgttagattcttccttttatccatcaaaatcgattattattataataatatttgagtatatttcttttggctttctgacttttacacttttggttaaaatttgaaactgggtcttcttcgccgggcgcggtggctcacgcctgtaatcccagcactttgggaggccgaggcgggcggatcacgaggtcaggagatcaagaccatcctggctaacacagtgaaaccccgtctctactaaaaatacaacaaaaaattagccgggcttggtggcaggcgcctgtagtcccagctactcgggaggctgaggccggagaatggcgtgatgaacccgggaggcggagcttgcagtgagtcgagatcgcgccactgcactcccgcctgggctacagagcgagactccgtctcattaaaaaagaaaaagaaaaagaaactgggtcaacttcaagactttaagtcgtaaaggtttccatcagtttggtataagagttgagtttccagactaatcagagggagggtgttaattgcaaattgtgtgtccaagctcttcctagtatcctttttgtgccttaacagagcagaataggaaaggaaaaaaatccctcattgcccccaaaaaataaaatactggttgttttcttctgtgatcagagttgagtttcatcacttcttcccttctagggtcacctgcctggttaagggtagtcagtctgaacattcattcaggatttcagtgttccagcctactatctctgagtttctttagtacttactccatgtatcccatgtggttaggagctagagtcctgcgtttgaattcttgctgttctactttaccctgggcaagatatacattcttttcaagacttgcttttctcacctgtaagatggggataataataataataccaatttcacagggatatttagatcaaatgagggaatgcaggtaaaggattctgtaattataggtcttaataaacgttagttaatagtctgttcttacatgctgtagagtcgatactcctaaacttagaattaaaactgccttctaggccgggtgcggtggctcacacctgtaatcacaacacattaggaggctgaggtgggccgatcacttgaggtcaggagttcaagaccagcctggccaacatggtgaaacctatattctctactattctttagtagagaatttagtattctctactaaaaataaaaatattagctgggcgtggtggcgggcgcctgtaatcccagctactcaggaggctgaggcaggagaactgcttgaacccaggaggcagaggctgcagtgagctgagattgcgccactgcacttcagcctgggtgacagagtgagactccgtctcaaaaacaaacaaacaaacaaacaaaaaactgccttctaaaagaacgaagtttctgagaccgtaactaaaaataaaaattacttttggatgaataaaatgtaatttttcaggagaaaaaatatgtaatagtttcaccactgaaataaaacatagggtttttgaacacaaatttctcagatttaaaaatatgcatatttcctgtataaaagttgaaaagtgggcagtggctggtggtgcctgtagtcctagctacttgggaggctgaggatcctttgagtccaggaatttgaggtcagccaggacaatacagggggaccccatctcttaaatcagacaaaaataaaagtagaaaaaaatattaaataagaaatttggaaagtggtaaaaacttttaagacaaaattaccttagtctcagctggcagaaccattgtaacaaactggaacagtggttttgttccttattttaaatttaaattctaaaagcagtacatatttattataaaaggttcaaacaagtcaattaaatatttaaagagtgaaaattctttgggagactgaggcaggaggatcacctgagctcaagagttggaggtatagtgagctatgattgcaccattgcattccagcctgggtgacagagcaagaccctgtcttataaaattcttaaaaagtgaaaattactttctctttttagtcccattccttagaagtacctacccgctgttaatagttttacttactgagttagaaataagtagtaccttttgtgtgtcggatactttttatgttgattttaaaataaaaaatctgatcattaagtattgttttccatatcatgacatatagtggcacctctactttttaagtcattagatattatgctgtatggtagtactttaattatttgtgatcatttatgttatttctaactttgagcaactaaaactagagccttaatgaacttatacgtatgtctttgtgcacatgcatatgtagataagtatttccattaaaacgacttgtaagtgtgcatttaaatttcttttttcttttttttttgaattgcattccaaaaagacttgtaatgtatatttccttattgagttgtagaagctcttcacatgtaatagatattaatctattgccttctgtttaagatcttcctcattccacctttacaaaaaacattcttatgtgttttcttctggtacttttaataattattgtgtttcaatcttttttttttttttgtgacagagtctcactctgtcactcaggctggagtgcagtgttggatctcagctcactgcaacttccgcctcccgggttcaagtgattcccctgcctcagcctcccgagtagctgggattacaggcaccataccatcgcacccaactgattttttttttttttttttttttgtagagacggggttttgctatgttggccaggctggtctcaaactcctgacctcaggtgatctgcctgccttggcttcccgaagtgttgggattacaggcgtgagccaccgtgcccagcccattgtgtttcaatcttaatctttctggaattttttcatgcctggtggggataaaagagttttaaaatagttttgctacagaaataaaatacaggtataaaaatatttggccgggtgcagtggcttacgcctgtaatcccagcactttgggaggcctaggtgggtggatcacctgatgtcagcagttggaaacagcctaaccaacgtggtgaaaccttgtgtctactgaaaacacaaaaaattagctgggtgtggtggtgcacacctgtagttccagctactccggaggctgaggcaggagaattgtctgagcccgggaggcggaggttgcaatgacctgagatcaagccactgcactccagcctgggcaacagaacgagactccatctctaagtaaaaaaaaaaaaagaagaagtagtaactagatttttctgttcattggtatttttattatcttactggacttcagtaaacgtctttattttgttttccaggttcattgttttatctgagaataatagtaacttcagtcacttttctatggttacaatatttaaccttttttttttttctttttctttcttttttaaagacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtggctcatgcctgttatcccagcactttgggaggccgaggcaggtggatcagctgaggtttggagtttgagaccagcctgaccaacatggagaaacctgtgtctactaaaaatagaaaattagccaggtgtggtggcaggtgcctgtagtcccagctactcgggaggctgaggcaggagaatcgcttgaacccgggaggcggaggttgcagtgagccgagatcgtgccattgcactccagcctgggcaacaaaagtgaaactctgtctcattaaaaaaaaaaaaaaaaaggataggcctttatgataacttctgtagttaacttctataacctattcaggaatccttattcatgagtcacttttgataattcgtatttcctagatcatttcttttagattttcaaatctgttactatataggtgtgtataatcttttgtcattaagatctgtggtattcatttccttttttttattagtgatttcactatttttctgaatttgccaaatgtttgtctacttagtggttttttttactaaccagctttgagatttacttattgtattggtttttttttgtttgttttctgaatgcctgatttctacttttctctttattttgctctcctgctttttttttttgttgttaacaatgttaacattaagttaatgttaatgttattaattcttaatgaattcttagttcctttaatgtgttttcgatgagcggtaatcgctcctcggatagacctcattggctacgataccgccactgtgcaaagctagttcattttaatgtcttttaataataaaaacctttaatgttcttaatttgcttttgaatgcagcgttggctgcacattctaatttacatggacaatgttcttctgctcagtattttccaaatagctggtggttctagttttgatttcctctttgactcaggaggtatttaggataattctattcactcatattttctttcattgttgtcagcttctataatcttttaaaatatcttttaaacttattgagtgtttcttgtgacttaaaacataatccattttggaaaatgttctatgaaaacttagaacattttctgttggtaatatacagagttttatacataacctattgattaaatttaatgactaagattatttgtatgaattaccagtttttataaatagttcttactaaatataggacttagtctttattagtcctagtaagaactatagtcgttattaataattcttattaatgtaaaaatcttcctaatctgccaaagacaaagaggtagcattgtttctgagaagcttgttctcacgttgggacctttagatttttatttcttctgcctgaatgtcactgaggccatatttgaaagagatctttcatgatcacctctgcctacccccactccgcatctaacttcctgcccttcagtgtgtttattttcctttatagcacttccatctgaagtttctttttcatttatttggttttctttaatatactattctgttttacagagctttgaacaaataggtatgaaataagtatgtgttggttgagtgtcactctcttatttctaatgatttttagaaatttttattcattttaattaatagactttgcagcattttaggttcacagcaaaactgagcctaaggtacagagttcccatataccccatgctcctcatgcccctcttctccaagcctcctgctcatcaacatcctgcatcactgtggtatatttggcacagtcagtgaaccagcattcacacatcatcactgcccaaagcccacagtttacgttagggtttgctcgtatggtattgtacattcagtgggttttgacaaatgtataacaacatgtctccaccagtatcataccgactggtttccgcaccttaaaactctctgctccacctgttcctcccacttttactgcaacccctggcaaccgctgatccttttactacctccatcgcaatgccttttccagaatgtcccgtagttggaattatatagcgtgtagccttttcaacttggcttctttcacttagcagtatgcatctgaggttcttccgtgtcttttcatggcttgatagctcatttcattttagcactgaataatattccattgtctggatgtacattcacctattgaaggaccaggtttggtgattatgaataaagctgctgtaaacattgatgtgtggagttttttattgtggtgtaaaatacatgtaacagaacttaccatcttaaccattttgaagtatacagttcagtggtactaaatacatttatagtgtgcaattatcaccaccatccatctccgaaactttccatcctgcaaaactgaaattctatacccattgaaccataactcctcattctcctttctgtctgcatgattttggctactcttatgtaccttatgtaagtggaatcatattttgtgtttttgtgacttatttcacttatcctcaagcttcatctgtgttgtagcatgtcagaagttcttttcttttttttttgggtgaatagtattcccatgtgtgtatttaccttattctgcttgtccatttattcatcagtagacacttggattgcttccgtaatttaggtactgagattaatgctactacgaacatgggtgtacaaatacctctttgagaccttgttttcagttatttcgggtacatacccagaatggaattgctgggtcatatgataattctgtgtttcattttttgaggaactaccgtattgctttccacagcgcctgtatcacttcacgtttccaccagcagcgcacagcagttcagtttctctacatcctttttaacacaaccgttgttgtttttaatagtagccatcctaatgggtattaggtggtatcatgttagttttgatttgcatttctctagcagttagtgatgttgagcattttttcatgtacttattgaccatttgtatatcttctttgaaaaaatgtctattcaagtgctcatgtgtaggttttcgggtggacataagttttcagctgatttgggtgaataccaaggagcatgatggctggagtgtatggtaagaatgtatttcattttgtaagaaactgttcaactttcttccaaagtggctgtaccattttgcattcccaccagcaatggatgtgggggttcctgttgcttcacatcttttccagcatgtcatgttatcattgttttggattttacccattccaataggtagtagtgtttcattgttttctgttttttttttgagatagagtcttgctctgttgcctgggctggaatgtagtggcacgatgagaactcactgcagcctcgagctcctaggctgaagcgatcttctcacctcagcctccagagtagccaggactacagatacgctaccttacctggctatttcttttttttttttttgaaacagagtttcgctcttgtcgcccaggctgtggtgcaatggcatgatctgggctcactgcaacctccgcctcctgggttcaagtaattctcatgccttagcctcccaaatagctgggattataggcgcctgccaccacgcctggctaattttttgtattttttttgtagagatgggatttcaccatattggccaggttggtctcgaactcctgagctcaggtgatccatccacctctgcctcccaaagtgctgggattacaggcgtgagccaccgtgcctggcctatacctggctaatttttaaaatctttttgtagagacggttcactctgttgcgcaggctggtagatacttcttttgcagatattttttttctaagtctgtggtttaagttctcattctcccaactctgatgatttctgtcatgttttgattcagtattatttggtacgtgtgtaaattctacactgctcaagatcttcattatgaattgtacctcatccatgaaaatgattgtcctgtacgatcatgatttaacatttttgcatcttatattttgcttgtcttaaattcctgttgtactttgttttttgttcaataaattattcaacattatctttccttgctgttttttgttgtgtctttttaaaattgcgtgtagtttatttttgctttattccaaagtgaatgcttaaaacatattaatgcttaaagcattaaaaatgaatgcttaaaacctaaaataaagtttaaaaaaaaaaaaaaccaaaacatgtttattataataaatgctttctggtatgtttctgttattttatttaatgctttctgttttttaatgattaattgttgctttttttaattgttgtaaaatacatgtaacataaaattaccatcttaaacgttcttaagtgtacagttctttggcattaagtactcacgttgtggtacaactttccctaccatctgtcttcagaatttttttcatcttccccaactgaaactcggtactcattaaacattaactcctcattccctacctccagcccccagtagcctatctctaatctgttttctgtctcaatgaacttgcctcttctggatatttcttataactggaatcgtgcaatgtttgtccttttgtgtctcgctcattatttcatgtagcgcagtattttcagggtttatccattttgtagcatatagtataggttgagcatcgctaatctgaaaatccaaaatccgaaatgctccaaattccagcactttctgagtgctgacatgacatcacaagtggaaaattccatatgtaagtacttaatgcaaaccatgtttcgtgcacaaaattatttaaaatattggccaagcatagtggctcactcctgtaatcctagcactttgggagggcaaggtgggtagattgcttgaggccaggaattcaagaccagcctggccaacatgctaaaaccccgtctctactaaaaatagaaaaattagccagcgtggtggcacgcacctgtaatcccagctactcgggaggctgaggcatgagaatctcttgagcccagagggcggaggttgcagtgagcccagatcacaccactgcagtccagcctgggtgacagagcaagactgtccccccaaaaaacacacaaatttatttatatacatatatatatatatatatataattcaggctatatataaaaggcatttatgaaacacaaatgaatttcttttttttttttttttttttgagaccgtttcactcttgttgcccaggttggagtacaatggcgcagtctcagctcactgcaacctcctcctcccaggttcaagtgattctcctgcctcagtctcctgagtagctgggattacaggcgcatgccaccactctcagctaatttttgtattttgagtagagataggatttcaccatgttggccaggctggtcttgaactcttgacctcaggtgttctgcctgcctcggcctcccaaagtgctgggattacaggtgtgagccaccacacccagccacaagtgaatttcatatttagatttgggtctcatccccaacatatctcattatgtgtatgcaaatattccagtattagaactctgagacagttctagccccaagcattttgcattttggataagggatactcaacctgtagtacttaattcctttttaagggtgagtaatactccattctatgtattataccacttttgtttatctgttcacctatcaatgttttctttttttgctttgtaaattgtatttggtttgcttttatctcagatatttggaatgtatacatcctgtttttaaagtatattagcttaagtgaattcaagtctaaatctaaattgaaaaaaaattttctgatctgtaagcctgaaaaagaaaattgttttgactcttcctatatctgaagattataagatttttttctcttaaccctttctcactttatcctcctttcacctccgtggtgagcttgggacacagaatattgttaatgtattttttgtatatttcatgtttctaattccatcttcttttggtaattttgttttatttatttgtttgtttgtttgtttgtttgagacagagtttcactctgttgcccaggctggagtgcaatggcgcaatctcagctcactgcaagcacctcttccctggttcaagcaattttcctgacctcagcctcccgaatagctgggattacaggcgtgtaccaccacgcctggctaatttttatatttttagtagagacagggttttgtcgtgttggtctcaaactcctggcctcaagtgatccgtctgccttggcctcccaaagggctggtagtaaaagcatgagccaccacgtctggcctatttatttttgagacaaggtctcgctcttgtcccaagctcaccatggaggtgaaaagagggtaacgtgagaatgggttaagagaaaaaaaaattttttttttttttgagacggagtctccctgtgtcacccaggctggagtgcagtggtgccgatggctcactgcaacttccgcctcccgagttcaggcctgaatagctgggattacaggcacccaccaccacgcctggctaatttttgtatttttagtagagacgaggtttcatcatgtgggccaggatggtctcgatctcctgacctcgtgatccgcccgcctcagcctcccaaagtgctgggattgcaggtgtgagccaccgcgccgggcctgagaaaaaaatcttataatcttcagatataagaaggttgcccagtttggagtgcagtggtgcaacctcagcttgctgcagtctttcaggcagtcctcccatctcagccgcctgagtagctgggactacaggcacatgccaccacacccgcctaatttctgggctcacgtgatcctatcttcctgccccagcctccctaagtgctgggattgcaggtgagagccaccacacctggcctaattatttcttttatctcgctaattacatttagtattaacacaagttattgaaaccttgtttatgtgaattcattgctcattgccagctttctgttttacatttaaattcattagtcatgtataccatctagtgtacattttcagctagtattttcactaggagtacctggaagccacatttaatgatttagattgctaacttccctcagaaattctgttgatgttgttctatcgccttgcattaatcattttgtttttttcctgtgcctggatggtggtaggaattttcctttttctttttttaaaaatattttgacagattctgtcttgtacatgttcactaatgttgcctgaaacattagttccttatgatctttgtacttggtgctttttaaaaaatttccaataatacttttggtgattacttttgtttcaattgttctgtttccttccttgaaaacacatgtaattattaggttggctcaccatttctgtcccctatgtgaactgctcaaaagtttgcccttttttaccactcgtttgatttttctttttcacttctaatgttggctttatttctgctattgcaatcttaatttcttagtatccttttaaaatttatctcacttttcttaaattatcttatctcatcctggtttcttctctccatatactcctgttttgtgtcatttgctaaattgtgactggaagttcctgaagtaatttaccttgtaagttaggttctgcttttgtgtgaagggtaatcttccttgtggttttcttttgctattaggatcagtgctggatttcttactgcctacttaccattgaacagtaactgttatgtcctgtctcatgtgcatttgtcagagatgtgtgtgtgttttccttgcctctccaggggactggagttctgatgaaaccgcttctcagatgtatttctgagggataaatacacagctcccggcctgatttccagtgatgaacagacattcctcttcatatggtattctgggctagggtagtaggatcttaccctaccctgtttctgtctttgtgagtctgaactgatgatgtatgagagtggccctcatttctagcatgtgctgctgttacaggttttctgattctgatcttacacccacaacataacactctccttgttacttcactaaacctcccaggaagcagtgtgtccattcgggttttcctgcccttacacagccccgctggaaccttacctgcacacgggcgcagacacacacttcctggtttgctttctggaatttgcgcctggtaatctccctgaatgtatgttgagagatcacagaagataaggaactgtggctgccacaaaaactgcctctgtgtagcaaggagtggctgaccaattcttgattctgctttgattcttcaaagccgactctgagtctccaaataaagcgatggctagtagggagagacaagatatcttcatagttcttttaggcagatgattgaactttgttttatgaggcagagcatggctgggtcacgagtctttttgcagtacagttgaccttaaagctaattgaaatccttcaaagatctcatataaattgtattggtggagatttgggacagactacgttggagatttctgatttgatagcattatttactagagtaaacctgttccaattttttgaaacttaggtaatcacttaagtagtaacatcagtcttgaccttcatcttttaataaaagattttacctcagattgatagattttcactttggtagtaggagaatggtatcttgttccattttgcatctgtttgataaatctagtgaggctgaaaatttttcctatgtctatggaccctccctccccatttttccattttgaattgctatttggggttcatggccaaaattaggaaaaactagacttcagagtgtttacgcatttcttcttccgacttttttttttttttttttgagatggagtttggctcttgctgcccaggctggagtgcagtggcacaatctcggccctctgtaacctctacttcccgggttcaagtgactctcctgccttagcctcctgagtagctgggattataggtatgtgccaccacgcctggctaattttgtatttttagtagagatggggtttctccacgttggtcaggctggtctcgaattcctgacctcaggtgatccgcctgcctcagcctcccaaagtgttgggattacaggcgtgagccactgcacccagacttcttctttttttttttgagacggagtctcgctttgttgccagcctggagtacagcggcatgatcttggctcactgcaacctccgcctcctgggttcaggcgattctgctgcctcagcctccttagtagctggggttacaggcgagcaccaccatgcctggctaatctttgtattttcaatagagacggggtttcactgtgttggtctggctggtgttgaactcttgacctcatgatccgtctgccttggcctcccaaagtgcagggattacaggtgtgagccaccgcacccggccccttccaactttttaagtaatctttcttgttgctgacttgttgtctccctgttccctaccgtcaggcagttttgaagcattttctgagcctcgccacttgacttcctttacgctttgtcattgtttcagttttttaatgtggtgattgagtgaaagccaaggggaagaagaaaaagagaaaaaagggtcacatttgaattacaaaatgcctttacactccctgtgtcctctgtatatagataccttcctctctttctttgcctgacaaattccttttcatccttcaaaaagcaattctgggttttttttgcctaattactctcatctaaacaggagctccgggtccccctttccagtgcgttccactgggccctgtcagcagcttaactcatttcagagtagttgttatttgtgagctccaaactgagacttaactcttttaggcacttaataaatatttgaatgaatgaataaattaggagtattagtaacaaaatgcttgggctgggcgtggtggctcatgcctgtaatcccagcactttgggaggccgagctgggaggatcacaaggtcaggagttcaagaccagcctgcccaatatggtgaaaccttgtccgtactaaaaatacaaaaattagctgggcgtgatggcacgcgcctgtagtcccagctactcgggaggctgaggcagaagaatcgcttgaacccgggaggaggagattgtagtgagctgagattgtgccactgcactctagcctgggtgacagagcaagattccatctcaaaaaagaaagaaagaaacaaaatgcttattccttggtgctgcaatgaaatagcactcagcataaatttaactttctcagcaaggcagttttacttgctgcataaagggtgctcctcgcagatggaacaatggtgagagcacacctgaacaagggaggggaaggggttcttattcctgacacaggtagcccctattgttgtgtcattcccctgttggctagggttggactgcactgtctaagctaattccgattggctattttaaagagaccagggggtatgagccagagtggcaggctgagtagtttagtgggaaggacggttaggaacaggtaactcaaggtgacttaggtcagagcaggtgaccaggggtgactcaggtcaaagcaggtgactgggatgagtcaggacagagcaggtgactgggggaacagatgtgaactactgatgaaaactggtggaaaaggttgtttagtgaaactacgctgaagttaaactttaaaatggagggcaatactggttctttgaagagaaatctagaactcactgtatccaacaggagagatttacaaagagtttctgttattttttccatccacgtcatttccctgcttagtaacttctagtgtgaaaatatcaaaagcaggtatctctgagaagtggacttaggcttattcttcttttcttttagaccttattctggtttgaggtttttgtgatcatcatgtactacttttattatataagaataaaaaaaaattaaccccaaacccctcaaatttccaggcgcttcctgttgcccagaccctgcaccattctggccccactcagcctagttttatttcccactgcttgccagctgtgccctgtgatctccttgctgtctcatgagctacgtggtacttatgttcctgttgcctggaatcccgtcttctggtcaggaagatgatctgcgataaataccgagaatactcgcgttagatactgaatagtgagagtttagactcacgacctggggtgtcatcttgaacatacggtgcttaagggatgaggtttctgggtcagttttattggttgtgatgaacaagataaatggagcatttgtcttagcttctagaatagtgaccttaaaagagatagaacagtgaatgtatcttcaaacttgcctgggtctccactagcctaaagaagaaaaaaccctttaattctgatgctgtcacagatgaaatcctttcattcactgatttattcattcaagaaataatgactcatcacctactctgggctaaacacagtgtccagtgtgatggtgatgtaatggtcaacaagatagatactcactgggtccttgcctgtggagtttatacgtagttagagaagacagacattaaaagaagaaatccagtgtgatgaatgttgagataaaaggaaataaaccaatacttgtggcagtgaagaggtatcagaggtttcctgagagaatgacatttaagctagtacttgaagtaggtgtttgccaggtggaggtggtgggcagaaagtagagtcatcagttcattctggtttgtccacggctttcctggttttagcacgacacgtcccgtgtccggggaggtcatgtgcgaaagcttcagatggcaattaaagaaacagtaagaatagaaaaaacttaaagcctgaagagggaaagactaaagtgagatgagtctagaaagttagacaggagcctgatgatgcacgcactgttgggctttacctaagaaccatgagaaggttttaagtgggaggatgaagtgatagtatttttattttattttattttagtttattttattttgagaaagtgtctcgctctactgcccagggtggagtgtaccctggcatgatctcagctcacagcagcctccacttcctggttcgggcgattctcatgcctcagcctcctgagtagctgggacagcaggcactcatgatcacgcctggctaaattttatatttttttagtagagacacagtttcaccatgttgcccaggctggtcttgaactcctgacctcaagtgatctgcccacctcagtgtgccaaagtgctggcattacaggcatgagccaccacacccgtccaaggatgttaatttcttaaaaagggaaaaacttacacatttttattctcgtatttttctgtcactggatagaaacattactagcagagtaaataatccagatgcctgtcttcagcctttttgtcagacatgaagagtaagcatagaaggtaggaggcatggctgtgaggtcgttgaagtgatcttttcctgaacacagcaaatactataaatggtttttgtcaccattgaagtagtcccattgagagactgcctgattatcccagtgatgcttccactcttcagattatttctagaactcttctttttgcattgccctgggagcctctggcatattcttcagagtttcttcttcaccagaggcaaacttttcatccttgcctgtgcctctgtttcaggtcagtttctcttgctctctgcatctatgtttggcccaattggtttctttcttttccttaaaaattccttaaattttaaaaaaacagatattcatatacagtaaaattcaccctttaaggtatacagttaagtggttttttttgtttttttttttttttttttttttttttttttttttttttgagatagagtcttgctctgtcacccaggctggaggctggagtacagtggcgtgatctcggcccactgcaacctctgcctcccaggttcaagcaattcttctgcctcagcctccagagtagttgggactacaggcacgcaccaccacgcccagctaatttttgtatttttagtagagatggggtttcaccatactggccaggctggtcttgaactcctgagctcgtgatctgcccgcctcagcctcccaaagtgccgggattacaggcgtgagtcactgtgcccagccagttaagtgggttttttaagtgtgctcacaaagttatacagccgtccccactatctaattacagaatatttgcaccacctcagagagaaatactgcactgaatagcagtgactccttatttcatctccccgccggccccaaataccactaatctattttttgtctcatgaatggaatgatacaatatgtggtcttttgtgactggtttctttcatttaacacagtgttttcaaggtccatccatgctgtggcatctctcagcacttcattccttttacagtcaaatggtattccattgtatgggtgaaagagacagggtcttctatattgtccaggctagtcttgaactcctgggctcaagtgatcctcctgcctcagcctcttaagtagctgggatggtgcacacctgggttattttcagttttttgtttgtttgtttgttttgagacagcgtcttgcactgtcgcccaggctggagcacactggcgcgatctcagctcactacaacctccgtctcccgggttcaagcaattctcctgcctcagcctcctgagtagctgggattgtaggtgcccaccaccacacccagctaatttctgtatttttagtagagacagtatttctccatgttggccaggctggtctcgaactcctgagctcaggtgaaccgccggcctcagcctcccaaagtgctgggattacaggtgtgagccaccaagcctggactctgagtatgatttcttacctcattgttcatatttctacagtgataagtaggcatcatccatgtgcagccgcattatgggcctgtaaccatgaccggtctgtgagtttgagcagtttgaatgcataaggatgcattcttatgctatccaaattatttgtgctttgctggtgaagattctgaaacaaggtgtgtcattagaaagtgtttacttgtttataacggccttaaactactgaaggtgtataggatatttatgagtcgtgattcaaagtgtgagtttaaacgtttgttggtgcctccgtgttaaaagcattatgttagatagtgtcagataggtacagagatgtatggaaagtgttacctgccagccagtttataatcttgtagaaaaaagaaaagttagggctgagcacagtggctcaagcctgtaatcccagcactttgggaggctgaggcggatggagatcaggagttcaagaccagcctgaccaacatggagaaaccctgtctctactaaaaatacaaaattagccgggtgtggttgtgcatacctgtaatcccggctactcggtaaggctgaggcaggagaaccgctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgacccccacctccctcccggatggggcggctggccgggcggggggctgacccccccccacctccctcccggacggggtggctgccggacggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtcttggccgggcagaggcgctcctcacatcccagatggggcggcggggcagaggcgtcccccacatctcagacgatgggcgcccgggcagagacgctcctcacttcctagatgggatggtggccgggcgcagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaacctcgtctccaccaaaaccagtcaggcgtggcggcgcatgcctgcaatcgcaggcactcggcaggctgaggcaggagaatcagacagggaggttgcagtgagctgagatggcagcagtacagtccagcttcggctccgcatgagagggagaccgtggggagagggagagggagagggagagaggagaaccgctttaaccggggaggcggaggttgcagtgagccgagatcgtgccattgcactccagcctgggcaacgagagtgaaactccgtctcaaaaaaaaaaaaaagaagaaaagttagaagccaggtgactgaatttcaaggaagtgtgcaagtaccatatggatggatgggactgtatcattctgggtccaatcaggagagagaagccatacagtaatttgaacatgaaaaaacataattgactgactataacagggtaattgagtaatgagggattagccagtaaaaaaatagagctctaaagaacattggaatagcaaaagtaagaagcagctacttcccctagggctgagatagaccccccaccccctgcctgggaaagagctattccttttcccagagctgagatccagaccttattggagagagcgtggttgtaaatcactgaatggcagagatgtttctgccatttaatggttctttgttggccatagttgttggacatctgccctttagggtgccaaggagaattattaactctgatacaaaactgctcaaaaagagtatgtggggtggctccctgttgcagtagactcagtgctgctggccaccttcccctattggagtctgatgctggaggagctgcctgcccatcaggagtcttgtgacaactggaaccaggaagcaaaactccttttcttctgtgatgtctctccagcgccctatatcgacaaagcttagcatcgtgtcccggcaaaggaaaaatgcttgaaggcctcagatccgttttcggaatggacagaaatgatgaatttggaatggagaggcactagatcagtaactggcaggagaatggtattaactgctgcgggagctcagagacggagcagaggtcacatgacagtaaaagaagtatttgagaaagagcttagaagatgagtagatttttaaattgaagattgcttacgttttcatggcaaaatagtatctgcattttagaaaaaatagaatatagacaagtattattgtctattttctatagaaagaaaggaaaggcactcagatcactgtctacaaagagatccagtgttaattgcttgataaaaggtgtctggccaggctctgtcacccaggctggagtgcagtggtgtggcacgatcacggctcactgcaagctctgcctcctgggttcatgccattctcctgcctcagcctccagagtagctgggaccacaggcgcccaccaccacgcccggctatttttttttttttttgtatttttagtagagatggggtttcaccgtgttagccaggatggtcttgatctcctgacctcaggtgatccacctgcctccgaaagtgctgggattacaggcgtgagccaccgcgcccggcctgctgctgcttttgtatctttgcagaaaacaattggcttttaggtgtaataatgctaaactttataaacagacactgggaaaaacttcctacttttggtatttcaactgtgaagtttatttgcataacttctttatgataagtttgtcaaataaacattttagcgctcttcaagtgacctttaggaagagattttctgatggaacatcgtatcttagaagtccattttttcttgccaggcgcagtggctcacacctataatcccagcactttgggagaccaagacgggcagatcacttgaggtcaggagttcaagaccagcctggccaacatggtgtgaagccgcatctctactaaaaatacaaaaaattagccaggcatggtggcgggtgtctgtaatcccagctactcgggaggctgaggcaggagaatcacttgaacctgggaggcggaggttgcagtgagccgagattgtgccactgcactccagcctgggtgacagagcgagactctgtctcaaaaaaaaataaataaataaatacagatagaagtcaactttaaagctaatacccaatttctaatttaatttaatttaattttttaaaatagcgtcttgccacgttgcccaggctggtctctaactagtgggctcaggcagtcctcccgcctcaccctcccaaaatgttgggattacagctgtgagtcactgcaccgaccccaaattttcttttcttttctttctttttttttttttttttttgagacggagtcttgctctattgcccaggctggagtgcagtggtgcgatctcggctcactgcaaattccgcctcccgggttcacgccattctcctgcctcagcctcctgagtagctgggacactacaggcacccgccaccacgcccagctaattttttgtatttttagtagagacgaggtttcaccgtgttagccaggatggtctcgatcttctgacctcgtgatccacctgcctcggcctcccaaagtgctgggattacaggcatgagccaccgtgcccggccttttttttttttttttttttttgagacagggtctcgctctgtcacccagactggagtgcagtggcgtgatctcagctcactgcaacctttgcctcccgagttcaagcgattctcttgcctcagcctcctgagtagctgggattacaggcacacaccaccatgctcatctaatttttttgcatttttagtagagacggggttttgccatgttggccaggctgggctcgaactcctggcctcaagcaatcccccacctccgcctcctgagtaactgggattacaggtgcgagccaccgcatccagcctgccaaattttctaaagtagttttgccagtttatactcctgccagctgtatataagaattctctttgtgccatattcctgataacacttgatttgaatcagccttcttgttttttgccaatgtagaaggtgtaaaatggtatctgctagaggccttaatttacatttcattaatgtctgaggttggacatattcttatgtatgtgttcattatttgtcatcacttgtgagaatagataatacaggtattactccattatattggtggttaaataaagggactaaaaggaagagtgatttggctttcagtatgcaacttgataagtggcagtagtttatttgcctagactggctaacattgtttatttgaaaaacacattttgagtttctgtgatgtatataacactttgctaggtgctccttgagaataaaaagagctataaaattagtatcttctttttttttttttttagacggagtcttgctctgttgcccaggctggagtgcagtggcatgatctcggctcactgcaagctccacctcccggggtcaagcgattctacctcagtctcctgagtagctgggattacaagtgagcaccaccatgcccacctagtttttgtacttttagtagagatgaggtttcaccatgctggccaggttggtctcgaactcctgatctcatgatccgcccgcctcgacctcccaaagtgctgggattacagacatgagccaccatgcctggcctcttttttaaatttttatttttatattttcttctcaaaacttagtaccttctcacaaagagtagagttcagtagaggaaatatgatacatcatggtagctgacaatagaggcataacctataaataatagagctaataacccggtcataatctggttaatgagtgtttgctaactgtgtaatacatataatacaaaaagttaccattatagataccataatctctaaagatgtaagaacagaaccagtgccaatttacattcaattctgttccgtattttggtcttcatttaattgtaaatgcaaataaggtgcatatgtcgtctacaaagcaaaaaagtacaaggattttcttaagtgatcagtggatggctatcttactacaagcagtattgttcattcttcataagctggtgattttatataatttacggagttccaaaagcgaatataccaaaaatatatattcagagaaatctaggttttaacttggtcccatctctcccaaagtaactattttttaaaattttggttcctccgccaaccccacccccgacccatgcggtaactatggatggtgatggatgtcttaatttgattgtgataattattgcacaggatatatgtatatcagatcatcatgttgaatatatgcaattttgtcaattatacctcagtaaagctgggaaaaaattatggttcttccatttaaaaaaaaaatagaaacaagtacaccccgtgtgtgtgtgtgtgtgtgtgtgtgtgtgtgtgtgtgtgtgtgtattgatacaccttccccccatctcttttggtaaatgatagcatcccatatatatttttttcttccaactggttttcacttcatatattatggagattactccatggcagtatatggagctattttctcatttgtttttatagcttcaaaattatttagtgtagaatgttctgtagttagttgagccattcccctatttatggctgtttgagttacttccagtcttttgctgttactgataatgctacagtgacagcctagtgcatatatctttttgtatttttgtgagtatatcctttggatagatttttagaaacgggatatatgggtcaaaaggtatatatgtagtcggtactcctaaacactgtgttatattgctttcctatgacttgaaaattgtagattattaaacctatcctcacagaattttaggaggaaaaaatcaattaatgccctgactataatagaaaaaaagaaaaggcgagcaatttataatgaaatacatgttttttgtttgtttgtttgtttgtttgagacggagtcttgctctgtcacccaggctggagtgcagtggcatgatcttggctcactgcaacctccgcctcccgggttcacgccattctcctacctcagcctcccgagtagctgggactacaggtgaccgccaccacgcccagctaattttttctgtgtgtgcttttagtagagacggggtttcatcatgttagccaggatggtctcgatctcctgacctcgtgatccgcccgcttcggcctcccagagtgctgggattacaggcgtgagccaccgtgcccggctgaaatacatgtttttatttgtaaatacttgatcacaactatactaaaagccattatgcagtgaccagagacttgtgtctatacataggggtgaccacagtgcggtctcatcatatggactctgctgttggtgactcaaccagcatgagcacagtattgctagtgacatgatttccaaaattgtgaataaacttcttggtgaagtctgagccaaagtacaagctcctcttggttcacatagtggttgcatatctggaaaattcagtgtatgctaaaactggaaaaatattttcatatgtgaaatagaattttgtcctcagttcagatcattataagttttaaaatgataaatcaacacgtggtgggacactgaggagttgtgagcacattgcaaaacatcggatacctgtggtccctgctcattgaatgccagcagaactgcttttcattcctaatcatgtttattttttactctctttgttttgattaattttgccgagatattttactagttttgcccaagacactatttttggctttattgatagtcctttttgtatattagttttctgttcagtaatttctgatttatcttgattatttccttcctacattctttggatttattttactgttttttatacttcttaggttggatgcttaactcgttaatttttagttctcctttattttatttatatatgtatgtatgtatttatttatttatttatttgaaacaaggtctcactctgttgccaaggctggagtgcagtggcaaccccaacctcctgggctcaagtgatcttcctgcctcagcctcccaagtagctgagattacaagtgcaagccaccatggccagctaattctttatttttatttatttttatttttgagatggagtcttgctctgtccctcaggctggaatacggggtgaaatctcggctcactgcaacctcctcctcatgagttcaagcgattctcctgcctcagcctcttgagtaactgggattacagacgcgtctcatcatgcccagctaatttttgtatttttagtggagacagggtttcaccatgttgcccaggatggcctcgaactcccagacctcaagtgatccaccgcgcccagccccccagagtgctgggattacaggtgtgagccaccgtgcccggcctacttttatttttttacagggtcttgctctgttacccaggctggaagttctccttttttgatgtaaacattcagagctagctgggcactgtagtgcacacctataatcccagcaatttgggaggccaaggaggatggatcagttgagcccaggagttcaagaccagcctgggcaacatagggaggccctttctctacagaaaatacaaaaattagctgggcgtgatggtgcacgcctgtggtgccaaccactcggaggctgaggtgggaggattacttgagcccaggaggttgctgcagtgagccgttattgcaccactgcactcctgcttgggtgacagtgagtctcaaaaaaataatataaataaaaattcagagctgtaagggcttcgtatcctagttttttgttgtgctgctggtgaaatatacataacataaaatgtattatttaagcatttttaggtgtataatttggtggcattaagtatattcaatgttgtacaaccatcaccaccatccttttccagagcattttcatcatcccaagcagcaattccgcatcccggccaggcgtggtggctcacgcctgtaatcccagcgctttgggaggccaaggcgggcggatcacgaggtcaggagatcgagactgtcctggctaacacggtgaaaccccgtctctcctaaaaaaaaaaatacaaaaaattagctgggcgtggtggtaggcgcctgcagttccagctactggggaagctgaggcaggagaattgcttgaacctgggaggcagggcttgcagtgagctgagatcatgccactgcactccagcctgggcgacagagcgagactctgtctcaaaaaagaaaaagaaaaagaaaaagaaattccgcatccattaagccgtaactctgcatgttgcactttgccccgtctctaatgacctttattctactttctgtctatgaatttgactaaggtatctcacttgagtgaaattaatacagtgtttgttaggccggacatggcagctcacacctgtcatcccagcactttgagagtccacagtgggaggatagcttgagctaaggagttcaagaccagcctgagcaacatagtgagaccttgtctctgctaaaaagtttaaaagttagctggggatggtagtatgcacctgtagttccagctacttaggaggctgaggtgggaggatcactggagcccaggaggtttagaccgcagtgaggtctgatcatgccattgtaatccagcctgagtgacagagtgagaccctatctccattaaaagtatatatatacagtatttgtccttttgtgtttggcttattttacttagcatattattttcagagttcatttttattaataatatatatcagaatttcattcctgagccagtatggtggcatgtacctgtagtctcagcacagctacttgggaggatcaggtgggaggattgcttgagttcaggagctgaagggctgcagtgctgccctctgatcatgcctgtgagtagccactgtgctccagcctgggcaacacggcaagaccccatctcttaaaaaaagaattgtttgtgtgtatatatgccacattttgtttattcaatcctgcaagttttttatatatagtattttattttattgtattgtattgtattttaaagacagagtccagctctgtctcctacgctggagtgcagtggcaccatctcggctcactgtaatctccgcctcccgggttcaagcaattctcctgcctcagcttcccgagtagctgggattgcaggcgcatgccaccacgcccgactaatttttgcatttttaatagaatcagggcttcactatgttgaccaggctggtctcaaactcctgacctcaagtgatctgcccaccttggcctcccaaagtgctgggattacaggcatgagccaccatgcctggcctgagttttttatatatagtctttaaatctccattcagttctaaatatttttcaattttcattatgtctttttttaactggggtttgttggaggtgttttcaaatttctaaacatgtatttctttcctagttatctttttgttattttaaacttaattgactttaagagtgtgtagtgattctggtcttttaaaaaaaacaattgtctcaatgtttctgtttacctcattcttaaaaaatagttttgttgagtttgcagtttatgttggcagcttcttgtctcaacacactgatgatactccactgtcttcttgctttcattgttgatatcaagaagtaagctgaccattcaattactgcttctgtgaaatttgtctttttttctcctttggccaattttaggaattctttgtctttgatattattaatatcactacgatgtgtctacttgtagataattttctatcctgcttttgattcattagacttctacttacagatttgtgttctttatcagttctggaaatttctcagctattaatttgttcagtggaccagtccttcattctaccaccttctggaactccaagtagttgtatgttagaccatctaatctactcatctcctctttcatattttctttttctgttttttttgagacagagtcttgctctgttgcccaggctggagtacaatggtgcagtctcagctcactgtacctctgcctcccaggttcaagcaattcttccgcctcagcctcctgagtagctgggattacaggtgcttgccaccacgcctggctaattttgtatttttagtagagatggggtttctccatgttggtcaggctggtctcgaactcccgacctcagatgatccacccgcctaagcctcccaaagtgctgggattacaggcgtgagctaccatgcccggcctcctctttcatattttctatctcattgtctgcaatgagttcattagttcattgttcattaattctgtctaacactatgtctatgctgctttttacttcaaatgttgagttttagctttcatttattttttcttattgaaagttctgtatggtgttttcatattcgctctattctgcttttattttcaagctgcttctatgtgtcctttgacacagcattccatatctgtgtttttcagagatttttcctcctcttgccatcaccattttcaaaatgctaaaggttctcttgttcctttctgtccagagggatttattcctgattggttgttatgtgcattatagcctttttcaggcctagccttatgtgggagggacgcctgttaatttttcaacattaggcagactgggttttactacctgtcccctgtggcagccatcaaagtggaagcatgaggtctctggggtttagtcagaatccctcgagaataagtagattagtaaattgcttactctttttgagttcctggttttgctttggtttgggctctatggaatcatccctcttattttactagcccatccatgcatttaaaaagacttgatacgttatccagacctttatcttagagtttgaagcgaagttttagtttccttcttttttaccagcctccagattgtgttttctgcatctcttttctcgctttccctcttttctttctggatttgctactagtgggactgatgttatggccattgtcaccgtcaccacatgagaacactcttgcttcagagttgtgaaccttctgtttagagtgtgtgttgtcatcttcaggtgatttggaaatgttttcattcatgcttctgctctcaaagacatctgaggctcttttgtgtttttgacggggcaggtggggagggaagggccactggtgttgggctcttgcagcttattgagagattgttgaaagtctgggtgattaattagtgttactgcattcataatgtactgaaaaattaaggctcacttgttatttatataaaaagtaaataaaaatgctttttaaatcattgtgtttttcagtaatagatggtttacacttggagtactgtagttgatcccagcagataatagtaagtttagtaatctccactatttgggctgaccggttccagataccactccgctgttcgtttctgctgtatatttagccacccctagtctccttcagcagacaattgaggaattgtttgtgtttgagtcgtgtcacagttaaacagtgggcctcttagaagagtacagtgtgttttgggcacactttttgtttcgcctacttgtttttcactgaaaagtagcaaaaagtgtttgaacagatttagagagaggcactacttaccgtttgctcttttttttgtaaaacatttgttactaatggttaagcaaaacataaggtaaatcagtattttaccatgaattatttttatacctaatattgtttttggctaacatataagatgaacataaggaaccttatcacagtctcatttggtacttttcaggcatttgacactgtcagaagtagcaattcacacacaaaaaatactgttttatggaaaagagaactgaaggtcatgaatcagctgtgaggggaaaagtataaatctttctaaatatatttttgttaatatggggtagttgatgttgtctagtgctgtttgattaagaaaacaagttcaggccgggcacagtggctcatgcttgtaatcccagcactttgggaggccgaggtgggtggatcacctgaggttaggagtttgagaccagcctgaccaatatagtgaaaccccatctctactcaaaaatacaaaaattagccagacgtggtggtatccgcctcccagctacttgggaggctgagacaggagaattgcttgaatccaggaggcagaggttgcagtgagccaagatcacgccactgcactccagcctgggcgacagaatctcaaaaaaaagcaaaacaaaacaacaaattcaattagccgggcgtggtggcgcactcctgtaatcccagctactcgggaggctgaggcaggagaatccaggaggtagaggttacagtgagccgagatcacgccactgcactccagcctggggacagaacgagactccgtctcaaaaaaaaacaacaacaaaaaaaatctgtggacacagtatggtaccataaatcagtaaacattgcctaatacatgcacagtacctgcctttgaattgcttgaggtcttaggtaggaaaagcagataaaataactaagggtttatagttgtaattcattgccgaagaatggcccagtatattagcataagtaagaaaaaagagcctgagattcagagttgttaggaaacttgagttctagtcttagttctgttagtaattagatttatgtgcctttaggctaaccacttacttttgggtaagttggttttttttcacatataaaacaaggcagatggactagatgacttaatcctttacaatcttaataccgtgtgaatttgttttcctgtgtaactcgagtttagaggatgtgagggatctttttgggcaaggactgacctcaggaaggaaatcattttcactaagccttgaaagatttggttgggtagataaaaggaaaaagaaaagctaagaatgcagaaatagatacataaaaattatttaggccaggaaagtctttggtgtatttgaggaatatgaggcataggattgacatggtgcagtcacgtgagatgaaattgactcagcagttcagagttcagtggccctaatgccagagtttagtcctcagtctgtaggttatgggcagctagtcaggacgatgtgtagccagggagagtcatagcacttgttacctttagtcaacttctgcatgataattaaggtatatttaaccaattctgacttctttctcccaacaaaaaaactgaacacagagaaaccctctagggagctagttattaggtggtgcaaaagtaattgcagtttttgtcattacttgtaatagaaactacttttgcaccaacctaatagaatttcttccactcaacaacaactgaaaacatagagactgagagaaatccagagatgatgtggtaaatccccagctaagcagctggtagaggcatcagtattgtatccaaggccatgcttatatttattgagatctagtcactcgtggtatattagaattgtggcggcatggttgtcatcttgaataatttcattagggacatctctgactcaagtttactattaaattagggttttgttcaggcaagtattgcttaaagggtacgtcatgttaattggaatttccttgagacagctcattcagcatgatagtgtgtagtcactaaaaagttccgaaaaacacaacgctgtggttcctctttagttctattagactgagtatgtacagaacataagttactgcatagtatactaacattgaacagtagaaaaaatatttatttatttattttttttgagacggaatctcactctgtggcccaggctggagtgcagtggtacgatctcggctcactgcaagctccgcctcccgggttcaagcaattctcctgcctcagcctcccgagtagctgggactacaggcgcccaccaccacaaccggctaatttttgtatttttagtagagacggggtttcaccatgttggccaggatggtctcgatctcttgaccttgtgatctgcccgcctcagcttcccaaagtgctgagattacaggcgtgagccaccgaaggataaccaaaatgtaaggaaaggctgtgttctgaaagttgctgtgtaatgtcatttgcttagaatttagcattgcttctcatgaatgaaaatgtctctctggctcagccgtgaaaaagccttctgacctttctgatactgtaatgaaaagcagtatggtaaataccattgcatgcatttgggttttcaacatgttaaggattgaagaggtttctgtaccctagcttggaaatctagctgttgcttatttgttctgttaaaatgtgttctgtcgagtataagatgaaataaatatgagtcttctgccacctccgtaaaacatcaaagcatttggggtatgtaggtgaagggtaaagatggagtacgctttaaagcagcagttctcaaagtgtggtctgcaataccgtgggggagtctgatgtcaaaacctttttccgaatattcttaacacattatttgctttcacactgtgttgacgtacggattgatggggcaaaagcagaagtgggtcaaattgctcgttactttaacccataccaaggccatggccaagtgcttgcagtaaagtgccagtttcacgtaataatatacttaatggaacaataaagttattgatcaagtattctatatagcaaaatgggaagtactcataaggtacttctgcgtaccaaagtatgaaccgttgtcttggagataaccacttctgcaagagagctaaactagccctctgtttcatgcaacacctttttttatttggaagaacaactgacccacaaattccggttgttcagacttcgtattttgcggacatttcctcaaaaatagtgacagaatttgttgctactgacacaatttaggctttcaatcaaaaatcagagttttagaaaacttgtatccactatgttgattttagcagtttctcagcgcttgacttactctgatgacatagatggtgatattaatgaatgtggttttatttttactgcataacgagatgtgtcaacattgggagtatcttcaaaacccagggaaccaatattttccaaaaaccaattcatgacattgtaaaacttctgcatgggtaacagattcattcaaaattcaagagagtcaattggtttaatgtaatagggtacaagaagattcattgctgtgatttcagattccacaatgaaccttttaggaaggtcaggtttagtgtaataccaaagaagaaaatccacaattatgtgaaagctgttaaaatgctcctccgttttcaggtgggtatctgcgtaagacaagatttttttcgtaaatttcagctaaaacaactcagcacaacagattgaatgcagaagcagatctgatcatctggctgtcttctaccacaccagacatgaaaaagacttgcagaaatgtcaaagaatatcagtcttctcactcaacttattttgttttggaaaatagtcatttttcataaaaatgtatgacatgtaatgggtttgttgttatttttaaatgaattatttaaacaacttggttttttttgttttgttttgtatttttgaggcagattctcactctgtcacccaggctggagtgcagtggcatgatcttggctcactgcaacttccgcctcccaggttcaagctattctcctgcctcagccgcccgagtagctgggactacagacacgcgccaccacgcccagctaatttttaaatttttagtatagacggggtttcagcatgttggccaggctggtctcgaactcctgacctcaagtaatcccccgaccttggcctcccaaagtgctgagattacaggcgcgagccaacatgcccagccaaaaacttgttttaatttctcatacagtaagtatatataaacataaccctcatcaacaaaaactctttggactcttcattaatgttgacaagtgtaaagggtcttgtggccaaaatgttttgagaacggctactttgaaggagctgagtagctttaatatgcctgtgttgagagcagataccaataaagggaatgcctgacctaacttaaaacaagtacgtgttggtctttctccaggttatgaactcttacagaggactcaggtcgtcttttattttctctaatgtctagcacagagtcttataaatagtaatgatgataacaattgcagcagcttttaatctttgttagctcatttaatctttattctgtgagtagatagtgagatataatttgcataaccaaaaattcaccattttaaagtgtacaattgagtggttttagtgtattcacagggctgtgcagccatctccactgtcttcataccggaacatttgcgtcccccagagaaacttgatacccattaggagccccatctcatttccctcactccttagcaaccactcactaatcagccgtgtttatgaactaaattcctctctgtctctgtggatgcccctgttccggacatttcatatgaaacggaatcctacaatatgtggccttttatggcttttttcacttagtgttcgagggtcatccatgttgcagcgtgtatcggtacttctttttgcggccaaacaatattccatcttatggatacaccacgttttgtgtatccgttcatcagttgatggatatttgggttgtgtctatcttttggctgttatgaatgcttctgtgaacattcatacaaagtttttgcgtgaacatgtttttcagttctcttggctatatacctgggagtggaattgcggggtcgcatagtagctctatatttaatttttgaggaacttactaactccctttttaatagagtttttattaggggataattttagatttacagatgaattgcacagatagtagatttcctgtatacctatcacccggcttcctctaatgttaacatcttacataaccgtgatacgtatgtcaaaacaaagcagccaacattggtacctcactgttaaccaaattctaggatttatttggattctactagttgtttcaccagtgccccttttctgttccaggatccaatccagggtgtcacgttgcgtttatggttgtgtctcctctgatctgttacagtttctcagtcttgtttttcgtgtccttgacagtttggaggaatgtagtggtcaggagttttgtagcatatccctcaactggggtttgtctggtgtttttctcgtgattaggctggggctgtgggtttgggggaagaataccacagaggtgaagtgtgcgtcccatcacattagattaggggataagtaatattgtcatgacttgtcgctggtgatgttaactgtggtcacttggttaataaggcatgtttgccaggttttttcactgcaaagttatttttcccttgccatacactgttctttggaagtgagtcactaagtcctgccttcactcaagaggagacaaggattaagctgaaactcctagagggagacatatttacctattttatttgcaattcttctgtaagaaagatttgttccttttctcccatttatttacttattcatttatttatgtcagtatggaataacatacttatttgatactttgggtcgtaatctaatagtatactaatttgctcaaatcatcccagcattggcctatggaaaatctttcctgtgtccctttggcatttcctcatccttttaaagtgctcccttgccttctgacactacagcgtgctctgggctcatcttccattttccctttcccatgcctagagtcagccattccttcaaggagtcatgagacgtggtgaagtgtaagtcggtggtggaaacaggattccatgcaaagcagtctgattctggaacatatgctgttaaccaaaaaactggataacatgcagctgatttattattattattgaaggtgcattggcagtttctactcacattccatctatgtgggagccttgaggaaagaatttatagcactttacactaattattgtgccctgtttttgttgttgttgttttttgttttgtttttgagatgatgtctcactctgttacccacgctggagtacaatggcatgatctcagctctgcaacctctgcctcccgggctcaagtgattcctctgcctcagcctcccgagtagctgggactacaggcgtgcgccaccacacctgactaatttttgtatttttcgtagagacagggttttaccatgttgcccaagttggtctcgaactcatgaccccaagcaatccgcccaccttggcctcctaaagtgtggcgtgagccaccgcgcccagccgcaatgttgttactaagctttgtctttcttctgtctgtagcaagacagggcccctcttgtaatgcacactggtagtagcccatacttaggaatagccagctgcatgctgcttgcatcctaccccaaaacaaaacaaatcccgcatgatgtcatgagctggttaggaagaatcattttagggcatgttgtcagcactgccttagatcctgccctcatttcttccttagaccagacagccttttgcacacaaagatagagatctttttcactcccttttcccagcccttctctagctagttaccccctctcttagtctgttttcatgctgctgataaagacaaacctgagaccgggccatttacagaagaaagaggtttaattggacttacatttccatgtggctggggaagcctcacaatcatggcggaaggcgaggaggagcaagtcacgtcttacgtggatggtggcaggcaaagagagagcttgtgcagggaaacacttctttttaaaaccatcagatcacgtgagatgtactccctatcaggagaacagcacaggaaagacttgccctcataattcatttacctcccaccaggtcccttccataacatgtgggaattcaagatgagatttgggtggggatgcagccaaaccatatcactcccagaaatgtttttgctcctttacctttttttattctttctcttttgtagaatgaaaaaataatcattttgagagcgaaaatataccatagtgctagtgacacactcccatcaaggaaaataaaagctgtaagatttggtataagcttctcaaatttttttattttattttattttatttttttgagacagagtcttgctttgtcgccaggctggcatgcagtggcgcaatctcggctcactgcaggctctgcctcccgggttcacgccattctcctgcctcagcctcccaggtagctgggactacaggcgcctgccaccacacctggctaactttttgtgtgtttagtagagacggggtttcaccatgttagccaggatggtctcgatctcctgacctcgtgatccacccgcctcggcctcccaaagtgctgagattacaggcatgagccatcgtgcccagctaatcttctcaacttatacctacttttcttcaggtataagcattcaaatgaaataaaaaatttgtttttaagttctgaacagttagcattcttttcattgtatatatgcaaggttttgtttgcttaaatgcattaaataatcttagaatcaaattaagatccagttaccaatgaaaaccatgtttagtgggaaaatatgttgttttctaacatatggttttgtatcagaactcatatgtataagttacggatcctctcccttttactgctgatttcaagtatgtgtcatctacttttttaaagacttaaacctagaagtatgggtagcagggttgaagttttcactgaattagccatgtagctaagacagattacccaactgcctggacagggcatttacaggtgtcacagaacctgagggatgtggccacactcagcctttcagccatgctctgtgtttaattttgtcagtatatccagattcgtcaagctcctttgtgattatctgcaaaactcaaaagactaatgtgtgtaaattaggatgtcaaattttcagagaccaaatactgtatcagcagtgcattgtttcaagattccttggccaggcgtgggggctcacgcctataatctcagcaatttgggtggataaggcgggtggataatttgagatcaggaattcgagaccagcctgggcaacgtagtgaaacctcatctctacgaaaaatacaaagattaggctggatgccgtggctcacacctataatcccagcactgtgggaggccaaggtgggcggatcacctgagttcaggagttcgagaccagcctggccaacatggtgaaaccccgtctctactaaaaatacaaaaaaattagccgaaagtggtggcatgcggctgtaattccacctactcaggaggctgaggcaggaggattgcttgaacctgggaggtagaggttgcagtgagctgagatcacgccactgcactccagcctgggtgacagagcgagactccatcttgaaaataaataagaattttttaggaaagttactgtgaaggctaagttgtaactacaaggttggagtgaaatcagattggaggggtgctgtttgatacccttaatagccaagcatctgtctctgctctagaggtgcacctccccaagatatcctataatttgctggtcagaacatatttttcctctttggaattaaaaaaaaaaaaaaagatttcatgttgtctgtctttctattgagaaggtctcttagaatccattgattagaccagtagcttttggtagtaccatgatgtttccatttgacttttcaaacatttttcagctgaccattaccagctttgttgggggtaaactcaagagagttacatcttttacacattgatttttccagattttgcaaatgtcactataaatggataatattttctaattgggagttgtggcaggggtagttattactgttttttgcttgttcgtgctattttttactttgttactaattgtattttttccaattccaggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggtaaatagcgcttctggctttcagagtctcagcattggtttattattgtatgttacccatgttgataacttttatggtgagaacattaaaacagatcatgaaaacaatcggtgctaatatacaggcactattaaaaagactagtttattttaaattgtgatttttaaaagaataaaatgtaaatttgtttctcaccctgcttgttatggccaatgaatttctatattcatctcctttgttttctgagaccttggccatattttaatgagatttgtgacacttgagggagacctgctattataagaatggtgagatagggcccacagtcccctgtctgaaatccctggagccaactgtgttttggaattaagagtttttgtgattcttgagtagtaaatactgtcttttaccaggtgttctataatgccctcagaagtgtcggaggcagcctcagtactcacagactgatgtgtcctcagcaaaatatatgtctagttcagggtttctcaacctcaacactattgacatcttggagccaaataatttgttgttgcagggacctatcccctgggggcaaaattactccaattaagaatcactgggccagacacagtggctcgtgcctgtaatcccagctacttgggaggctgaggcaggagaatcacttgaatacgggaggtggaggttacagtgagccaagatcgtggcaccgcactccagcctggggaacagggtgagactctctcaaaaaaaaaaaaaaaaagtgtacgtatatatatgtgtatataaaacatccttgtacctaccacccagcctagaattttatcagtacctctgaagtccccatctgctataccccatcctaaccttctcttcgtccccaatatccaccattctgcatttttattgtaattttataacatatctagtcaccctcaaatatgtatggtttaggcatgcctgtttgggaaccttttatgaatggaattatgctgtctgcattttttccacatacttttcactcagctttatgcttttgagacttgttgatgtatgtggtgtagtttgttcactttcactgctgtgtattgctacactgtaaatatactgcagtttatttggccagtctcctatctgtagacatttgggttgttttcatgaatagtgttgctatggataatgttgaatgtacatcttactgggtgtagggcaaagcttctcaaacttcaggtgatctgttagtttagttcttgaattgctaattagaatcacctgggaagcttaataaatctgtgttcaaactccatttcattccagttgaatcagcaatcagcatctttaggggcttaccctggcattgtttttggttttgtttttaattttttttttcttttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccaagtctttgctattgtgaataatgccgcaataaacatacgtgtgcatgtgtctttatagcagcatgatttatagtcatttgggtatatacccagtaatgggatggctgggtcaaatggtattgctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgaaaaatatggaacgcttcacgaatttgcgtgtcatccttgcgcaggggccatgctaatcttctctgtatcgttcgtattttagtatatgtgctgctgaagcgagcactgtttttaattttttaaataccccagatgataatgatgtgcagctcatattaaaaaccaatgcattggtgggttatgaactctgtatagtggacgacactaaatgcgctagaataatataatcagagtgttgtgcacacagtgaaaacgttgtcttatgaaacagtttgttttagttatgtgtatactgagtcaggatataaaatgtatttcttggtgtgggtcctgaccaaagatttaaaggtcattcagagatgtatatttaggattagaattgctgggttacaggctgttcccgtgtgtgacttgactaggtttgtcagattgttttctaaaagtttttagtgtacattctcacccacagaagatgagcgttcccattgctgagcaccctcagcaactctgggaggggtgaaatactagctcattgtgttttaaattggcctttccctgattactcaaaaaactgagcatcttttcgggttaattgaccattcttgtgtgctttctgtgaaatatctgttcaagagaaagaaatatctgttcactatctatattagtctgttttcacactgctgataaagacatacctgagactgggtaatttatacaagaaaaagggtttattggacttacagtttcacatggctggggaggcctcacaattatggcggaaggcaaggaggagcaagtcgcgtcctacgtggatgacagcaggcaacgagagagagcttgtgcagggaaactcccccttttaaaaccaggagatcttgtgaagacctgcccatgattcagttacctcctactgggtctctcccacaacacatgagaattcaagatgagatttgggtggggacacagccaaaccatatcaaggtctttaatccatttttctacttggtggttagctttttcgttttctattaataaacattccttgtagtctatacactaatcctttgccagttatatgatgttaaagatagtattccaggatgtgatttgccttctcaccctttcagtagtatattttaatgaatagaagttattaatttgatatggtggatttgatcaatttctcttttttttttttttgagatggagtctcattctgtcacccaggctggagtctagtggctcaatctcagctctctgcaacctccgccccccgggttcaatcaattctcctgcctcagcctcccgagtagctgggattacaggcgcctgccaccgcgcccggctaatttttgtatttttagtagagacagggtttcatcatgttggccaggctggtcttgaacttctgaccttgtgatccacctgcctcagcctcccaaagtgctgagattacaggcgtgagccaccgtgcctgtcttcaatttctcttttttgtggttcgagctttttgttttttaagaaatttttgtcttacttgaggtcataaagacattttcctgtattttttctatagcttgccttttacactttaaatctttgagctagctggattttatttttgtatatttgtgaaaagattcactttcacttttttctttaaacttggatagtatcccagacccatttattgagtcttctatttccccactgacctagaccaccattatttgtcaggtttccatgtgagagtctgtttctgtgttctctgctttattccattaggttatttgtctgtacctgagctaatagtagcaccctgtcttgattactatatcttacaatctttttttttttttctttgaggcagggtctcactctgtgacccaggctggagtgcagtgatatgtcttggatcattgcaacctccacctcccagattcaagtgatcctcctgcctcagccttccaagtagttgggactacaggtgcacaacaccatgcccaactaatttttgtattttttgtagagacaggctctcatatgttgcccaggctggtctcaaactcctgagctcaaacgatctgccagccttggcctcccaaagtgctgggattacaggcgcgagccaccacacctggctcttatattgattgttaatgcctgatggaacaaatctcttaaccagattcttcttcagaatcctgttaattgctttggctttttgcatctttctataaattttagaatctgtttatcatgtactttaacagaaaaaaaaacctgtggctactttgattagaattgtatagactttgggccgggcaccgtggcttatgcctgtaatctcagcactttgggaggccgaggccggcagatcacgaggtcaggagagcgagaccatcctggctaacaaggtgaaacgccatctctactaaaaatacaaaaattagccaggcatggtggcaggtgcctgtagtcccagctactctggaggctgaggcaggagaatggtgtggacccgggaggcagagcttgcagtgagccttgattgcgccactgcactccagcctgggcgacagagcgagactccgtctcagaaaaaaaaaaaaaaaaagaattgtatagactttgtagggcaaataggggagaattgcatccacctttgtagctgagggtggggaatctgcagagcctttgtgtagcctgtttacagggaagtttagttgcatgtcgttttcagtctcagagagacagagatgtgtggaatgtttggagggtaggatgcttcttgattcctcctgtttcctggagctctacctccctttcctcttacacttattgctcctacctggaagctgaaacacagcccagtcactggggcccagctttcggcattaggaatgagggagaaccttgtgtgtgtttacacatccgtgcttttgtaaacatagaaataacctgctctgttgctctcactggattatcccgttcatcaccctagtggttgcctctgggtccgctcatttccacccaccttgcttctagtttcagccacctgcagcagtttgcagaagcattttcccactgacatcctaactgctgcttctctcgctagtcttatgctaattgcttttcattctggagcattcctcgtggattttattctgtgaaacactcggttttggtgtagaagggagagaacttcagtatgtgctcagtacatcatcttgaaacagaagagtctaaaaggcaaacaattgtatttccattttttaaaaatcataatgaccttaagacttttgccatctctaatgtaaggcctgatctagagataattcattttattccactaaaaaatttacatcccttactgctttccttactaaaaaaacagctaatatttttataaaaagaaaataaagactctaggatgttttcacttattaattactggttttaattggtatcaccaaaaaactcgaaaattatccttttggatcgtgccgttttaaggcaacttgacagaacagatcttttttccatgcttgctaatgtgtgtactatgtgaataatcagagatgagtgataaagcagatagtgtccctgctcccacgacagcaatctcaaaccatggtatagaattacaagccatgaaaagtggtacagaggcagtgcacaacatgtgtccaatctgcagtgtctgggaaggcttcctaaggaggtcataatagagctgaagactgcaggatgggtaagggaaacgatagttacaaagtgtgttccatgcccgggaagagcctgtttcagtggcccacctacaggagggatcagagcacatccatggagctgagtgccgcccggtgttactggaaagcagagagggaaggacagagaattacagcagggtgtatgtaggcactacagacagcagaagaggctgaagaggtaggcagtgaccaggtcataaagggccttgtattctatgctacagagctcacattttatcctgtttcctggggaaccattacagatttttaatcaggggaaagacctggccatctctctgttttagttaggagagaatggtaggtatatagaaaaaaggttttgttcgaagtgtgagagtgaagttggaaactagttaggaggcttttgctgtagcccaagtgagaaatggcctaactagtctactagtttaaataatgaaaatgtcagtgagccatttgactttttaaaataagctttattcatacagctagagttggatggtattgtctttattaactaaagcaattttcacatctagctattcaacctataagcaccttcacttctggttggttatgacttagatctgtaaacaacctttctgattaaaaaaatgaattctgagattaataatagtaacccatacttctctgcctatttcctagaggagtggtccccaacctttttgacactggggtaatggtttcatggaaaacaatttttcttttttcttttttgtttcatcttgttgcccaggctggaatgcaatggcgtggtctcagctcactgcaacctccgcctcctgggtacaagcaattcccctgcctcagcctcccgagtagctgggactagaggtgcacgccaccacgcccagctaatttttttgtatttttagtagagacagggtttcaccatgttgaccaggctggtctcgaactcctgacctcaggtgatctgctcacctcagcctcccaaagtgccgggattacaggcgtgagccaccgtgcctggccggaaaacaatttttctgtggggctgacgggggggtggtttcggtatgaaactcttccacctcagatcatcagacattagttagattctcataaggagtgtgcagcctagatccctctcatgcgcagttcacaatagggtttgcgctcctatggggatctaatgctgccactgatctgacaggaggtggcgctcaggcggtggtgctcactccccactgctcacctcctgctgtgccacccagttcctaaccggccatggacctgtactggtccacggccctggggctggggacacctttcctagagaattctctgctgtgtcatggaatttgaagctattacacatcaaaagaacaaaggaggaattacttatggttagactagaaacagaagagtcttccttttaaacagataaagggtttcttttatttgtttgtttagccttagatgtagcttgaaagcagtctaaaaggtagtgccctagagaatgtgacagtagcctacttaggattcttttcagtaccttttgtcaacatgtgactcagggtctctgcctcttggctgaaggttgctgcctgcctgctgctgctgttttgttgtctaatgaagttggaaaatgattctaagaatctttttttctcctaggacactagttaaattgtttattttattaaaataagttttttgccctggtctattacttcccatcaagtgatctggttgcctggtgaacctcccgtagatggttgtgtttgataagcagaagtgggaagttgacctcctttcattttatgaaacatgaacagatttcagatttctccaaagctaaggtgtaacatgtaggggtccgtcccgcagaccctgacccaatgacggatgaataacttacactgacacagatgttatgcttgtcagtccagctgagagtccgggccacttacagactcccaggagagtgctgtaaagcgttgcaaccatcggcctcaactagccaaggaagcttgcatttatttagtatagattaattgacaaaggcttgagtcaacacacctgtgggtaattcacctggtcgcccccaccctggagagggccatcttgcccaccaatgatcaaaggttagtcttaggaccacatgagtaaacaagctctttagataaactactttatattcctttgtatctgtaccttaagctctctggctcctgaaaagagaatctggctaccttcagccaaactttgaagctatgcaaaactccccggccttccaagcaggtttgcttttttctattcctataatttcttctgccatcctgactgaacccccacatctacataaatttattgtgattggccctctatttctgggcttctagagtcgttatataagagtattaaagacattctgttggtatagcaatatctttccagcacattgttcaattccagacatgctttagtatctttttgttttagacactgtttctaatatcctttccttttcccattgagactattaaaatacagagagtacctgtatgtgtgttatgtaaaaacaaatggcattgaacagatttttaggattttatgtttattttgaatgatctaatgtggctctatctcaagttctgcttaatcgtttttgtgtttttcctttaactttttactctatactcctatcatatatgaaactttaatatatttctctaaactcttaacgtttccaagttgaagaatatgactaggccttagacacaacaggaaccaggaatactcttgctagatatgttatctctcacccttctttttatatttttttcttattttatatttcttatttcagaatgttttttctttatgtgttaagaaatataattcctgggccgggcgtggtggctcacgcctgtaatcccagcactttgggaggccgaggcaggtggatcacgaggtcaggagatcaagaccatcctggctaacaaggtgaaaccccgtctctactaaaaatacaaaaagttagccaggcgtggtggcgggcccctgtagtcccagctactcgggaggctgaggcaggagaatggcgggaacccaggaggcggagcttgcagtggagctgtgatcgcgccaccgcactccaacctgggcgacagagcgagactccgtcaaaaaaaaaaaaaaagaaatagaattcctgggctcagtttcttacaacttcagacactagtgatagactgattctcagggagccgagtctggcttagctgctcaggtggctgcccctgcaccagttgctggagggtgtgtgggaagctgtgctgacctggcttgagttaggtgcccacctcggaccagtcatctgtgaccatagtcgtgtaagaaaatggcatctttcccaactatctgcatagaggaaaggtgagggaagtttccaaaagtaggatgctgagcagatttttttaaaagaaagaacacatataatcatagtacattaaattgtaaactactagtttatcgttaactaataaataatttctcctgtatgtagggtattccgttagaagccaagggacataaagaaatgttgagtgcacgacctcaaattactcaaagtctagtgaaaattgagagagaggtaatttatgatagacgtattaataattgtgtttcagtaaagagaatccaggcttaacagtttcctttccctctgctcctgtccataaccagcattcccttccctctcactgtgaccagatctcttttaagttacatgcctagagaggagatggacatttgagcataaatccctcattactagttaaataagtattattgtgtttcctaccaatactaaactagtagtatctttgtaaacaaagaagagcatacggtaacatttccagtcttatatgtatagacttatcaaacagcatgatttttaactctttgatattagaagaatcttctggttaaacacagcatgttgaccacatacagaagcattctatttactctccctcccaagacccaactaaaatgacagaaaaaaatatatatatatacacacacacacacacggtcaaagagaaaaagagaggagacagtattgtgaaagaggcttcagtacacatttggaaggcagaagtggtggaaaattggcacctgactcagcaggacagagaaacacataacctaagcgtttgcagaggggaatctgtgagaagggaaacaagtttcccttgtagaaattctggaagctcaagatttagaggcacacgacactgtgtcggagtgggggtaggatgcactacacatgctgaggagaagggggattagttgaaaatcaacatcgaaagtgtcaaaggccccccaggactcctcctttacaccccacacatccatgtaagtgttatccccatcctccggaaggaaaaaagaataaactgggatttacatttatttccagagaatttaaaccacagaagcctctgttcttatcaggggagtcaggaaaagttgaagcaccagaataaagcaggtgacttcatgcaagtcagcattttcaactcctttccccatcctgctttcagaatacctgcagcctgactcacagcctcagacaggagattggaagatttttctctggataaacaatggcctggggaaaaaaatactttaggtaccttgcatgcatgctgtccttatctttagtgttaaggttggcttaactcccagttagctttttaatactttctatatgagtagacagtacaggatcacccgacatttatgaaaaaccctttataaatgagagggagagtccaaaacaatagggataaaaacaggaacttaaaagaaatagacagtgtaaggagaaaaaaaaccccaaactgcagcctgtgcatacacacatactgtataatcgtcaaagagaggagatagaggaatccatgaaacaagaaaagagttcgcagagaaagaatgatcagagaacaatggaaaacagttcttggaatatcaacatttaaaattaccaaaacaaacaaaagatagcaatagaaagaagagtggaagataatcaagaaaattctccctgctggagcggtggctcacacctgtaatcccagcactttgggaagccaaggtgggtggatcacttgagatcagaagttcgaaaccagcctggtcaacatggtgaaatcccatctctactaaaaatacaaaaattagctgggctcggtggcgtacacctgtaatcccagctactcaggaggctgaggcaggagaatcacttgaacctgggaggcggaggttgcagtgagccaagattgcgccattgcactccagcctgggcaacagtgcaagactctgtctcaaataaaaaaagaaaagaaaattctctcaaagaattaaacagaaatacaaagatggaaaatatgagagaaaagataacagttaaaagatctgactaatgacaattaagtggaggacatagtgacttctagctctaaaatggtggtgtagaagcacactggcttcactcactctgccctgccaccacagaaaaccaagaacatacagcactaagatgatcaccagcaacatccaagaactcagatatgagaaggagacagttcccaggggcacagagaaatgaaagaactccaggcatgctgtaagaatcggacttccgtatctgcaacacccgttccccctgtccgcctggcgccaagtgtgggaaaatctcccccaattcacagtgtctacacaggaaaaagtgagattgaagaagacagccaccttctccaccatcttgggttccctggcaggaggcctgtccctgccttagcccacaggtggcatagggagagctaccctgaggacagccagaggcagaggagggaggcgggattactgttcccagccttggaaaccctgctgtataactcagccaaaggggatgccaaatagagcagctgttcagcaacaccatgttgtaggaggtttattccacaggacccttggcaggaaccctgagccacccttcctgtactgctaccagaatatccccttggggactcctctctcccatttaggatgggctgcactctgctagaacccaggcaaacctgggcttatggtgccatttagtgctggaaaggaggcagcaacctaggctcgggggtgaggaaaagaaagaaaatcaacaggtaaattacagagactctctaagcaaacatatccaataaaaaccagactaaatatcctcatacttctttgaaaaatggcttaaaattttccaaatttaatgaaaactgtaaacccacagattcaagaaatttaacaacatttgagcataggaaacatgaaaactacaccaaggcttactgtaatcaaattgtttaaaaccagtgttagggctgggcacagtggctcatgcctccaatcctaggattttgggaggccagtgtgggaggatcacttgagcccaggagttcaagaccagcctgggcaacatggcaaaatcccatctctacaaaaaaaaaaaaagaaaaaaagaaaaattatctgggcagggtggtgtgcacctgtactcccaggacttggtaggctgaggcaggaggattgcttgagcccagaggttgaggccgcagtgagctgagatcgcaccactgcactccggcctgggtgtcagagcgagaccctgtttcaaaccaaaaacaacaacaacaacaaaaacacagtgatagagaaaattttaaaagctaccagaaaaaaaatgaaagactcattatatatataggacgaagatagagtgatcccagactttatttaagtaacagtgcaagccagaagacaagggacaacatctttaaagtatttaaagggaaaaaaatctatcagcctagaattctatactattgaaagtgtctttccaaaacaaaggaggacacagaattttaaatgcgtaaaagctgaacgagtgtatcgtcagcagacagactacaaaaaatgttaaactaagcccttcaggcagaaggaaggtgatgtcagatggaaatgtggactcacaggaaagaatgaaaagcactggatgtggcacctccgtggttctggacctttttggcacccgggattggtttcgcggaaggtagtttttccacagacccagtggtgcgggggaatggtttcgagatgaaactgttccatctgaggtcatcagacattagattctcataagaagcgcacaacctggatccctcgcgtgtgcagtccacagtagggctcacgctatgcggtccaacgcggctgctgatctgacaggaggcggagctcgggcggtgatgctcactcacctgccactcagttcctgccgtgcagccggttcctaacaagcctcggactctggtaccagtttgtggcctgggggctggggacccttgtggtatgcgttctttcttatctaaatttctttgaaagataattgttttgagtttttaagaaaacaaagcactgatacaccttgtaacatggatgaatcccaaaaacattaagtaacaaaagtcattcgcaaaagactgcatattgtttggtcccatttatattaatgagcagaacaggcaaaagctatggagacaaagtagattggtggttgcctgaggtttggggtggggcaagggctgaaatggggagtcattgccattaggtgcaaggtttcttctgggtatgataaaaatgttctaaagttagattgtgattatgattgcacaactctaaatatactaaaacccattgaagtgtacaatttcaacaggtgaacatgatagtatatgaagagttctagcttaagaaacaactgagtagataaaagggaatctcaaaatacttagtccagaagaaggcagaaaagattgataaaaacagacctacctacaagaaatctactttaaaacataaagccacaaaataggccaaaatgaaaggatacaaaaaggtgtgttaacaattaaaagaaacctggactggctgtataaacagcagacaaactagagtttagagctaaaaaatactatcagtgataataaggaaggttgttatttcgtgataataggaccagttcattaagatgatataatagaactaaatatttatgtacctaataacagcttcaaaattcacaaagcaaaaactgagaggatttcaagaagaaacagacaaattcaattataatcggagattccaaaacttctctcagtaattggtagaaaaagtagacataaaatcgctaaggatataaaaaatttgaacgtaactatcagccaacttgacctaatagacgtttatagaacactccacacaataacagtagaatatacattctctttaaagacacatgaggtctacttttaaaaattctcaaaaatgttggccaggcacggtggctcatacctgcaatctcagcactttgtgaggctgaggcgggcagatcacttgaggtcaggagttcgagaccggcctggccaacatggtgaaaccgtctttactaattatacaaaaattagctgggcgtggtggcaggcgcatataatcccagctacttgggagactgaggcaggagaatcgtttgaacctgggaggcagaggctgcagtgagctgaggttgcgccactgcacaccagcctgggcgacagagcgagactccctctcaaaataataggctgggcgcagtggctcatgcctgtaatcccagcactttgcgaggccgaagtgggtggatcatgaggtcaggagatcaagaccaacctgaccaacatggtgaaaccctgtctctactaaaaatacaaaaattagccaggcgtggtcgtgggcacctgtaatcccagctacttgggaggctgaggcatagaattgcttgaacccaggaggcggaggttgcagtgaaccaagattgtgccactgcactccagcctgggcaacaaagcaagactctgtctcaaaaaaaaataaaataaataaaggatttaaattatataaagtgtgttcttgtgatcataatataattcaattagaaatcagtcacaagaaggtctctggaaatatttggaaagtaaagaaagcacttcacaaataaaaagatatttagaaaatatattaagccgaatgaaaattcaaaacatcaatatttgtaggatactgctaaagcagtacttagtggaaaacttatagtattaaacaccatattagaagaaaagattttaaatcaatgactttagctaagccatcttaataaactagaagggaagagcagatgaaatccaaagtaagtagaagaaaggaaataataaaaagcaaaatgggaataaatgaaatagggggaaaaagcagcagagaaaatcactgcaaccaaaagtagattcatttagaatgtcaataaaatggataaacctatagccagactgacagggggcagtggatggggaggagagacacattaccaatattgagaatgagagaggtggtggcacccctacagattttacagatattaaaaagatggtatgaacaaatatgtaccaacttttttttcttttctctttttttttttggagaaggagtcttgctttgttgcccaggctggagtacagtggtgcgatcttggctcactgcaactgccacctcccaggttcaagtgattctcctgcctcagcctccctagtaggtgggattataggcatgcatcaccacgcccggctaattattgtatttttagtagagacgagacttcaccatgttggccaagctggtcttgaactccttagctcaagtgatccctctgcctcagcctcccaaagtgctaggattataggcatgagccactgtgcctggccaatgttaaattcttagcaagattttagcagttggaatccagcagtgtataaaaagggtaatacatcatgaccaagtggatttcgttggtttaagtttgaaaatcgatggatgttatttactgtattaacacaatagaaaggatgagccatgggtttgtctcaatacatggagaaaaggcatttgacggaacccagtatccattgctgatagaagtgttcagcaaacttggaatagaagagaatgccctttagcctcataaaggacatcttttaaaaacctaccattggcattaaacttaagggtaaaaagaatgacagtttttcctcttagatcaggaaaaataaaatttctcttcatccacttttattcaacaatgtactgaagggtctagctaatgtagtaaggcaaaaaaaaattttttttaagaaaacgaataaaaggaatccagattggaaagaagtaaacttgattttattcaccgacaacatgattgaatttttgtagcaaaattgtatatttacaaaaatactagtggaagtaagtgtaataaggtttcaggatataagattagtattcaagaaacaactgtgtttctttatggctgcaatgaatgattaaaaagggaattttaaaactgccatttgcaatagtatcaaaaccaggaaataccgaggcagaaatctgatgaaacagtgtgcgctctgcactgataactactgctctgtttctaagtgtcccccagagttcatgtgttagaaactgaagccccagtaagagagtgttgagacatgggaccttcaagaggcgacgcgagtgctcacggatggactcatgtctttattgtggatgcgagttgcttataaaagccagtttggccctctcctgctctctttcttgcaatgtgatgccttcggctacgttatgacacaacaagaaggaccctcaccaggtgtggcttcttggtccttgacctggaggactttccagcctccaggagaactgtgagccaaatgaacttttatttttttgaggcagtctcacgctgtgactcaggctggggagtgcagtgacacaatctcggctcactgcagcctccacctcctgggttcaagcaattcttgtgccgctatactcggctgaagtttgcattttagatacagtgttttgccatgttggccagatgggtcttgaactcctggccttatgtgatctgcccacctcagtctcccaaagtgccaggattacaggcatgagctactgctcgcagccagcttctaatgtttatattaatcaattgcataggcagtggtattctgataaagcgtaccgaacggatgaagacaactgcaaacactgctgagagaaatttttaaagacctaaataaatgaaaagatttgctgttttcatggatcagaaaactcggtgttgttaagaaatcaagaaataaattctcagccaggtgcagtggctcatgtctgtaatcccagcactttggcaagccaaagcagatggatcgcttgaggccaggagtttgagaccagcctggccaacatggtgaaaccccatctctaccagaaattataaaaatcagcctggtatgatggtgcatgcctgtaatcccagctcctcaggaggctgaggtaggagaattgcttgaacccgggaggcagaggttgcagtgagctgagatcacgccactgcactccagcctgggcgacagaatgagactccctgttaaaaaagaaaaagaaagaaagaaagaaattctccttaaaattcatctgtatgtacattcattccaattctagtcagaattccaacaggctttctgtagaaattaataagcttattctaaaattaatagggaaatgcagaggacctcgattacccaaacagctttgacaaaagaaaaagaagacttatgtgacatagtttcaatgcgtattacaaaatggcaataaaataatcaaggcagtctgatagtggcataaaggcagacaaacagataattgcaacagagcagagccttcagagatagactcacacgtgtacagacaattgactttcaacagtggctccaaacaggaaccaaaatggcgctggccttctaaatggcaacactggaaatgctgagggttccaacttatatatatataaaattagtgaagaactatcactaaagggataaatcaagaggaaaacgtaagatccagaaaatagattccagcacatacagggcaggagtgaagggatgtcatggacggtaactgcaggaagcgtaggcatgagctactgcagattagagcaggaggagctgagagggagggggtagggggaaggaactgatgtgttggagttcacagagaacattattgataggtgtgtggcagaaatgttgcagaaataatttacaatcggaccatagaaaaactgcatagttttaaaatgtggcaattagtaactccactaaaaaaggattatgcttgcacaaaaaaggagaggtggttttgtcaactacttgtcttgacagtgtgtattatctgcggagtcacagtaatgcaaatctgacttcctgatgaatgtagctgagtggaaatggggtttgctgtgtttgctgtccacattgctcagcatctgagatgtagccctttgtgagagagctggtgcccgaagggggtgtctcttctgcctgtgctctgttactcaggcctgccgttggtcactccatgtgcctcctcagtgtttggttgtgtccagccctactctatggcaggacagtctgctttacttcatttactagtttcctatcagccagtttttaggggaaatcttttctagaataactttgattctagtgtgttttctagaataactttgatcctaatatgttttaggaaaaatataaacataatatgccgggcatgcggtggctcacatctgtaatctcagcactttgggaggccaaggcaggtggatcaggagtttgagaccagcctgatcaacatgatgaaaccctgtctctactaaaaatacaaaaattagccgggcatggtggtgggcacctgtaatcccagctacttgggagactgaggcaggaggatggcttgaacccgggaagcagaggttgcagtcagctgagattgcaccactgcactccagcctgggcaacaagagcgaaactccatttaaaaaaacaaaagacaaaaaataaaattataagtgcctttactagtcttgtttaaataggctgattctttctctttttttctaatgccccctaggaagtaaaaagaaagaaaaggaacggccagaaatttctcctccatctgattttgagcacaccatccatgttggctttgatgctgttactggagaattcactgtaagttaacctagttcgggcccatttataacgtttaaaatagcactcaaacattttccttcattattaaatttgaaattaacatttcaggccaggtgcggtggcacacgcctgtaatcccagcactttgggaggccaaggctggcagatcatttgaggtcaggagttcgagaccagtgtggccaacatggtgaaaccccatccctactaaaaatacaagaaaattagccaagcgtgggggtgtatgcctgtaattccaactactcaggaggctgaggcaggggaatcatttgaacctcggagatggaggttgcagtgaacagagactgtgccattgcactccagcctgggcaagaagagtgaaactccgtctcaaaaaaagggaaattaacatttctatctatacgttaactatgaattcttactgctttttgctttttataaaagtgttagtggttggatatatcgttttcctagagagcagagcctattaattatagttatgcaaaacagacttagaaaaaatagacctaggccgggcgcggtggctcacgcctgtgtaatcccagcactttgggaggccgaggcgggtggatcacgaggtcaggagattgaaactatcctggctaacatggtgaaaccccgtctctactaaaaatacaaaaaattagccaggcgtggtggcgggcacctgtagtcccagccactctggaggctgaggcaggagaatggcctgaacccgggaggtggagcttgcagtgagccgagatctcgcacgactgcactccagcctgggtgacagagtgagactctgtctcaaaaaaagaaaaaagaaaaaatagacctttagaaaatgagatcttttaaaatttactcaaacctacactcaaaagattggtttgttttgtgtattttgtcatttatctctggaaattaattttattgcatcaatttaaaccataactaatttctgaatatcttcttgttagggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctggtaagagagtggcataaggctggatcagatggagatttgtgaagcacttctagataaaaagattactcctggaaaaatgaaaagctaaactatggttcttgttgataacggtttttccctggatagattctaccttttgtagactgatccagggcagttctgaagcataatttggatctgtgaattatagtaatctcataggtttgccagaaacgggagttgatggatattttggctttttgtttatttggttttttctcctcattgctgtgtttttgttttcatttttcactcttcactgcttttaaatgacttccagcaatcaaaggaaaagacgctggttgatagacatgttcatactagaaacacatttattgttagcgggacaagaggaggttgaactaaaaaatgtttaggtccactcaaaaaattgaaactcgcaagtgtgcagataatagaatatatgtattttaatatataaaacagataaatcatatacgaaagaagcgttagaactaaaaggatttatacctcagaaatggaatatctggaatatcatctacatagtcacagtaatgcaaattttactttctggatgaatatagctggatggaaatggggtttgatgtactttgttttccaagttgctcagtatctgagatataccgttaacctatgagagaaccagtgaattggtatatagtgtaagagttggtgtagtggatttttaaaaatagtttttgttcaaataaagatcagaataaagttcatacaacgcagttggttgatacatctcttgaatctcttttgatctttaggcttcccctcccacacactggttcatgctgtcttttcttgacgtttatttattacagaaacaagatcatttgtcctgtttccctcagtttagattttgctcactacatcctcaggatgtcatttttcaatatgtttgtctgtctctgaagtcatacatgtggttttcaaaagcaatatgatggagctaaaatcgtacatgtggttttaattgattttacttactgtttgcatcctcacagaaacaaaggccatgtgcaagggagaaatagaaatctttttcaagtgatcttgacctttttttgttgagtctagtacaccgttaggaaaaggtcacacttgctcctagaacttttctatcaaccagtaagtctgtgtgtaaattagtaatttttttgaaaaaccaatgtttgaccacaaaatggtagcttattttcacctagtacacatacatacatatatgtgtgtgcgcacgcgcgtgcgtgtgtgtgttttgttttgtttttgagctggagtttactctgttgcccaggctggagtgcagtggcacaatctcggcttgccagaacccccgcctcccgggttcaagcaattctcctgcctcagcctcctgagtagctgagattacaagcatgcgccgccacacctggctaattttgtatttttagtagagactgggtttctccatgttggtcaggctggtcttgaactcccaacctcaggtgatctgcctgtctctcggcctcccaaagtgctaggattacaggcatgagccaccgcgcccggcctgtgcgtatgtaatatgtgatatgtgtgtgtgtgtgtgatatatatatatatatatacacatatatatatatatatacacacacacatatacacacacacacacatatatgtatgtctctgggcatttttaaaagaaaaacaaaacaatgtcagaattttactttgcacaattgtcattgtcttaattgttgcattaagttcctcagtcagcagttttctggagaaagtatctttatcaataaatttgttttgttttaataaatacagattgataggtatactttcaaactaaattttgatagctttattgaggtataatttacatgcaatacaattcacccattttaaatatataattcactgatttttactaaatttatagtttcatgtagatttcagatttcttaccttggtcttatataaattcttatttgactacttgcgtgttcatttttctcaagagttaattcaacttgaaatcagtttaagaacatttcactttctctgctttttttttttccttttatcatataaaagtgctgtttcttgaattgctaatgttatgttttgtttcatattcagagaaagatggctttccttctggaacaccagcagtaagttaattatattatttcttgtatctcttgttctaatttaggttacccaagacaaatctcagtttttattttgctttctaaaataaattacagccatcagaggtaaataactactcaataggtgtttttagctagccacctgattagttgaagaagccgtattaaatagaaattccttgatgtgatacttaatgtaactaaaatttataatgaccttcagaacagtttagttagttttggtaatgttaacatatacaaacgtgaacacaaagaacttgctagcatatattttcctctccatccctcagttttccttctggtactattttactgaatatagactgtggaaaggtgctgaacagttgaaccttgtcagtcttcagagtcatctgaaacttaagttatcgcataaacacagtcagtttttggaaacagtcgttttatttgcagtttctcaattgggaggaaacagtctcctggagttttatttttttatattttattttattttatttatttatttattttatttttattttttttgagttagagtctcgctctgtcgcccaggctggagtgcagtggcgcaatcttggctcactgcacgcaccgtcttctgggttcactccattctcctgcctcagcctcccgagtagctgggactacaggcgcctgccaccacgaccagctaattttttgtgtttttagtagagacggggttttaccgtgttagccaggatggtcttgatctcctgaccttgtgatccacccacctcggcctcccaaagtgctgggattacagacgtgagccaccatgcccggccccaaatctgactgttttaaatgtcaccagatgtctctgacataacaaagcccagaggatctttgattttggtcttaacaagtaacattgtttactttcaggacattgtatatgtatgcttagggtaactttattaaaatatttggtactcaccatatatatatatttcataaactttttcatgattcatagaatcgccttattatgttagattataattctattgagttatctaagagctaatgagatttagtggttttgaaatgagctatcaaagaagcaaactttttgaagtacgttcataaagggcgatagtcgcatttaagcctattggacttgttttccttactttgctcatcatcaatgcagctgaatgccaagggaacagaagcacccgcagtagtgacagaggaggaggatgatgatgaagagactgctcctcccgttattgccccgcgaccggatcatacgaaatcagtgagtctccatcggtgatctaggctgtgtgtgtgcacgtgtgttttaaaaaatagcagagtttgtatttgactttcagtgattgcttttaaaaagccctcaagtttaaaatcgtttagtatggggaaatttaaccaagaaatctgtacccaaagaccactcacctaaaactagttttctgaagattaaaatgtgatgtctttaaaagttaacgcactcacctcactgggcttttttctttgtatagtacaccttttccagagggttcgtctatttcccaagctttctctgtttatctcaatgtagatgacgactaaatctaaaacttagagctttcctcttacccagattatgcattttaatctcccattttacactactctcagcgccttgctgtcattcaaaaggcagttgagaatgaaattcctaaccaggtaagggagaattttaaaaatgatgaccttaaatggagccaggaagagaggaatgactgcggttaccattctgctcccttcagtactgcaggtagagtgtgcggaaggtgctgtgccgtggaatgggctgtgctcctggcacagcgggcaggcagagctcaggagacagcctctggatgccaagctgatggcagaggactccgttttctttagcctttcaatctggctgtttgaaatgggtggtaggcattataattgtgtaaaaactttcatgggaattaataatagttatttcaacatcaaggtttctgttcttttgcattttacttaccatttgtagtaaaaacatgatttttaaaccgtgctttttgatacattgttataccattttagacctggtcacacttaaatttcattcatggacctgctgttttactagacagcttttcaaatatattcatgctatgccaaagaaaaatgtttcacatttattcttcttagttacacatcttttatatctgaaaatagtgttctcattatttagaacaatggaaaagactacttagttcaggttaaaaatcaaagaactgaattagtttgccaggaagaatatctgaaaacattattcctcaaaccttggtaatgaactgtgtctccacagatttacacacggtctgtaattgaccctgttcctgcaccagttggtgattcacatgttgatggtgctgccaagtctttagacaaacagaaaaagaagactaagatgacagatgaagagattatggagaaattaagtatgttatctacattttacatcattgttaaattgttcacggctcttaaaacatttggcccagatggattttaacttacactttacattgtgacttaaagtataaagaataaattgtttccttatagcaacagtagcttcaattacaatctggtgatgtcaccaggttcacccctaaatcccagcactaggtcaggagatcaagaccagcctggccaacatggtgaaaccccgtctctactaaaaatacaaaaattagctggatgtgctggcatgtgcctgtaatcccagctacttggaggctgaggcaagagaatcacttgaacccaggaggtggaggttgcagtgagccaagattgcgtcgttgggctgggcgcggtggctcacgcctgtaatcccagcactttgggaggccgaggtgggcggatcacaaggtcaggagatcgagaccatcctggccagtatggtgaaacccctcctctactaaaaatacaaaaatcagctgggcatggtggcatgtgcctgtagtaccagctgcttgggaggctgaggcaagagaatcacttgaacccgggaggcggaggttatagtgagccgagatcgcgccactgcactccagcctggcaacagtgagactccatctcaaaaaaaaaaaaaaaaaagcgaaccggccgggcactgtggctcatgcctataatcccagcactttgggagaccaaggtgggtggatcacttgaggtcaggagcaagactagcctggccaatgtggcaaaaccccatctctactaaaaacaaaaattagcaaggtgtcatggcaggtgcctgtaatcccagctacttggggagctaaggcaggagaatcacttgaacctgggaggcggagattgcagtgagccgagatcgtgccactgcactccagcctgggcgaaagagcgagactcagtctcaaaaaataataataaataaaattaacaattaaagaatgctaatctagagggttcaaggaaaaatactgtatggaaggattgttttaaacataaagcctgggcatagtggctcaaacctataatctcggtacgttggctggccaagataggaggatagctggagtccaggagttcaaggccgaactatacaacttagaccccgactccaccccctcaaaaaaaaaagaaaaaaagaaaattaacgagacctggtggtgcatgtctgtagtcccagctgactgggagcctgaggcaggaggattgcttgagcccgtgagttcaaggctgtagtgagctgtgattgcgccactgcactccagcctgggtgacagagtgagaccctgtctctaaaaaataaacaaatgtttatatgccccatgtttatttggttttgatttctcagtgctttcaagtataaacctggctcttactctgttattattattatctttttttttttttttttttgagacagagtctcgctctgtcacccaggctggagtgcagtggcgtggctcactgcaatctctgcctctccagttcaagcgtttcttctgcctcagcctcccgagtagctggggctacaggtgtgcgccaccacaccccgctaatttttgtagttttagtagagatggggtttcaccatgttggctgggctggtctcaaactcctgacctcaggcatgagtcaccacacctggcctgctctgttactctatgagcatataagaattattttaggagagctgctacttaaaaaaaaaaaaaaaattaactagaatcctaattgtcatcatttagttgtgacctttagctgtcacatccccagtctttttggtatctttttgttcttagcctcttattattgatcctgtttctttgcttgttgacttgaggttgggtacctacataaaactatttatgtcagtttccttgatatggtcctgtccttttttaccttgagcaagtgaaagtttaatgtggtttttcttactagtaataagaatataagttaggattttatgtccaacttcctaattttaaaacctctttcttgtgactttgaactttcctaaaacaaacatatgattagtttatgtcagagcatagtaatttttatggtaataagtggttttctaaatatattgaaagatgaaatgtatactggaagagtcagaaagaccatttagggtttagatagcctttattatttataatactaagtagtctcaaacttacctattaatagatatattcaaatatatctatttctatattcaaatatatctattttatattcaaatatgtctattttcttgagattacctgattctaaagctgaacatctgagaacctaattaatctctgacaaactggtacagtcttttcaaaatgtgaccattattgagcaaatgattagttaggaggtctaacctaatggaaataatgtgtcttcttgtttctgttacttttaaacttttaatgtgtcttgtttctgatacttttaaacttttattatgtatttaagtttctttagtgttttgtgtttgaaacctgttatttttggaacttagtattatgtttgaaaatcacttataaaaacagtggagttcattaaaaggaataataatatcacaatcaatttacacttaaaatgcttgactgagcttccagctttttgtttattctaggaactatcgtgagcataggtgaccctaagaaaaaatatacaagatatgaaaaaattggacaagggtaagtatttgtgactgtattacgataatattcagtattcagtatttcctggctttatagcatgatgtttattttgcctgccgacatcaagtacttatatagtattctgtgagtggtacccttgggggatttgtgtaaataaataatgcagttatttgtagatgctgttaaaaaactgtactagttgttagcaatgactgtgtatcattattttttcttaagtgtcatttcccatctgtgataattagagggaagaattgcccataaaatatatttaaaagacaataagaatatttactgcatgactataagcaataaaaaatgcatttaaatcatgtcattgtgtattgacttttgagtctactgatcttctgattttgttgtgtaatttgtatttttaaagtatactaactaaactccttttttctgttgcttggaagcaaataaacacctaaatttttaatgttattaaactctggaaagcattctgtgaatttagagtgagggcttaagccatttttgaaaacttccatatgaattccttcctcccttccttcccttccctccctcccttcccttcccttccttccctccctcccctccctcccttccttcccttccctcccttccctcccttccctccctcccttccttcccttcctttccttccttcccttccctcccttccctcccttccttccctcccttcccttccttctcttccttccttccctttttttttttttttttttttggcggagtctgtcactcaggctggagtgcagtgacataatctcagctcactgcaacctctgcctcccgggttcaaacgattcttctgcctcagcctcccaaagtgttgggattacaggtgtgagccactgcaccaggcctgaatttcttcctaacagctaaattcaattgcagcactggttttatgaaagagaattgaagattatcttactatttttgagcatgaatgaacaagcaatacctatccatatggatgaccatcacaaatccagtgttgagtcacaaaagcaagttgcagaataatatgtgaaatgaaactatatgacgtttaaaaattagacaaagtatattttatagggatacatatctgcgtcctttgtagttaaaagtatggagaaatgcatgaaaatgatgaacaccaaatacaggataaacaccaaatacagatcacctttgggaggaaggagactgctgtcggaaagggcttatgggaatcttcaaattatttacagttatttgtatcttaatcagggaagtgtatccttaagtatatgttatataatttttttcctgctcttttttccctacatttttgtaggtctgaaatatttcacacataagttttgccgtaaggattgtctctttcttcccccaccccctttcctcaggtttttgcttttactccttttaagcacgttaggtcatcctgttctttaattctttttcaattgcttgaagtgtaaagtctttggatattgcaaatgctagtgatttatcaaccttaaatctggttgtgtgttttctccctctagggcttctggtacagttttcactgctactgacgttgcactgggacaggaggtagttactttgttgtaatcctgggtgttaccattattttgtcatataggtggaaactagatgaagctgggaagaagcaataggaacctcttttaagttgagcccgttgtaagaatcgctctacgtatgtttatagcacttctgtcagtaaggcggggaaggacttatgagttcaatgtcataaataagcaaatacttaaaaattgtttcctcagcttgaagtgaaaagaggattaattcttagtattggactgactgtgggtgtattaatcaacttcaagataaatctaaaactaggttctaaacattacaaagcattgtgcacaggcagtgtgcaaggcaaggtgccacctgggagtaatagcatggtgtaatacagtacacgtaccgtgagttatcaactgcttggggtttgtaattttctaagagaattcctaaacctggtttttttcaatcctgttttcattataggttgctatcaaacaaattaatttacagaaacagccaaagaaggaactgatcattaacgagattctggtgatgaaagaattgaaaaatcccaacatcgttaactttttggacaggtaagtatgactattccttaaacaccgggagaaaatgtagaaattttaagtctcatggtttcgggggtggggctggccactttggaataaactgtcagtgccgagaaataagatggaagaaagaagaggagaggtaaaaatagcacagtgcagttttagaaggtccttctctgcaaggacatcacttggcaggtgagagaaggcagttaattgaaggccatagctggtggtgtttatactcatcgcaaacgacctgaagcgaacacatgaatggttggctgtgattcgtgtcttgactgacagaggggactggttacatggtttttaaacttgtggatcaatttttatttcaaatgctatccttcatggacaaatttatatgtctatcaaaacctcatttagttgaggaattaatgttaaataacagaccaaaaagcagaatagaaaatgatgcatattggctgggtgcagtggctcacacctgtaatcccagctactcaggaggctgaggcaggagaattgcttgaacccaggaggtggaggttgcagtgagccgagatcgcaccactgcactccagcctgggcaatggaatgagactccatctcaaaaaaaaaaaaaaagaaaagaaaatgatgtatattactacaactgcatgagagaagattcgttgaaaatgataacagtggttttattgaagatagaggtgattataggtgattttcttccatatttaaatttgtttagaatgaggaaaaaataatgtttagagactttatccctagttatggagaacatgttcatagaaataaacttttcaggctaggcacggtagctcacgcctgtaatcccagcactttgggaggccgaggcaggtggatcaccaggtcatgagatcgagaccatcctggccaacgtggtgaaaccctgtctctactaaaaatacaaaaattagctgggcatggtgccgcacacctgtagtcccagctcctcaggaggctgaggcaggagaattgcttgaacccaagaggtggaggctgcagtgagccgagatcgcgccactgcactccagcctggcaacagagcaagactctgtctcaaaaaaataaataaaaaataaacttttcaggtacagttccctgctttttaaaataacatttcaagtcagcatagtgtggtggttaagataagccaggggcttcggaatcgttgatccttggcttcatattctggttctgtcacttcctattaatagctgtgtgcccttggatgagtcacttcacctctccaagcctttgtctgtttatctctaaaacaggactagtaatttctatattgtagggttattttaatcagaatgagctatgtgcatactcaaactacagttgtgggcaaactgtaactttaaaatgattcaggatcataacttcagttatttttctgtgctgttacgtagcagctttccagttttcttcctaactctcaagctaccagctctagttttattgttagggtgtttaatatttgaattcttcaacatagaataccatgtgtttaggaaaaataaaagtgtgactgtatttggtatgttgtatttttagttacctggtaggagatgaattgtttgtggtcatggaataccttgctggggggtcactcactgatgtggtaacagaaacgtgcatggatgaagcacagattgctgctgtatgcagagaggtaggtttgcctccttcttgatatgttatggtgatatgtggttagcaagaagtgaacaaaaggaaatttttctgcacaggtaattgttattgtgggaggtgctttctctgtatacattctctgcaaattactccatctccgtgccatttcatcctacacaggagtttcagccctttccttcaggtataagataatttgggaatgaattgtggacctttgaagatccagattcacaaggaaattctggtagagtgatgatgatcatttaccatccaaacaggacacttttgagagtaaaagggtatatatcattagaaatacaccactcaggctgggcgcggtggctcacgcctgtaatcccagcactttgggaggccgaggcgggtggatcacaaggtcaggagatcgagaccatcctggctaacacggtgaaaccctgtctctactaaaaatacaaaaaaattagccgggcgtgttggcaggtacctgtagtcccagctactcaggaggctgaagcaggagaatggcgtgaacctgggaggtggagcttgcagtgagccgagatcacaccactgcactccagcctgggcaacagagcgagagtccgtctcaaaaaaaaagaaaaagaaatacaccacttagctggaagtggtggctcatgcctgtaatcctagcactttgggaggccaaggcaggcagattccctgaggtcaggagttttgagaccagcctgggaaacatggcaaaaccccatctctactaaaaatacaaaaattagccaggcatggtggtgcacgcctgtaatcccagctactcgcgaggctgaggcgggagaatcgcttgagctgaggaggcagacattgcagtgagccaaaattgcgccaccgcactccatcctgggcaacagagcaagattgtctcaaaaaaaaaaaaaaagaggctgggtacagtgtctctcgcctgtaataccagcactttgggaggccgaggcgggcagatcatgaggtcaagagattgagaccatcctgaccaacacggtgaaaccccgtctctactaaaaatacaaaaattagctgggtgtggtggtacgcgcctgtagtctcagctactcgggaggctgagacgggagattagcttgaacccaagaggcggaggtcacagtgagccgagatcgtgccactgcattccagcctggcgacagagcaagactccgtctcaaaaaaaaaaaagagaaagaaatacgccactcaaccgtggaaactagaactatctcaggtcaagcaggacacttatttgccttcagtatcaataagtctgtgcctggcttcattgagttcactaatggtgaagaaaccggttatttctttatattcattaatgaatttctagacatattattagcttaaaccagtagaattctgccaaattgccaatttaagccaaaaataagccttcttttttccacctatatctgagctttttctacagataagatttgggctaatggtttgcttattgtcattgaaacttctaatgtcataggaatcactgtcacaaagggcaaaactttaagtttataagactatattgtgttttctatgatttggctttcagcagttcttcagtgacatgtgaattacaaactttgttcatgtaaggatgatacatatatatttcccttttccatctgtcattaaggtgttaaaaatattaaaattttaattctgatttgtgttctacctgaggaatagtacctctttggtagaagggaggaaataagaactcttgaatagaatattaatagaatatgatagtccttaacaatgcatgcttggtcactgaaaagctgataaaaacaagaatttacctatttatacttaattttgttttttctaatacatttctttgtaattgatataaaaattaattttggaagttcctctaatttgggttttcttttgtgtgccagaacttttaaactgtgacgagtttgtttctatttatttgtacaagtattttctggagctttgaatctgatgattgcctggtaaatgtattgcggtaacacccaatttatctgtttttccttgaatgaatagtagaagattttggatgagatttttagttgtacagactttgttctcctctgatgggagtaagaaataaaagcacagctaacttacacccgtagttcaaaaacacaagagtgagcagatttttaaaacgtcatctcgttctcgtttgtaaggaaaggagtagtttacccccactttgtgactcagtgctctctgaaatatggcataagaggaaagttattcttgcatcattcatgtccaagttgtagatacagcttaatataaaatcgggcactgaagaacatcttctttctgatgaacagctaagtggaaccaggccacccagaatcttacccgcttctcagtggctcacattgattagccttctgagtatctcatgttcaaatgggaatgatcaaggttttttcattactgttgaaaagatttctgaggagcctgtgcatgtttaccaagtgttgtatacctttaggcatttaaacctgaaagaggcaattttttttttttttttttttttttttgagactgagtcttgctctgtcgcccaggctggagtgcagtggcacaatctcagcttactgcaatctctgcctcctggattcaagggattctcctgcctcagccacccaagtagctgggattacaggcctgaggcaccacacctggctaatttttctttctttctgtccgtctttttttgttttttcgagatggagtcttgctctgtcacccaggctggagtgcagtggtgcgatcttggctcagtgcaagttccgcctcccaggttcaagcgattctgctatctcagcctcctgagcagctggggttacaggtgcacaccaccacacccagctgttttctttgtatttttagcagacacagggtttcaccatgttggccaggctggtctcgaactgctgacctcaggtgatccacccgcctcggtctcccaaagtgctgggattacagaagtgagccaccatgcctggcctcccctggctaatttttgtattttttagtagagatggggttttgccatgttggccaggctggtcttgaattcctgccctcaagtgatctgcctgtctcacccggccaggaggcaagacattatacagacccagctaaacaatgtctctgagtaagatcagagggtaggagcggatctactgactttttaaaaaattttattttcttatataaaactttaaggaggagatctaattacttttcataactttgtatataagagaggatgttttttctttataaataaaagtattggagggtcttctgctgggcactggaagcaatgctcaggccatagctactgcatgtgcctccctgtgtcttttcagggactatttcattaataggtgtttttcttctgttcagtgtttacaggcattggagtttttacatgctaatcaagtgatccacagagacatcaaaagtgacaatgtacttttgggaatggaaggatctgttaagctcagtgagtaacaaatggacaattcacaatcatttattataattttctgccttttgtttaattaaaaacttttcttgaccaatgcaaggattaataatgatttaatataggaagaggtgagacctttgaaaactgagtgatcctctgagggttttaactaatcagtgccagagaaaggactcgctggataagacattacctaataattaccactagataagacattattaggtaatgtcttgtcttgtctttttgagatggaggtttgctcttgttgcccaggctggagtgcaacctccgcctcctgggttcaagcgattctcctgcctcagcctcctgagtagctgggattacaggtgtgcaccaccacacccagctaatttttgtgtttttagtaaagacggggtttctccacattggtcaggctggtctctagctactgaactcaggtatcttcccgcctcagcctcccaaagtgctgggattacaggcgtgagccaccgcggctggccatgattgcttatttttaagtaatcttaatggggaagctctcatacatttttggtgaatacacatgaaaatgaattaaacttttggatgacattttttttttctggctctgccatttactaagtgaataaccttggataagttgtctttatgcctcagtattcctatttgtaaaatgggaataattgtaataataaatgtacctttctcatagggttaccatgcggattaaatattttaattcttataaggtacttaaacagtatctggattgttttaagtactcattttagctataaatattgtttgacctaactgttactcttgtagaattctctcctgtagaatttctgaacttacataccgcagtaagtacaaggatgttctctgcaatattgtaaagaaaaaccaaaactatcttaagtgttgagcagtaagggaataattacatggattattatatttttatattctgtatagtttttaagatgagggaggccgggtgcagtggctcacgcctgtaatcccagcactttgggaggtcgaggcaggtggattgcttgagcccaggagtttgagaccagactgagcaacatggcaagactccatctctactaaaaatacaacaattagccgggcgtggtggcaggcgcctctagtcccagctactcaggaggctgaggcaggaggatggcttgagcacaggaggcagaggttgccgtgagccgaaattgctctactgcacacagcgtgggcaacagagtgaaaccctgtgacaaaaaattttaaaataaaaaattttttaaataggcagatgtactaatatggaaagatctcaagaaatggttttaccaaagtttacagagtatcctgattggtaatacaaaccaaaccgttcatagatattattcatgcatatgtacatgcataaccaacagtctaaagcttacaaacctaaattttaacagtagtcacatatgaaatggaatgggtttaacagtataagaaagaattctaaatactaatcctgacttttccactaaatgaacattgagtactacactaggcatcctgcacctccattacaggtgagattgagaagataatgctggtggcgaccttaggctctctgctgagatgatggatgtttagtgattctggcttctgtttgttttattcaaaaatagtttacagctgggtgtgatggcgcacacttgtaatcccaacactttgggaggccaaggtgggaagatccctcccatgttgcccaggagttcaagaccagcctaggcaacacagggggactctgtctctacaaaaaattttaaaaattaaacaaaattaaaagacaaagtagtttccatgacctgacctttacctgattcactgcatttagttttggtgtctacttttgctttactttttcgtagacctctttcagttttattaaattttttaggatagaatgaattattcagaataaaaggcctcctgataatttggactctgtggcaagtaaaagtaaaatgtgagagtgtgttacatcatgaaaatatttttaaactcattctggtttactttattaatgaaatctttaaaaacaagaggcctaatagtcaaaatataattaattacataatctgaagtgaactcttctgctaaaaccatccatggaagccattaactctgttttgttttgttttgtagctgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggtaagatgagttaaacaccagccttgttcaatgtttttctttgaaactcttatttagaacttgcacgtgcctggcactgtccaagaatttaaagtagaaggttgataaaacctaatctctgcccctaactctgcatctagaaatcatttgctctctgagttacaaattaatgtgttaggtgaagactttgtaggtttttagtagtaagctgtattgttttgtattttacgtaggaagtttggagcacctgtctctaaagcttctccttcttttattttttaagatgttttgagacagggtcccactctcttgcctattctagaatgcagtggcgcaatctcagctcactgcaaccgccacctcccaggttcaagcgatcctcctacttcagcctcctgagtagctgggactatgggtgcgtgccaccacacccagctgatttttgtacttttcatagagacggggtctctccatgttgggtcaggctggtctcaaattcttgacctcagttgatccactcgcctcggcttcccaaagtgctggcattacaggtgtgaacaactgcacctggccacttctcttttttttaaattaccatatgtggctcaacattatcagttattaaggaaatgtaaatcaaaacctcaacaatcagaggctgaggcaagagaattgcttgaacccaggaggtggcagttgcggtgagccaagatagcactactgcactccagcctgggcgacagggtgagactctgtctcagcaaaaaacaacaaaaaaccccaccacaacaggataacacttcacaactactagaatggctgtactcaaaaagacaattaataaatattggtgaccgggtgcggtggcttacacctgtagtcccagcactttgggaggctggggttggaagttcaagatcagcctgaccaacatggagaaaccccatctttactgaaaatacaagattagctgagcatggtggtgggtgcctgtaatcccagctacgtgggaggctgaggcaggaggatcacttgaacccaggaggcggaggttgcagtgagccgagatcatgccatcgcactccagcctggtcgacaaagcgaaactccgtctccataaataaataaataaatgttggtgagaagataaggaaactagaaatctcgttcattgcaaaatataaaatggtacatctgctttggaaaacaacttgacaattctgtgtgaagttaatacggaattaccagatgacctagcggttcctctgctgggtacagagccaagagaattaaaatcatacatccatacagaaaccttcatgcagccacagaagtggaaataattcaaacctggtgaacagtggaatattatttggtcatagaaaggaaggaagtgccaatccgtgttacagcattgaaccttgagagtactgtgctaagtgaaagaagccgaacaacagatggcagcagattctgaccgtctgtttcctgaatgcttttcatccagttgccaaagattccagtttatgtgggccgttaaagtacttctatagaggtgattagtttagaccacttttcagaatgacattaaagccctctaatgttattcattcatttagccagtattggtttgggtacctgccatgcgctgagcactattcacaatgctgtctaaaagaacccacaaaaattcctgctcttacagaacttgtcttctagtgggaaaagagaaaaacaaaataaatcagaataatgtgtcatacattgaataatggactcttgagtactgagactggcaggaaggaggttagggtgtttactttcaaaaggtgcttagagagctgggcacagtggctcacgcctgtcatcccagcattttgggaggccaaggtgggaggattgcttgagcctaggagttcaaggccagcctaggcaacatagtgagtccccatctctacaaaaaaatttaaaaattagccaagcatgttagtgtgtgcctgtagtcacagctaattggaaccatcatcctgccccagtgcgtgggtcacttgggcccaaggaagatgaggctgcagtgagctgttatcacatcactgcactccagcttgggtgacggctaggacctgtctcaaaaaaaatacaataaaaataaaatgtaaaattaaatcaaaagcgtgcatagggagggcttccctgaggtgacatttggacacaggaagtaagagcgtgatacttacctgagggaaaagcattctaagcagaaggcacagcaagtgcaaaagctctaaagcaggagcgttccttgtgtattgagagatgattctggacctcagcacagctggcgtacgctgagcaaacagcgagaggtgcggtcgatcggcgaagaaaccaggccagaccgtagtgccttatgagagctctggaaggattctggcttttactggaggccaaatggggaaactgttagagagatctgagcagagaagcaaagtggtctccttcagttttaataggatttccctggctgcgttgttgagagatccctgaggaaggcaaaggcagagcagaagaccagtcaagaggctgatgtcataattcaggcaagcagtgatgatggcctagaccagggcagtatcagtggaggtgggaaaaagtggtgtgagtctggatgtattttgaaagaagagtctacatgagagagaaaagactaacgggatctgttcccaagtaactcaactgcattcctgtacaaagctgaagagtcttacagggctgcgtctatagccaggagtacgctcaggcttcagaagaggctcgcctccagtggccttcactgtggcaaaaaggtctacttgaacctcagtgagatcggtaaaatcaccagcgccaagctcctatcagcagatccagaagctgatcaaagatgggctgatcatctgcaagcctgtgactatccattcccaggctggatccccgcaaacaaacaaacaaacaaacaaacaaaaaaaacaccttgggccgggcacggtggctcatgcttgtaatctcagcactttgggaggccgaggtgggcagatcacttgaggtcaggagttcatgaccagcctaacatgatgaaacctcgtctctactaaaaatacaaaaatgagccaggcatggtggcgtgcacctgtattcccagctactcgagaggctgaggtgggagaattgcttgaaactgggcgacagggagagattctgtcgcaaaaaaaaaaaaaaagaaaaaaacaccttggcccacaggcatatgggcataactgctaatgcacacattaccaaaaaggcagcctggatgaggaagatgagaattccaccccagctgctcagaagacactatgaatctaccgagattgaccttcacgtgtatcagagcctgtacatgaagtgaagggggacgtgttcagaaacaagcaggttcttcggaactcattccaagctgaagatagacaaggcctcaagaagcttctcattgaccaggccagggcacatggctctaagaccaggaaagcactgtagttccacggagagtgcctctgggccaagagaaaatcattaagactgtcccaggaggaagaaactaagaaataaaggtctccctctctcgtctgtacatagtggatcttggtgattacatagatccagtcattcaaatacaacaagattttatctgcctgatggggggaaaaagcatattggtaggaatacagaaatagccaggacccagcaatcacccagacatcagtcaaagtttaccagacaggcaaaggagcaggcagatgcagcccataatgagaaaaacttccaggcaactggaacggacagaagttcattaaaacaatctcacgactgcatttcagttgtaagaactttaaatgcatattgcttagtgaaagaatccagtctaaaaaggctacatattatttcaactgtagagagtaaaaatgattagtggttatggggtttggcaggggatcgggggtagagaggatgagtaggtgaagcacagggaatttttttgggcagtgaaattactttgtatgatattataatggcggacactggagagcattcatttgtcaaagcccatggaacaactaggcacggtggtgcacacctgtagtccctgctgcttgaaaggctgaagcaggaggatctcttgaccccaggagttcaaggccagcctgggcaacatatcgagaatgcattaaaaaaaaaaacaagaccataggactgtgtaatgtaatacagagtgaaccctaatgtaaactgagggctttaatttaatagaagtgtatcaatattggttcatttgtaacaaatgtcccatagtataataatgtagacaataataaaactccacattggggaggttgcgtgtgggaactctgtactatctgttcaattttctgtaaacctaaaacttctaaaaaattagtcagttaaaaataataatttaggaccagacgcagcggctcatgcctgtaataccagcactttgggaggccaaggtgggcagatcgcttgaggttaggagtttgagaccagcctggccaatgtggtgaaaccccacctctactaaaaatacaaaaattagtcaggcgtaatggtgcatgcctgtactcccagctactcgggaggctgagctgcaagaattgctggaacccgggaggcagaggttgccatgtgttgagatcatgccactgcattccagcctgggcaacagagcgagactgtgtctgaaaagaaaaataaataggccagatgcagtggctcacacctgtaatcccagcactttgggaggccaaggcgggcagatcacaaagttgggagtttaagaccagcctggccaacacagtgaaaccccgtctctactgaaaatacaaaaaattagccgggcattttggcgggcgcctataatcccagctactcggaaggctgaggcaggagaatcgcttgaactcaggaggtgaaggttgcatcgagctgagatcgtgccattgcattccagcctgggccacagagccagactccgtctcaaaaataaataataaataaataaataaataaaattcaatttatagaaatgtaaaggaaataattagaactatgtaaggattttctaaagggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaa

SEQ ID NO: 2017 - DNA, 168463 bp, Homo sapiens
tgctataactgctttttccattttattcaaggtgttaactaaaatacagagagctttcaacctactttttcagtcattaaactaaaatgccaaccaagtccagttcacttctaaaatgtattggtacaatccagtaaagaggagatgacaggaaaagaaaagtcaacaacactaagtatagtaatgttcctttttgtttcatgaaacccaaattgttacaaacatcaattttagaaatattttatgtagacattaaaacaaaaaggcaacaagaaatgcaaaataaacacacacacacacacacacacaccaataggtttcacctgagaatttgaagtaattcagagacagatttaatattctttgaccaatagagataccgagaaactgtgcacactaaaatgaaaataagcaataaaagcaaatagtactcaaaatttaaatgacattggttaacaatggagtacgaaaaggttattgaatgtgctaagtctaatgctttaacactcttcaatcattcaccttttaatgcagacctttaattatattcataatcttatcttggtgaactctacacccacacctatgaattctgtcaatttcttagttaaacaaaactctcctagaaacctaggaccagggtcagagatagaattaaaatcacccactctcaggagaaatggaggaagcatttacactgaaagtctgctgaatcccagattctgtaatataaaccacttaataatctatactgacatttcaaagcttaggaaagggaatgttgtacaaccctggacttcattgtgtttattccctatgaggcacagagcaagataataaacaagcccctcaagctaaaagaggaacacagaaacatatatgtgtgtatatatatatatactatacacacacatatgtatgtgtgtgtatatatatacatatatatgtatatatgtatatcacagaaacatatatatttcccaaatttttcttaaaaagcaccccagttcaggtatcttgaataaagaaaattagtcatagacgaaaaaaaagaaaaccttccagttgtctaccaagaaaaaactaatatggatattacatgcatttctattttgaagaccaacagtttattaatttattaatagaacctgtatttttctgtcaattattgtgctttcaattattgtgctttgaattatatatatatatatatgtgtgtgtgtgtatatatatatatatatataattttaacttttgagaatggataattttaacttttgagataaacattcagcctgcataaaacataaatctctatgaagtaaacatcttatacagtttctctctttaaaaatagctttgacatgcttctgatgtccttaaatatttgtgctgcagatgccatagttgtattttttcaaagactggctcagaggcttctgaaatattagatatccctttgctggcaaaacatcagagtgggtattcgatcattacaaggtttttcttaaaccagtgtttctcggattttactgtgcatcagaattccctgacgggcttgttaaaacacagaatactgggcctcacccccagagcttctgatccagttggtctagagaaagcctgagaatctgcatttttagcaagttcccaggtgatgctttgatgctgatagtccagggaccacactttgagaaccactgctttaaaccgttagtttataagttctttaaagagcaatgtaagcttagaatccagaacctacatggtacttactaaactctcttcagagctgtgttccaggggcattccttgagaaaatcatttttttttttaaactttcttcttttagcaacagtaatgcccaggcagctagagagtccttaatattcattgcttagcattttggttttgctgggcctggactgggagtattccctatttctcatcagaagggctgcaatctactgtgtatctccaagatgttctggatctaaactctcccaggataggatctatgcctctgggggaccaaagccacagctacatgtctttacccagtaagtctatctcatccaggaggaagtccatgtcctcccggctcacttgagggctgatcaccacctggcggaagaagttgacctttccccggtgcggctggtagcccagcatcaagcttcccttcttcatcatcctctccttaatggctggggccacctgtgtggggagaaaaggggagaggggtgaaagaccagaacatcaaggcatttcaatagcattttcaccagccattggacatttactgggcatccactggtttggatcccattctcattcacacaaggttgacactaataataataataatttatggaggactcatgagtactgattcaagtgctttagacatattaattaatcttcacaataacagtgaggaagatgctactaatgtgcccatttatggtcgagaaaacaggtacatggcgagtaaatcagtatctcaaggtcccaggcattttctccctaagcccatactcttaagtgtaaatcattattcaatgctgcctcattaaaaacaaatcaggtgtccacagggattacagtctcattctcaaatttgtcttaactaaaaaacaccccagttcaggtatcttgaataaagaaaattagtcatagatggaaaagaaggaaacccttccagttgtctaccaagaaaaaacaaatatggatattatgtacagttctattttgaagcctaagtttattaatttattaatagaacatgtatttttcatcctagaaaaaaagaaagttagatattattctcatatatgaaatataaacaccctgtctcttattaagagatgtaaatgtggtaataaaattaggaagcacatattttaaagatctatagctgacatgagaagtacaggccctgataatccagatacacagatttttctaaaagtttaatgtttgaagaaactagtctaatttaagaaccacatgggaaaatcagtccattttctaatcagtagtatggccaccaaagagctaggttgtaaacttttaaaatagtgaagttcatttttgatacactgagttaaaatattaagaatgcatttttactgtcttggaaatacaagcaaagtttttccacttgaattttattttaactctgaaaactttttgagtgtgtcctatgtgaatatgtggaaagggaatataatgagtttctatccttgccttctcaggaagatgagacttactcctccagaagggaggagtacatatagaaagaacaccaggcagagtgtgcttttaaactccttaggtgaggggcatgaatctgggttcccacgagtctccctctctcgtaatgtgataatcccacaccagcccagtttttgaacatacccacattttgtcagcaagtcaaatgacttcatctgacactcaacacaatcttgatctgttccaaagctgatgaaaaaattgggtgttttagacctctgaagatattatgtgttgaacttaaccacagagccttctcaaaggatgttcaaggttaattttaactcaacacttttttttccacatgtactaattttagaatataagtcttgcaaaacatggactacacagtgcttgcaataacaaaacaaacacctattcaggaaaatcacattgccattctagcaaaaaactggaagtttcttacattatcacaagatatgaaaagaaaatatatgagtgtaaaagaaaaaatgtagaaaaggtgatgttagaggtcaagttagtgaaaaaagcatgggccatcaggttctacaaacttctaaatatatgtgacacattttattctgagctttctagagattagaaaaatgtaactaaacaacagcctgcattcacttgaaaagagtggcaaatgtccagttgatgctggaagccagaagctaggaagtaactctctactatgcttatacatatctgcttcaaacccatgaatttgtatgcattggttgagttttcttccaaatccatgtatgcaagtagtaattctaaaatctagtaaaaaaatatgtaaaacaaagatagatgagtgccaaaaaaagtgatttttgtaaaaactaagttgagtcctttggaaagaagagataaagggggatggctaaacatcattgtgatcacactaggcaagagaactgtaaaagcttttgagaatccagactgattctgcacggagatcgctacacaggtgtctgagtacttacttcacctgaagaaacccgagctgcataagacagatgattcctgaagaatgtagtttatgcaagaacagtggagggccctctcatcatcagacctctacttaagaaaagtttcacttgtttataaaaagcatttggaaatcttcactaggtggaaaaaacctttccatcaaaagatggtaacataaatgtacactgatatacaaatataacattaaaaatttaaatataaagatacaaatattaaatgggaaaatgctcacattatgtatgtatcacattattttctagaattatttgctttacctgactaatcctcctcaccttaggtaggagggcttctcgtgcatatgtggatataaatgggtctgcgtgcataagcatgtgtgtgtgtgtgtgcctgtgcatatatgcacatgttaatatacacactcacatataatttaaacctctgacccaccatattgtactgcttttaaaatctctctggccacagggcaatggagaaccacgctttgacttaggttcatcataaaagtacacttgtttttaattcaaagaacaagtggctttctgaatgcaaactgtgagaaaaagacaacagtagtgccagtgctgaatcaagattgggaagacctggtttacatggaccaaatgtctagctagaagggccacagactatcagttttagagcttacagcttgcggttctgtggttcttgtttttgaaatcaaaattctcttcatgttcctctccttcgtcctccaggtacccagggtataactggctctggcttgtagccaattttaaatgtaaaacaggcatgctcttggctcaggcctaatttgcatagtgtattcctgtttacttttcaatacttccattttttctcccaaaatggtattttatgccttatctttggagagcattagaattttgattccagtacataatatatctgaggctcacatgaggcaattatcaaaatgaatctgtcacgtttgtatttcttgtgaggaagccagaaatactttctaacgtgaacaagaaaggtaaaggaagagggcacctcagatgttttaatataaagatactttggatgtttaaattcttgctcttgtgtaaagcgcatgactgtacttccatgggcaaaacgcagggaataaaaaccaaacttctaggacaaattttgttactgactttctgagattataaagacataactaaatatatgactcagagaactagctaagcaagggtttaacagtacaacacatttttatttatgagtctatgaactataagattaattcctacaggcagttactactaggtaaaaaaggaaggtctcccttgtctatgaatacttcgcgggaaagaaagtaataacatcaaagctgatattcatcaaatctttatcacaaactattctgctggtagtagtagttgttgtttttaacaagtattttaccagttctttacaatttgcaatgtcctctcacttgtctgattcccataaattcaaattaaagcttatttgaaaggaattcatgttttggcaatttagggaccaagcacgttctcactaacagtcagcttatcacctttgcacttaaaatcaaccattttttatttatgaagctccaggcataatccaatgctaggtaatttggatattcctttttgctgatcacagcagagacagtcctaatctgacaggatggcatggtcacaggggaaggaaaatatgcatgaactaaatgtaggtatccagataccacccctaaatggggcgcgcatagaggaaagcaatttggcaggagtgagattgctttccagctctcaattatttttctgctgttttttcttcaaattgtaaatcaaattcttttcttgtgcctcagtgcactggtccctgcatcttaagtggaggaagattctgacatttctatttggatacacggtgacttaatgtacacatttctgtggaatttgtctctccctacccctgagttatgttccatcagtgatttagtcatttaaatagagtctcgttgcacatcgctgtagcaccaaataggatttgatatttaaaagttgcttaaacccaaggaaaaataaaataaaatgactttctttctgaccaagcagggcaattcgataaaaagcttctgaccaggcatcattattgcctttgattaaaataaaatgataatttccataaaatgacatttctttttaagaatttgttatatactcagtgttaacaagaacagtttttcaaaatacaaagtgtttttcagggtcgggcatggttgctcacgcctgtaatctcagtactttgggacgccaaggcgggcagatcacttgaggccaggagtttgagaccagcctgagcaaaatggtgaaatctgtctctactaaaaatacaaaaattagctgggtgaggtgctgcttctttgtaatcccaactactagggaggctgcggcacgggacgcaggggttgtggtgagccaagatcactccactgcattccaacccgggtgatggagtgagactctgtcttaaaaaaaagtaataaaatacaaagtgtttttcaaactatctgtggggaaggatcagttttatttttttcaatgcattataaactaatactttagtaaaatacaataaaaatcaattactagcaaaatgaaataaaaatacaagcccaattttgtttatttttaagttcaatagtaaagctaatctgttaaggttgctataaaagtttctaaatggaaactgtggatttccataaatttcttattgcagactggtgacacagatgggttgggattgctgctgtggctttcttccagtatagtttttctggaacaatcacaaaaactaatttgctttatactttcctcccacgtaatctgggttcccaatgtgtcccactttctatgtcaacttgaggagagttctgctgagtgggatattgaaatctagttcatggaaaaaattggcatgaaatgttcatactttgtatctggcacccaaaactatcactgagacttacatacctccctcccctgtaaagtcatctcttttcttttcttttccttttctccttccttccttccttccttccttccttccttccttccttccttccttcctccttccctccctccctccttccctctctccctctcttgattgcttgcttgctttctcttctttctttctttttttgtagtttggggtcatcttagattttctgaagccaggtggagatacaccacggatcaaggcaggggccagaattcagggcatgaacagcatcaaggggagagcttaagtggaaggatttcagtccaagagaagtattaacatgtcaagacaattcagactttgatgggctttccccgtgcctcccccttctgagggggtgctccaatgcagtggctatctagaaggcagagtttttcctgtctcactgtactcaggagaaattagccacagtcctcaaaagctgaaggctgattaaccatctgagaaaagccaacctagagagtcttgaatgccagcttctgcagatgtgaaaagttagacatgtgagaaagcatgaaattcttttatttgctttattaatttttctggtatttatctccataactaaagcattatggttgccagtgaatttaaggtcttcagaaccatgttagatcacaaagtctcacatcgatttacatctctgtttgccttttagtttcaatttttgtttaagtatattcttcagtggaaagtggatttcatctgtttctggtgatgaaagagctcaacaatatgtctcatacaaatacttcttaaaacctaatgaatattcttatctctgaactacatatctgaccataaatatgaactgaattattctgcctgtaaatatgaactggattttcctttacacgtgcagctcacaacatgtagagctgaaatgggctttggattcagctaaatatatatcctctagtgtgtaacctccatgttagccaggcaggttgttactaaatgaacagctgttgacagaaagcatttccttatcgtccaaacatatgatagtgcaaaaaagaaagtggttgttttagtcttatataaaaaaatttttgtggtaatggttagctttacatctttaaaatgtattaaacggatagtttcaccaaataaaaaaaattgctaacccacaatatagaagcttttctttgtatttccaaatatgtctgagtaatttgtctcttctcccaaatgagacatcttacataccagacatttgccctcccaacacagcttgcttttgtccatagccataaactgcagaaattttgattatctttcatcatatagtcaattttgctccccattaaggaagaaaccagtacttgacagacaagtactttagcaccttcatgtttcttagagcacctgacaatgtaaagaggggaaaataatagccttcttagtttgtgttcaggtaccatctaaatctctctactttgttgttgttgtttttcttcctgatttagtcttaggtaaaatgatctgatttctctgttgtttcatcaagttacacattttccttctggaatagaaaaatagcaagggtgctgccctttttgaaagctacttgatccatgcagtaaagaaaactaaatctcccattgcattgtgtagaaggggtcacactatacaatttaaccttctacggcaattgtttgttaatgaaaaatttagaacatttttcttaaaaatgccaaatcgaatgaaatcattcactctattttcttcttcttctttacattggtgttttggctgtatagtcttcatgaaaaaagaaatgtgaatgtttacagcaactttattcaaagcaacacaaatgtacttcaagtacagaatggataaacaaaactgtggtatacctatacaatggaatactactcagcaattaaagggaataaactaccaacacaacatagaagaatctccaatagattatgctaacagaaagaagccagactcaaaggctgccttctatatgtttccatttatgtggcattctggaaatggcaaaatcaaatggctagagaagagatgagtggttgccaggacttgggctgaggggaagggttgactacaaagggtcagtcctagggaattttggtgagtgatgaacactgtgtcatggcggtgggtatataaacaccagcagacaataaattctgttcgaagctgggcctttgcactcttgggtgcaaaggaagaaggcattttgaacatggtggaacttgaagcttttcttcctggtgggctgagtggaataatgggaactgcatggctcaaagattttgggggctctaccacacatcagattgaacatatttaaatgtacccaacatacttattaaatataattcatatgcaatcatagaagatttcagttgaattgtgatggactaaattaacataatctttcattatgtttgtttttcagttttccttttacattttggatccatttttaaaactagcaagtattttaatgtggccctattgaattccatgctctcaatgtttattttgcctgatgattaaataaacaagctctgttcacactagtgtgatcaaatatctagtttgctcaggagacacccattttatacatgttttcctgtaattatcaataacaccccttttcatggccataagtgtcccagttcagatgataaactttatggattagaccgaccatacacagaccaacagactagcttagactgacttgtgacctaattcctgagattctctgtgactttgggccaatatttaactcctctgggaatcatatttctcttccattcagagccgataatcctttgcagggtccttatgtggactaaatgaaataatgagaacacaataagcatagtgcttggcatactaggcactcactaataggaactaatattatttatttcttaaaataaatttgtatttaatcaatttacactcccgcttggacttttattacattatttcattattatctcttgagacatgaacatttgcaagtgctatgaaaaacatgaaataatttattttctccccgaagtgtctaaactggatttaaatatttatgagacaggctgcaagtttgaagtttcagaaattaaatattgcaactcatgtatgccattaatcttccatttaagttccaggattttttcaaacgttgataaagtcaacttacatttttcctttacaaagtaacacagtcattgataatcttggcagattttttggagggaagttttccactaaaatttattgtgggcagggatgagtttttattatattctagaaatttctatctgttgcataagttgttagaatacaaaaacattttaaaagtaaaaaaagttactttttcttggacccatgaaaaggccatgtacttaaaattcatgagcttatttccagcattgtgcagtctccttgtgctttcttgtcacttatgtctttatcaaagaaaggttgaagaatactatttggtatgtcccaaacgtacaagaaaatacaaatcacctagattcaggccccaatcagagcagctgaatttgaatttcagtcgaataagcctagtggtctgtatatttaccaggccacccaaatgctctttttcatgatgtaagtttggtgaatgatgatctcttacttaggactttgggagaggcaaaggtgaggttggaggtaagaggagtttagtaaaggaaaagcaattttgacagaagaggggagaggaaattgagaatttcctctcgcattgcttatgtcgattttgtaataaaacaaaccagtgaccttcaaagaagttgttagccaacttttttgttaatcataaaatctaataaagtgtttaaaacacttaaccatggcccaggaaacaatgagcctcttagttttgattgctcaaagaatcaatttttctcttctaatatattttctgccatttttaaacctatctaattcttctcttactccttcatacaaccttactcatttcccctgatacctccccaatccataatttagaggtaaaatgcattagtatgagtctctcaagtttaaattatgtaaaattggtggtctatagcccatgaaatcatgtgcatccaagagatcattttagcttggcagaatatgaagaaaaaagccatactttgattggacatacctttttcaaatatgaattttacccttattttcctcctgagtatatctgaaaatcagacatgcgcaaaataaaagaactgcctcattcatgttctttccaatacagatgagcaaagctacagaaacaaagagtttagaaaccccaaaagccagaaaaacacagtgagcttcacatttggtgtttacaacatagtgacaatgatgacagcacttccaataaacctaatgtcagtcatatattcaaggcagctgaaatgaacagtcataaaaacaaacgaaactgaactgaaagctttagctgaacaatggacacaataaacattttatacactctataaagcaaaagcttaatacccagttgtgtctcagcagccacctgagctaatagctcctgagtaactgttgtgggccaactcccaaatgtctgcctatgttgggagatccctgtactgctccctaaatgcagttattcagtagctctctaccagaggtgctaccaactcccttggggcatttggaatcatggcaaagcattttggatggttgcaatgactgtggagtgctacttgcagttagtgtctcatggttaagggtgccaaacacctcacaatgctgaaaataaatctgcccaaggaagaatcatgttatccaaaatgccagtagtgcctctgttgagaaacacttctcaggagccccataattcccaccgacatctctacactttttcttgacatatcctgagacctttaagtttttctcgggagtcattaaccttgctttggcccagagcaaagtaaatgggatcttcagtgcttaaaggtatgttcatgttgttttccaaggattcataacatattcaatgagtatcactccatctgagaggagagaatgagtacaatcccaggttcttctttaggttctatgggcagtggtccaatatttctgaatattgtgtctggccatttcagcaggcatacgatgctttagtttcggcactactgcctattacaataagtgggtcatattcatgagtttttagccacacagatgtcacattcacaccttacccacacacttagtgagatgagaagcacctgaaatacactctatagaagatgaaaattatgattcattttctcacgggttttctcagggcaactttctctgagaattctattacttttcaatatttggcattgggaaattagcagctacaattttctcttttgatttattccactctaacaagccactgacagccaacgaggctcttctgggcataaaggcaaaactcctacctagcagcacaggcacagatgtgggaagcggccccagtgttggcacagcaataattttacattgtagaacctgcatatcaggcttgggaggcctagcttcctgaattacagaattactgattttatagtagatgcaggggcctgacaaggcaggggatgaaaaaagaagggagcccatggcgttatgctgctttgacctaagagacatcttgttctatacaggctgccgagacattccaattatgccttggtgagattcctgtattcgccatcctgcaccctccttcctgtgcccatcctcctgtgtgactatctacctgcccccacctgcctgtgcccacctgcctgcacccatgcacctgtatcttatcttgtttataggttttttccactgattatttgcttcaggagtaaactgaagtctaagttgtctttttgacctttttgtttgtttgaatacagttgttcattatccatacaaagttagttgcacaccacaggatgtgttctcagctctccctataccttctctttgcatctctatttatgtcattttcatgttttactgcacttctttattcagctatagtgcatcctaaaacaccttggtatttcaatctcagaggcaaaacctgaacttttaaagtcccaagtgttatgtaccttactttacttctgtcgctgaatcaaagaaagctaccatgaggatactttaaaataattcttattcctgtattattcataaaaatattgagaaaatgttaagtatgaggtgtttgttcctcctggaaatctttataaatactaataaagagtctttaccattaatgctgtaaatattaaccaacggtttttaaaagcaatccagaccatttacttgagtaatgaaatgcttttgatttgcacattttgagaaaattaatgaaagcaagttacacattattttttatggagcttgctcaacactcctagtgtttaaggttggaaattactctttcctctaaatcatgatgtttctattgtgtccagggggctacaggctacagagggatagaggggctcccacaaggggtaagaagaaagcaaagcaggcaggacccacctctgcctaaactaagctctgctttacctgcttcgtatgtcagagttctacgtaagagtttgcttggcaaaaagggctctggtatttaaaaagacagagtttgaattcgactggtaatgtatttttgttattattcaagatctttttttgggaataactgcaaaatagccctcaagatgtcagctaagggaattcctacatgccacgtctaaggggagaaagttgctcttggagtctggcattctttcccaagttggggaagttgtgagaaaggtcctagagaaacatgtggctctgctgaaaccaagcttcttttgcttaagagtttagggtaagtgatacacgtcaagttatgttcaagtcaagtaatgatagtaataaattactatttcacacaattgaacctctacgtacgtcctaaagcagttacataacaaaacactatcaccttccccccaaaggtctcttttgcttcttccaggtaatcactattcaactcctactttcttactctcccatatatgcccctagggtttcaagttatctaccagccatttgaatgtcttctttttgtgaaatgcctatttatgttctttgtatatttttgttttgggtgatcatctttttcttacaaatttagaaaaaccctttattattaagaacattaattctgactttacgtgttgcaagttatctgcttttaactttgtttttagttatttcctgaacaatttttatatttatacaaacaaacatatatatatctaatatataaaaaacaaatatattatatttgatatatcaaatatatttattatatattatatattaatatatattatatattatatattaatatatattatatattatataatatattatataatatatatttgatatatcagatatataaatgtttgtataaatatatataggtgtttgtattatatatatgtattcctagtatatatatatatatatatatatatatgtgtgagataggtggtttgtttgtataaatattatatatattatataattatgtgtgtgtgtgtgtgtgtgtgtgtgtgtattccaacactgtggtgttatacttaagctctctctgcccacgccaagattacaaaaatgtgtgttattttctgatttgattatgacacttaaacttttaatccatttaaacattcaattttttaccttgcatagagatacactcctacatccccacatttaaccagtagtctcaacactgctgatggaacaagcctgcctttccccagtgtgtattggaaacatgttcgattcctataaataacttgggcctaagccttctattctgtaagactgatctgtctattctcagaataatccaagttgttttatttatataattctataatatattcagttcctagagaactcccctctcaaaatgttcttgccggttactaccaacttagtctcctagaggacatccagaagtgtttttgatgagtttaaaaaatcatttaattattatgattagaattatattaagcccatgtataaattagggaaaaattaatcttctcacctaaaattatggtgtttttcagtttcaaaatgaggtaaatttaaaaaatatgactgcaattttgtttgacacttctctcaaagagatttcttgaatgagagagggcttgtggcacactaatcaccagtggggtgcagtggaagagatcctgtgtggcctccaaggcaaggtcaggagaggtggactattgtccaaattgttctcaggtacactgactttcccaagttcaactctcctaagcccactatgaggaattccaggccacatggagaggctttcctgtaggtgctctgattgacagctccaaatgaggtcccagctaagggccagcattaaccaccaaacatgtgagtaaagacgcttccagaatattttggcccggacagtaaatcaccttcagctattttagtcttcccagatgagactctagacatcatattccctctgtgctctgtcagaattcctgacacacaaaatccatgagcataataaaatactgcttaatgctcctacatttggagtgatttgtaaaacagaaatagttattggaacattaagtggtttttttttttggccttaaacttttatagttttcttccatagatattatactttatttaagttaactcttagttatttaatatattttttttattatggtgataaaattattctgactaaaaagctaccttctgatgtaatttttcattttctagctcccagtttcttaccttttgtgtagttattcaactttgtacatctactgcagtacatttctaaaagtattttatttgatattcttaggttttatagatatacaatcacacaatttaaaatgaacatatttgggtcttctccatttaaatattataaaattcaggtcttttctggtcattatattggctggtactctcagaacatcattaactcatggtggtcaagccagacgttcctaatttgttactgagtttaaggggaaggtatttcatgtttaatatatatagttctaaatatcatacaagaaaacaaaataatataatcatgagataaactctaagccctactattagttttgaaggtcatatattttagcatatttcaagtaattttttttttgctacatttaagtgggagaagtaattttggattactttttttatttacttgttcagagataggaagaaaatggtgaaattgctacttaaagcatgcttctgcttagctttagaaataatgacattctgctgaatggagcaataaaaacagaacctgcgcatgatcttgtatgctacaccagctgactaatccatctcctcagatggtttttcagagtccaaaaatgctacataaatttttttcaacctgtgtgagtggattattttgtggcttcctgaaataatcctctcatcttttaacacagttctgacccagtttgagagagtatctttaatatcttgttctacttcactgacctcaaggcagaatagccagaaatatatgcatttaacaggcaactttcatcttcaagctcacagaagggttggctttctttaaaaaggaaattgaaacttatattaccaggcagctttttagatgattttactttccattttataactccagcaaataggaagcagagatgtggagtgagtgaaggagatatgtggagtgaccaaggtgcctcagaatagcgcataacaattgatggaagcaaacacaagctgtcacagcgcctgcttttacctcaccattgattattcatcaggtgaaaggcactcatcccagaaagaaaaacagaaacacacgtatggaagacaaggaaagtgggttgctagaacaaaacacagaacaatagcccatccagaggagtgggctggtgaggtacttacagaacacaaccactctgagaattcacaacacactctgattccctgagtggatggttaggagcatgggtgttttctagttggtaaatgtgagactgattgttatggttattgcctgttaaaaataaattttattattgttcttcattatttaaatgtccttcttgcctttgcctcataacccacacacagggcctgctgtaggaggagtacatatctctgttccattgctaagtgaccacttctgagctgaaactctaagagtcattgtgtgtttctgccaggctttctcctttccctttggtgcaagaatagcatttcccagacaggggctcctccatcagtctggatgctggggggaagaccatggagcagagcagagctgtgactgacccccagggcatgaagcatgatcaagaaatacacctttgtattataaaccattgagatttggctgggaaaggtgggtggggagagggaggcttatttgttgctgcagtgtaactaagtgaaacctaattcatatgactcaaactaaggtatatttggttagatctaggtgagttctactttagaggaaatcctggtaactgttgtttgtttgtaagttatagctgtaattaattttccctgtattcaaagcccccaaaccctgcattcagatactatgcatttagacttccttaggcaaagtcaaggcaacaagctgatgattctaagctattattcaaggagtatctaccatcataaaggtggtttagtcatatagataatatcaatcaataatacaggagatggcaaaaattttttgtgaagagccagatagtagctgagtatgatgacccctaatctcagcactttgggaggctgatgggagagggtcatttaagaccaggagttcaagaccagcctgggcaacattaaaaaactccatttctaccaaaaactttaaaaaaattagccgggtatggtggctcatgcctgtagtcccaactacttgggagaccgaggcgggaggattgcttgagcccaggagtttgaggctgcaatgagccatgatcacaccaccgcactccagcctgggcaatagagtggcacactgtctccaaaaagaaaagaaaaagctacatagtaaatattttagactttgcaggccatacagtttctgtggcaaccactcaggttgtaagtgaaagcagccataaataatagaaaacaaatgagagtggccatgttccaatacaactttatttacaaaaaaatgacaatgggatgtgttttgcctgtaggctgacccttgttgtagaataagaaacacgaacagcggcgaacgaaatctaaataacaagcctaatgtagcatgttctacaactatgtttatatggttttaaaattaaaagctatccaggagccattgaagaacatggttaagttcttggttttcctatatgtaaaatagagacagtagaagttatttcataagatttttgtaggaattaagatgaaatataaagtgtgcatgagtgagcaagtgcttaatgaattccagcttctttaatctttctgtgtgctactattcaggactcaaagtagattattagtgaaggcctatttaattcatgccaagttaatgaatgaggtcaaacagtaataaggtgaagcacagaatcctttaagtcgacatttgccgagcaattcaaacttacggtaatgaagaataaatattaatatatgtcatgatttacatgtctatcaattagatccctaattatattgatttgacatggaaatgctttatttttattgcgggggtacatttggaatgatagaaaataattatctgtgttccacacccaaatcatgaaattctttcctgcatggacaagggatagaaaataaaaccctattgctatctgctatattaagaagctgctcaattaaacagaagtcaattttgttattcattaaactcagattgagacatcaaattttctttcagaaagcagtggatctcaatatgttgctctgtgttctgttaaataccttccatcatgaataattagtgtcaaatgtgctcagaagctcatggccaatattcatcatctttggtgcatgggccatagtgacaattgttgagatacctgaactttttctttttgtaaatctaaatgccaccagagaaaaatatatttgtttttccaatacattctctgcctgatttaacgtttaaaatttatcttcctaggcctctacttggagttcatcctgttccaaaatattaaaattctcttcccttattctttccatttcttcttcttcttctccttccccttccccctcccctttcccccacccctcctgctcctcctcctcctccttcttcttcttcttttttccttttattgcactccagctctgttgcccaggctggagtgccatggtggggtcttggctcaccgcagccttcgcttcctgggttcaagcaattctcctgtctcagcctcccgagtagctgggattgcaggtgtgtgccaccatgcctggctaatttttgtagttttagtagagacagggtttcaccatgttcaccaggctggttcgagacctcaagtggcctcaagaggtctggcaggccacagcctcccaaagtgctgaaattataggcatgagccactgcacccagcctccatttcttctccattgttaaaattacacactttaaggtaccactcactgcagacctactgagcctccagtctctaagaagttgtttctagaaatacaatttttaccaaattttcccatgattttaatgtgaaaccaagtataagaccctccttattaaaggaacatgaagaacatgagagatgctaatagtcatcaccatcaatattttcacaggggcataaaaaacagcactagggctgtgataagggtaataaggtgacaggtgcaccaggtgagacaggtgatggggtgataaggtgacaggtgggccaacaattgttaggaggagttttcttctctttttactttgtacctttcctttagctaagaacagtgtctaatcctgggccatcagatttcttacacacagaaatgccaacacataaaagtgacatataagttggagatgcaagaaaacaatggacattaagataattgacaataaaaatttccattaaaataattgaaaatagtgaaccagatctatcatatctacaaaattattgtctataaattcaatgttgtattttggtgttcctgatggccagcaatgcaggggagtgaaaatgagatatgagagtttaagcattaaagggcagaaggatactgagaaatccctcagtgaaacaacgcaatttaggccaggaattttccactctttatcctcacaggccctttttggtaccttgtgtaattatagcagacatatagggatgtctctgcaacatggtgcctgtcaggttcctgcgtttttctttttgcctctcagatgatttttactatcacaggcctggggaaagtgatttgcacatgaagcattttagcagaccaatcaattagaatcagcctttttctgtttatgtcaacagccaaatgatcgtgagaatacccaggccatttgttacctcccagggatttagcatccagcaccttgggttgtctgaagttctttccagggagctgcctccagaccttagacacaccacgagaaaatgtctccttggctactgacaataatgaatcaactgcataaatatatctgtcaaaatgatggtgcatttgtctatctgaatactagagaaggaagggtaggagagagtgaaagaaaggtggaattgagtagagtctgacacctcacaaacttagcaattttggtaaaggataaattcacatctacccatacatttctttggacatctgtgcagaatcctcaaatccaatttctttggaaaagacagtctccaatatattttctgaatcaaatggatttttagtttgtttgtttgtttgtttgcttttaaagttaatttataatttcctttgaaatgaagactgtagacatggccatatctaagagaatatgaatgaaagatttaaataggggcattcatggtcaatccacttcctttgtttatcctatcctgtaaatattttcagtctactacccatctgtcactccattctcctgattccagctcttatcaggattgtggcctgtggtttaactgactgcctttgccagagagttaaaacgagtctgttcctgattcacagcaccagctagatcactagggccactaatgatgagtttagcaaaactccctgccaataacatgaaaccattcaatggctgaaaaatgcttcctgtctgaattaaccccccaaatatttacaagtacagcctacaaaaaaattcaacagcatgcaaacttaattactcaacagtgatgaaaagtccacttattcttgaagccagagaagggaagttaggtgagttagaaagggatgacttggtgttttctcaccttcctcctggaccaaatcaatggcatagacactatggattgatttggaacaccatctagtgaaggatatgaggaagcgcatggacgtagaaaatcccacatcaactcctggttcgattcatttaacatttcctttagactattttaaatggttctgaaatgaataaggatgtaatttttttaagttatgaaaaaaacaaaacagaatgaccagtgtgtactccagcactgaccagattcagctaatgagtccacttgcctctttttctcttagcacttccccactgactacagtaaggatgtaagaaacacccccatagagttgatacaatcaagtttccttctgccggaatgtcagcatctggaatggcaccaaaggatttgagaagaatgatgccaggacaccagattttcaaacaagcatctatcagccatggtatttttcagttaaacaatatatgtgtaagaggctttagctatcaaaaaatttaaacattttctggaactcaatagcttttatcgtcagaaaatcggtaccaacagcacctatttcacagtgtgctgcacacaaaaaacattcaataaatataatattgttcaataactagaggtggcagctagaatttttaacctgggaagaaagctgaatataattcaaccgttacattttgaattcttctatataaaactgtgtcctcaatttatttatttatttattgaacttctcaactccacatttcaatgtcttaccccttgggatgttgatccatgtgctgttagcactgaataaatattatatgactgcctctaaacttcccacagagggaaaaaaagacaaagcaaaacaacaacacaatccctcacattcaatgttgtggttcttttactataattatcaattcccgaatcaatcttgccttcatgtaccctagtctgactttcaggaaacctcactgcactgttcctgattggaatcttgctttgtgttttctagcggttgctctgaagtcacatggtcagcctgccatttggggtatcatagtttctgtgagtaattgattctatccagtcttaaatggaaataaatgctgtgtttgtattgctcagcatgttaaattttccttttaggtgaagcagaaaaggttacataaggtctgaaagcctcaatcataggccactaggaacacagtgacctcccattacactcttggtcttctctctaaaatcagaagaaaagaagactggccagaatgctggagtgtctctcactttctcttttcaactcttctattgtttgaacaatgactaattagctgtcactatctttaatccagcaatgtactgactaactcatgcctatttttagcaacaggtgaatcttaggacatttcttcaagaagccagcactttagactaatgggacctactttgatcttagagaacagaacagttttcaaacattccaactgtgcttccctgattttgtgtgtctgtgtttgtggtccttgaaataatagagaaggaaggtttttacctagcaacacattttcaatctgctaggcaacacctgagaagcacctgaaggcaggcagaagtcctctactgagtggtttcattcgccccagctgaacagctgacacgagctcccgaggcactctactgaggataattagacttatactcagggaccggcaataaaacatgaaaacaactatgatataaaatgaaatgggctatctgtcataactgaagaataaactgtgatggagatttaaatcagggtattctacagccaatgatgagggccaatggaaaagagtgctttgggcaggaggttttgtactttagacaaaggtcagattttgctgtcattcaatcagctgtgtgttgtgtaggcaacttattatcattcaggttacagtacaagaatttacaagtgactcctcctcctctttctccttcttcatcaaagtaaattagaaaatactgcagattatccccatataatattcctctcactcttgctctgaaatattttaatgaatgggacagaaggcgctaaaattacaatcagaagagcacataactggagatgctggtttcttacaaaagtacttatttctttatgttgttgttctggtgtgattattgatagtatccttttcagtttcaaaaatgtcctgagttgggcaattcatcctctggtcaccagacacgcaccaacagtctatctcatgaaagctgtaacagcacacggagtggcacaagtgggtatgatgcatcgtccacatccactgacatcaccgatactgtcggcctccctctgcttaggcttccaaaacaccaggtctaccgagatgcccaaacaacattgcaaaggcaaggttatgagaaatgccacactagctgtggaaagagtaccagttgatgtttccagtgtaatgaaatgatgcaaacgcccactgtataaaaatttccgtctatcccttctctcctcttgcagccactttttttttttaacacaattgctacagctaattgtcaatattaacaacacacgcacacacaatataaaatatacatatacgtatatgtaatttgtcctgcggcttcatatggatttcaattcatatcttcttcaaactaacttattttcagcttgactaaaaagttgctaattcattcgccttagctcatttttttattttcaatgaacattagtctctggtggatcctataataaagcattatacattttaaatatttttgaaagacagaggacattatctgaaacacaaagtcaacctttgtaataaatataaaagaagcgtgctttgagagaaagaagtaaagaactattgagacaggagaataggaattagggtaaccggggttaaggcataaacaaaagaacaacaggtgcagccaattcgcataagcaaaagaacagcaggtgcagccagttctaggcaagattgggcagcttacgggccatatcctcgctcctgtgataacaagacaggagtttccagttcagcctctgattgagggccaagcctcacttcagcctctgattggtcacaggccaatccttcaaagggcataaccaattggaggcctctaaagggcacgtggggggtgttgccaattcttttggctttataaagccctgggaccattgtggtaaggagactcttgagccgcttgctggtgtttgtttctattctgtgagttgtcttcgctcagtctgtgctttttctttccttactccgttcttctgttgctttgtctttcattgcttcttttattccttcgtgtcttctgttcaacattccgagaacctgggtaactagaacctgggcaactagatcttgtaatgctatttgcctatgaaaataggcaagctggaaatatctagtagactagaaaaaaggctttctagaacttgagtggaggtatctatagaagataggctaatgtgaaaactgaaagactgaaacagtttgaggaattatctccctataagcccaccccttcatctagtcttaactacaatcgtgtctcatagacacggagatctatgcactgagaaactgaactagatttctgctgcgctggtgccccccgatggtctcgccatttcatggctcatagtttttagaggaaagtcccttggaaagctttttttgtctctgactaaacacagaagtaggattaaatggcagggctaaatctagcttcccttttcatccccaaccaatcttgtttctctccccaatatcccattgaatggcaaagggtaatgaggctgaagatgaaaagaacaacagcaaagacttactgatggctgtctaaataagataggacgattctgaaattaaacccagtaggcagaatgcttctaaaggctacccaggcccatgtgctgaaacctatttcgttaaagtactgctgtggtttctcattccacacacacagtggtacctgactgagtacttcactgagaagcttgagcagaagatgcggctctgatgtagtgctgttaagttctctcaggtaactttagggttttcgacagcttttccttttaaacttaagggaggctagatccacaaaccgagcactagcacaggctggcacgaaacacagcttaactttcatttcaggcgttgtaggggcctatctctcttgctgacagttacgggtgcagtttaagcacaatctatttaagtggtgcaccttgcatggagatagacatgtatggtgaaagaggatgggagtaacaatggagtctgtgccgcagccagtctctgcttttagataatgctctgtatctagttactataaatttgggatagccctggcgatgaggatgctgtgggacactgtttgcttctttaaatcaccataaccactcataaacccagtctcgaggagttatgcgagtgtttttctctgtcctttctcttaacctgttccccttaaatatcgttacaagaaaacgtccactggagcatacttcatagcactgtgacagtagcagaagggagaaagtgactgttctagaggaacttcccccagctcttagttcctttgagtatttagaaagtggagtccaaagatttgttagcatttgagatgttaatggcaggttaaaacaatctaggctgctggaagacaagagttttctatttaagttaacaagataattaagttctcaaataactaaaagtggctagaagtcaaatcagtataagatgatggcaagctggtagggcttctgaattcagttgagaacacaatcctcgttttttaacttggttttgaacacttcattgtcagcagtatttaaatattaaattttaaaaatagattcctaaaggagagtcataacgggcatcttcttaaaccagctactctttaaaatcaaaatgctgtcactgccaataaataagtgcagtgtctttttcttatgggtgagtcagttatttagtctgatttcaatcttctaagtaaccttgcgaaatattaaccacgctacacaggccccacccctgactgcaggcaagcagaaattcccttcagattgtgtgaatggagatagttccaatctacgttacatgatctatacacaatagtatgttttctgacatttattcctttgattcagaaattcttcctcaaaaccatgtattttgaattctagtttcaaatatgtctttgaaaatatccatggcaggtttgtgcataatttgcattttgcttatttaccttggttgaggtttttccttagtttattttttaatttttaggaaaaaattctcaggttttttcaatcctaaaaaaccaaatttaaggaaggatagtttctttgtagaaaggtgattaatgaaaaatccctgttcttgctattctgtcattgagctctttcaaacaagcgtcggaagaccaacagacttaaagataacttgttttcttacagtacttaagatcactcttgtttacttgcgggatgtggcttagagaatcccagttcatatttagataatatgaggaaaccaacgtgaatccagtgggcacaagtacaataaatgaaaacttaatttgctttttaactaaacttacaaatacatgtgttcctatgcaagatttatctaattcataaattgcaagaaaacaggctagcttccttgtacacttaaatctctgaggctcctcactcaacttttgttttagtggaccctgcaaatgaggtaactagaccattgatgaatccagaagagggaagcaattgcctaaaatgacatcactactgttagcacgctaaaagccatggccacctacggattttcccaaggaggactgaggtggtgagggctacttgcattaccaattgtattctatattttccaccttcaaatagtaaactaaattagtcacacaggctttcctgaaaaagcgtctgattgctaatgtgcctcccaaataagtaaaaacccttttaagaaaaatagacaaggttgtggattggcttttgaagtatggcttcatccttttttgctttcctcatggattacaagttcaatgtgaggggcagaaagcctaccattttattttttcaagatgtgtaaaggagaaccacatgcaagccttttgtgggggaacaaactataattctgtcaaactgatgaaacaagttatcaagtaatatcttagcttccttcaggaaagaatatgttggggctacattctgataggatatattcaaccataagccttaaaagcatgaatcctaaagggatatagaaaaaagcctcataggaatgccaatgacggactctcgaatcttcaggagttctgggagcatcaagaatatggagtccaaattctaccgctaagctgacagatgacaaagagtgtattacctcaatggctaaatatttaagcttcatggagtttggaagatagttgactgtaaatgagccaagaatacaaaaaaaaaactgcctgtgaaattatactgcagacataaaatctcaactgcctaagagctctggttcttctaaaagccgtggctgacagagcaaattaagcagtgagatgtttactatgtttaacagagataaactggcaaatgtagaagatgtaattacccagcatgtttttctaaaaatgaattttaactctgttctatgagggggcaaaaactgcagggcactgattttttttctgaaagtctcatgtgcttgggtaggatttttaaattattcagtaacttgataataaatggtcaaatattgaaaaaccaagagactttcactgaggaagcagaccaaaacgggggagcactttagcattttcagcatctctgaaaagatttctggttgaagaatattgtttgatctagcaagatatccagaggatttagcctacccagggacaacgcagtgcttcacatagagaaaattagccagttaaagctgacttgggactctatagtgaatgtcatacagatgacctcccaccacaaaaactaacctgtaccttactgtaaatcatatcatttatatttgtcttgcatgcaataggagataattactgactaaaatattcaaagatgtttacatggtgaaaccatcagcttgatttattaacctggatgcttttcttattaaatagcaacaataaatggagagttccaagccagcttcttggaagaagatactattactaaaaaacttgtttttctatgtagatattctaataagctaaaaacttctctaagccagcactggaataaatacaaagattattcacacatctaaaaatattacagtaacctgaaagataagtgaagacttctccccctaaggaatttcttgggcctgtcctaggagggctatctcctttgcaatatgttacgacaggaaatcgtccatttttgcttgtgtgtgtgtgtgacagttgtagaaaatatatactagcctaatagcggtagtgtttaaatgtctgaatcccctgttagactataaactcattcaggtctgggagtcctccttagaatagtgtctgacacattggaaatgttcaataaataattgttaaacgaatgaatgaaacaaaaggcaaatgtctagatacctatgttgtgattagaaaaagatttaaacaaatgccaaaggtactttttttcctaccaagaggtcatcatttgcatacataacattcatacacagttccaagtcagctttaaatggctggttcctctgtgtgagccactgctatggtccctggtggtagactcccacaagctgcctcctatatgcagattaagacctcagctgcttgatagttcacacagtcacctcacccaggcctcgcaggagaaaccttgggactgtgcaggagacctagggctgtgcaggaggagtttcacaaatgttttggcagcagggaaccagcagcagcagagatgaaatgactcgccactcttcggggcacaggatctagctatgtcaagcattcattttcactttattttgataaaatgtttttatggaccatgacaatgaacatggagcttggtaacaagagaaacgtaagttctgaaactcagctactcaactgatctggcctcagtttcctcctacataagatgagaataagaaggaaattgactatctaggattcgttgccaagtccaagtgagattgtggatgtgtaaacacttgtcaagccataaaacactctataatgtataaagttataaaggcatctttgtggtagaatgactgcaaatatggtaccaattatccttctaccactttttgcactgtgcctttgaagttcctactatcaacaggtgaagtctattcctcatctctgtaatctagcctggtcttggaatttgctttggttcatagaaaacagcagaagtaatcgtgtgctaaattctgacccaaggcctcaaggtaacttcctttgcaaatacatttgctctcggaacactaccactggcagaacaagcctggattagcctgattgggaagtagagatcatgcggaggagagtttagttgtcccagatgaggccatccttgtccacccttcagcagcaaacacagccaagatccagcagagctccctacctgacccatagctgatggcttgtctctcttacacttgccaagaccagtagatccatccagattcattaggaaagataggcttgattgtgtttaaaccactggagtttgggggtagtttatgtagcaataactcagcactagcctccaaccagagtccatgggggggacatgtcaaaggagaggggtaataagtagaaaatgtgtgggtcttgagaatcaatgacagctgtttcagcattacccctcagcttcctccatttccagggtgttggtggtagtcacaacttctggctcacctcgagactaaggctgagaacttctgatctcagtagaaagactgctcttaattcagagtgccatgtgaaccgctatacctctgctcccaaaatgtgattgaaaaaataagaaatggcctcctggaccttcatcaaatatctaagtatgctgtctcaatcaagagtcaaatactcagatctccttttaaatatagcctctgaaatcaacctacccagcctgacatttaaaaatcagctgataaaggcaggaagggattagttagcaaaagtgggaaagtgaatagatcagaggctagatcatcagaagcctataaaaagcataaatgcttaggacaattcgcatggaaagtgaaaagaattaaagacatgaaagggaaaccagttagtctctttatgagcaggtatatccttgctcacagaactctggctgtgtacagccttaaagctaatgtaatgctattagtaaatattgaggatgattacaggcccatggattagtggatttctgctttaagtttgctgtttattttctagggcacataacccccccacagagaatgagtaaacacagaaggacctagaattccaatcatccaaatagttcttgggattagtagatcagattcacaaaatcacaagaatttgaaggagttctacaactcctacaaatgtagtcccctcccctgtttaaacagttctagtccgtatcttctggatcccaagacttccctcttctcttaccagaatacactaatagcaaagctgctcagattatcagcagttcagcaaaatcaaaaggaatatctgagcttaagatgggtcagttacccagtaccaataaatgcagataacacttattgagcatgttaccatgtgctgagtaccatggtgtttattcattaatccaaatttgttttctcaattccatgagttaagtattaaactaattttatagacgaaacttctcaagatgcagcagcttgccccaaaagcttcatagctttcatagtttcctgcacagccaagagcaaaaccaaatctggatgataccaaactactctctccaaccatcaaacatcatgccttggctttactcaacattctttgcctttgtagtacattcctatctgccaagtactatccacatacagttgcatgcaccaagtatgtattcttagtgaacacctttgacagcttggtggagcactccactctctgaaagagcccctccttagctgatgagttttctctgggctattctttgcagcctccctccagctcttccttccgtcagatctccatttcctacactttgctccgtattgccttttatctttcccgtcttcccctcttctcaggaagaaccacaatgattgtgcttgagaactttagaatcagactggctctgagtaactgacaaaaaaacatgagatggtaactacctcatagagggtggttgagaggactctaaatgagatcatatatgtaatgggcttagcacagtataagataacatggtaaatgcttaaatataaatgtggaccttctacgaatatatcaacttggtggaagaagagagtaaaaactattcctggattcttatcactgagataaaggttttcatggtgactccattcaagaggactccattgtatttccataaagcaagtatttatttattgcctcataatgaagtactttcataaacagaatcctatgccatccttgccattaggcagcactttgtaaaagctggtacaagtgtcgcccttttgatagtcttccctgagcttccagtggaatatataggggatttgagtcaacatttgatctccttctaaagtcccttcctatattgcagaggcttacacatttccaaaactctcttgcagttagtctgatgtaatttaaagtgagccagccagacatacctgcacataatttcaaacttgagttaggtgggagaagagtcataatgattaaaaatccgttttttttccagtgcagatcacgatggagctggttggatttagtgctggcatctcgtaaggcaaatccacaattcgacaggcctctgcagattggagcagaagcagcagctccctgggcagcccagttctagggtaggacttagacatctgtctctttagctctcacaatgattatgtaaatctttaattatctataaatctttttcttccaaaattagccagagtatattctactccctgcacttgatttctaaacaatagctaagaggagctcttgcccttctttctgtacctccagtacttgttcctgctcataattcttgttacactggacattttattacagtaactcttagaaacatttatcttttcctcaagttgaaagcttgatggaaggtgctatgtcattttcacctttgatatttcccatagtgcttggcacaaagcatttgctgaattgaactgagacacgttcccacagtaacactgtggtaagctaaagcctaattttgaattgtcactaggttttattccacattttgtacattgctgaactatgcctaaacctgttttttaaaagtgaccatctttatttgtggtagattaggttcttcagaaatacgcatatgtatcctcactacttcacttccttagaagtaacatttccctgctcgactgccactgggtttgtgcatatggctggatttggctaactgtagcatagtctccaatatcttttaaggttgggcttagttatgagattcactatggccaagctaatgtcggcagatataacagactcacaaaatgctcttatgcaggtggacttgtgctctatgcctctgtcactcataagaacatgcctcagtaagttgaagaaagattcacggagccacagccactgccagccaagtccagcctaaattagctacctaatatctcctttttacctgcagattcatgagtgataaatgcttattgtctcatatcactaaagttttgtgattgtttcacagtattgtcaataagtcatgtttctagagaaataattctttcaaagaaaacttggatgtaccagaaagagaaggcataccctggtatgaagtttaatgcttccctgtaggacacttccttcctgcacaatcatcttcctcgaggttcatctccttcgtttccatagcaatacatattactcataccccagttacttactggcttgaccttacatctctttgtgccttatcaatagatgttcctcaatttttgcttctcttcattaagctttagtctcttttaaatatcattttcagggacttgtatcactctgtgaaactcctaaattctgtccaaccctgaacttgtcatagccaccaacttctagctaccaacagactgtgtctagctggcattcctcctaacatcttacataaaactctccaaaccacatccagcaatatttccttctgtttcctctttctcttaccatcttccaggccatctatacacaaaatctgttatcttcctctcaccataccagactccaaatttaataattactacgtatcttaagtgctctgacaaacattccaaaggatttaggctagtgaagcttctaatttgaaggaatactatttgaaatcattcttgtaaagcaatgagtggttttggttatgtgacttggccctgaattgattctctaatcttgggacttctccacatgtttttcttcaggtgggggcagggtgatgatgggcagcctgtggagcctcaaatatactgataaagatgtcaagcagtcatttggtagaaaggaaaggacatagggaaactggccattcctgcttcaactagaaaattaaaggctgatgtcctgtgctgttctaaaaaatcaatggctaataaatatttacctagactggcaaaacaaggattaaaatttaccatgcagaacacaacccacaaaacattttgcaactagtattgtatattttgaatggaaaaaagctatcgggtttcatataggcatttaatgaaggatctctgaagagaccctggacgtaaatctttatattgtatgctttatttactttaataaaattccagctttcctctaaatcaggctatatttctatcacattatatattgagagatgttctatcgtggatagcaatgagaattctgagtctccagggaagaagacagctagagcctctcagagctcctcaacaagctaagctaaaattgactcaatattggtgaattctagacacaaacaactaagttaaccaaatatatgtgggacttattgacaaaacaagtagccaagtcttcttccaggcacccagtgtcggtggcgcacacacattttcgcagtcaattaactacagaacctgggggatagatatgtttatttttactgcatggtatattttagctcctatactagccaaatttttagtgcaaagaattattgagtaagcttccttccctgaatctgaagctgatctttgttctgtgtccaggaagtctgagtctaaaccaaactttatccaattgaaactatcaatcctcatcagtctgtagtaactttttaaaaaaggaatgagatttttttagacatatccatttgtgtgtgagggaagtagacaaagtaacatcattagaccagtaagtaaaaaatctggaacactttttctaccttatcactagagcatcccctccacctagtagctctaccaattagattcaaacctatggtcaatattttgaatggcaatcttgaaacagcacaacacaaatgctgcatttcacaggatatataatatgaagtttatatgcatgtgtatatgtattatatgtatataatatctggggccgtgggagtgagaatctaatagagtatctgaaaccaaggcacaaaagagccgagacagtgagtacaggtcttgcaatgtgacgtgggtaggtgagaggtctggatgcaggagacagtctacatcaccaaatatcttgactgccctgcttaggaacccatgttttatagagaaggcagcaggaaagtctttacatagtggaatttgaaggagtcaatggctgtttatgcaaggcctctaacagtgaagagaagaggggcttggggtagtgacgatgctaggagtaagtgaattatgttgagaaggttcatggcagtaatctaggtgagaaaagagaagtgaggacatatgctttaaaaggcttccttttctacctggtagttcaatatataagggtccttcgaagactgaagttttcatgcgatttttgaattgtcaagcatgaaaaaatacacaaagcatatctgaactcatgtacttcaacaaacaacttcaaagtcagattagaaacttaacatttttataataaacttttaacttttgtgggcaccatagtaggtgtatataattctgggggtacataagatgttttgatacaggcatgcactgaaataagcacatcatgaaaaatgaggtatacattccctcaagcatttatctattgagttgcaaatgtcccaaccacactttttaagttatttaaaaatgtagttattgaatagtcactctattgtgcagtcataataggtctccttcattctttttattttggatccattaaccatgcccacctcccagacccccactatccttcccactctctggtaactatctttctagtctcaattgtttttgatttttagatcccacagataactgaaaacatgtgatgttagtctttcttttccttgctttatttcacttaacattacaatctccagttcatccatgtttcaaatgactggatctcattcttttatggttgactagtattccattgtgtatatgtaccatactttatctgtagatggacacttaggttgctcccaaatcttagctattgtaaacagtgtgctacaacaaacatgggagtgcagttatctcttccatatactgatatcattttaggttgacaattaaaaatctagcaccataaataggtaaagtcatgtgtcaagtagaactctgtatgtgtatttatacatatacatactcctcagcttacaatggggttacatacccatgatcccatcataaattgaaagtattggccaggaacagtggctcacgcctgtaatcccagcactttgggagtccgaggctggtggatcacaaggtcaggagattgagaccatcctggctaacacggtgaaaccccctgtcgctactaaaaataacacaaaaaattaaccaagtatagtggccggcgcctgtagtcccagctacttgggaggatgaggcaggagaatggctgaacccgggaggtggaacttgcagtgaaccgagatcatgccacctcactccagcctgggcgacagagcaagactccgtctcggcggcggggggtgggggtgggggggaatattgtaagtcaaaactattacacctaacctaccaaatatcaccacttagccaaatctaccttaaatatgctcagacttagatgattttgcccaactatagtctaagaggaagcctattttataatagtgttgcgtatctcagaatttattgaataccatacgttacatcaaaattgcaacagtttctcacattgtaaagttgaaaaatccttaggtctaagcattgtaagtcttaaagaccatatctttatctatctctccatctatagagatatagataacataatccttagtcagcttttgaccagaaaattctaaatgtgaagatatcagaaaatatcaccttaaaatgatataatttggttatccatatttgaaaaatgattttataaattctcttgataataaaaaggaaaaaatcttcccattgacttttttcttaacaaagaataaaatacataaaatatttctactaaacaaacctcaaatctctaaatgaggatacaggatttaaaatactccgtaatttggtcagaatagcatagaaagttttaacattcataaaaatgcaaatgtacattatatatacttatgtttattaaatatattaacgctttactgaagtgattttatacttaaagtttttcaaaacttagttcttaagtaactgaggacatgaagaaaaattctcttaagagatttttagatccgagtcattttccctactcaaatttgtaagaagatacacagtagaaactaatttctaagacatgatctgatagattctggtgtgtagactctaagagaaaccatgcaaaatttgttagattacacttaaaacataattctcttgagttatgtaactcataagaaaagcgaaactacaagactccagtgcattataaactgaatcaaactgagctttttttcctgtaaaaatggaagtagagccaagtgtagttacattttctttccaactctttcgtactacttggtcccttgttatttttctaagccccttgctgagcattttattagaggaaatcactcgagaagcatgtcccaagcaccaagaacagtggaacacaatagatgctcaataaatatattgtttgagtaggcaagttcccatgtgaattctctgatcatcttacacttaagaattgttaactcacatgatagacatgattagtaccaaactaaactgccacagtattctagtccacctcggtatacttcagtgtcggctcaccccaggttgtactgacaatctccattcggaattaggcaagtgatattacagttgactaaagcaagctctgctgtggcactgccaacatttgaattatccctacctacccctaaaacagtgaggcactaccatttctagaacatcctgcaaagaggggggacattttcataagaaacagcataatccaaggacagattgcaggaaaagtctgacaatgcaggtttagccatctgtagtcacaactgcaaattgactttttccttccgaactgatgatttgaccagcagaaccaaaactaaatagcaacttacaacactaactgctagatttacgcaagacagaggtagttccctcaaaggcaacattagaagagccatcaaaatgttcatctcccctaacatgtcttccttaagctgtccttatcccgaattccccacatggatcaccactcataagaagtggtggctctcggctcttcctgcacatcaaaagccagataaaaatatgatcctaggtttttactgcagaccaactcacactttcaggatgagtagtcatattctgtaaaactacaggtgggataatggacaaagaacaaaccatgatgtcttcaggaagccacaataagcatataagttgcccaaatgaagttcatgccttattttgctgaatgaatcaataaattattttctatgcatctactatgtgataacattgtgaaaacatacaaggacaatcaaccccattattaaacattcagtaccagggcttgcttcatgggtgtgcaacctgtgcagctgaacaaggccctgccctcagaagggcatgcttggtttaatgctcagctgtcagcatcttaaaactctgggtaattttgaaacaaggagccccacatttttattttgcatgagtttttgtactagccaggcttggaagggttgaaactcaaatatgaccctaatgtgacacattgtccccaccttcatctcccctgcaatctactgtatcataggggaattgtaatgcatcatccctatgcttaaaattcatcagccattttctcctatgcattgcataatttgtctgtttctctcgcctctagcttgacataatctttcccaactcccctcccaaatattgctttattatcgtaactggcaagacgggaagaaaatgtgtcataagagtatatgaaaaggggtactcatgctcaggtgccaggaaataagtcttgggaaagctgagaggctgaccttctaattttaaattggagtcagacataaaaattgactgtattggttaaatgatattggttaaaagttataaatggcttacaaaagactgcatcattccccattcagaggaagaaacaagtatatatctgaggcctccaggaggaaattgaacatggggcaccaagaatgaagaggtggtagaatataggcacaaggcatcagggatgaaagcagagagaaaatactaggaggtaggaatgctaaattcactctcattaaccctgagcatcagggatgtcttgaagatgtgcaaccagcacagtcacacaagctcctgagctgacaaggggccccatgcttggtaatgctctactgtggccatcttgaaatttttagtagtttctggaaaaggaaccccacatttacttcacatcaggctctgcaaattatgtagcctgtcccacttagcactatgtgaagtggtttacatgtactatcctatttagtccctgaaaatccataacatatcattactgtgattttttttctcttaatgaggaaacaggtatggagtggtaatgtactgtaccaaaaggcacaccacaaagatgaagccagaactttcatccaggtttttctgactgccaagccagtgtgtttttgatgacagtgataggctggctttccaagtaaagacaggagagagcaggtggctcagtcagctagactgcaggggacataaataggattagcagaggacaaggtaagaaggttgagtaaatcagatcactgtagtccctgaatgatcatagactttcctatgggacaaggggggaaacatgagtgacatattgagagttggactttaggaagtctattattgtgatagtgttaaggtattttgttaagcaaacaaaaaggcatggagaagatatctggggctcatatagtccttcaaatatgaggtaacaggatgaataataatgaaagctaatgtttatcaagcatttactctgtgccaggcactattctaagcactttggtataatgcttaaatactgtaatccccatcaaagttctgtgaggtgcaggtagtttttaaatatcctcctgttattgatggaaaaaatgaaaaggaaagcaagtttcagtaacttgttcatggtcatgcagccagtgagtggcagaggcattatttacttcagaatcagtgatttaatcttcaataagaatatttaaaagatgccctttttaacttaaagagttctaaaacatataaaaatgaaaaatattaaagaatgctattttacaaaagatccaggaggatagagtattagcagatttgagaacctatcgtaaaggaaagccatttaaatcctttggttcttggcacaaaaacagaaacgcagatcaatagaacagattggaaaactgaaatagtttttaaaattgtaacataagaccccataataaagtgttaggaggaattaattagaaaaacttgataatactttgaggaaatgatcaggttagattcatactttgcatgatacactaaaataacttctacatggattaaggatttaaatacaaaaaattgaatgacagtaaagccagcaggagatggaatagaatatcaggtttataagaaaacagtaacttcagctttgaagcagtggaataaattatgaaggaaaagattgacagatttgaatacataaaaaatttaaaacttgctgttttttcatcgtacagaagactaaatacaaaggatattattactgaaggccatatttgcattccatgctacaaagacagctttaaaacccaaaccatgttacccttattcaaatttataaggaaaaacatcagatctcaaaatataaatacttaaaatatgaaaaaaatgaatacactgacaatcagtaaagagaaattgttcagcctaccaacaattaataaatatgtgcaaaataaacttgagataggattttttaccttctaaataactccccataccccccccccccttatccttataacacccaatgttagttagattgaagcttgtgtactcattccttactgctggcattgcaaatgtatacagacttcttaaaaattagtaatacaaagctaatcaggctcaaagctgcatgagttttttcaggcagcaattacattttgagcactttatcgtctggaaataatagcaaaagcagatgtgagcaaaagatgttcatctgttattgtttacaatagcaaaaccctggaaacctaaatgccccaaattgagaatggttttataaattatgagaagggactacttgttatagagggcaagccatttgaagatttttattttcaggagtttggtccaaagggatgaggaaagagacagtgaagtagcttgaggggaaaacattaaggaaaaattgtcatttatttcattgaagccttggacatatttatcaattgagggggaacaagatattagaggaaataagaatgaaattttgagaaggagaagagggggagagagaaggggtggggagggggaggagaggcggagaaggaagagtggcgagactggaggtgcaaagacctctgaggcacaaagaagcctcaaaggcaaatgtggaaaagtttgctttggagaagggatgtgacttcctctgagataaagatgaagaaagaaacatttgaagtgaagagaaggaacaatttgatctctgagaatttgacttaggtgagtctttcttggtctggcagaaccggataccctgacacctgtgatgctgtaactctataacattttcacagcatttgttcactccgcatttagtgtgtcattttccagctgtgaacgaaaacatgagcaaaagtgccaccagggggcaggctgggcactggcaaaagcacttcaaagagaccatggaaaaagtcttttcctttcagcccaggggtctattctttgtttttgcaacaacaaactgcatcaagtccagagcattttccttaatggttgtgttgtgggtatggattttgctccatgaactcaagtgtgcaagaaatgtcacagtactgtactttattttctctaaataaaattaaattcaactgcaagccaccatcctaggcaaggctgaaagtcactcagtcattattacagctcccacagccccaaagcattctgtagagatgaggatcttattcagtgctcgtatttaggtcatcggtccatccagcgactagtgaaatacttatgacctgaaccaacatgatgtcttggtacatggtgacagtgctgtatccttatctgttaggataggggcagaagttccaatgtctggaacgtatgcacacacgcacacacacacacccagatacctccttaggttacgcaaagagggaagctgaggatgattcctatctgtagaaattgtctcctgtaccctcttctggcttgagggaaattcctcctgcttcccccctgtgcctgcctctttgtctcctctatggtctaatcatgggccagcttaggctacaaagaacatctaggaagatagacatcttcagaacacacaaacttcaggagaggcattgaagcccagaggccccatctagttcttggaatccggaaaggagaaaacacaagatcaaaatgcacccacacccatatgtctaaactgtgttgccacatttgccacaaggtcaccgtccttaaaacacccactacttgacagatctgacagtatgagaccgttatcttctagtagatgagagagctcaagcatccctcagtcgatagtgggccaatcccagaactgctgccatggaggagcaaagatgaagggacaaactctcatctcaaggagcttccagtgacacacaggtaatcaaggactgacgaatttaggtaagatattacacatttctaaatcacttaccaatattgaaaacattaaaaacaaagggttcacgtaatcatctgtgtattatctagcttctcttaaaaataagacccggcaaccctggcctgcattcctgcatggcagtcatgattaggagctgagtagaggttgttccctttagctgggaccaatatacttcagtgtatcacagtccccatcactccctactatgttatgctcaggctcctctcatttatgctacttgtctagcttctatacgtacttgggtttgcaactcgactgagtaaaccaaataaaatcagagacacagtggtaagtggcctataagcattaattaagcttctgcctttcctcgatgttcactctgatatacttgggaattcagaattatttcacgtagaccttacacgaacagacgctaaagaaacagacttaaatgataaacttggctcatgtgcaaatgttacacagaaagccagtggcactccgtacagagaatagtatactcatgcctcatgtatgtgtgcagaacaatagatgttcatgaaatgcagatttagctgtgttccttggcctcatctcccatgactgtcatcgagggtgcccagtggatcagtaggtcacaagtgaacaagtgtttactgttagctgtgggtggccactcccacaaaaattcctgagaactggtctcatcctaacctcaggcccatgagctcagagaactggtctcatcctgacctcaggcccgtgagctcagcctcagcctgcagaaatgccagcttcattctttattttaattttcaagagataggctaaactcagaacttatgccacaataaattagaacaatccaacagaaacaagagaagagaggctgttaagctcaaggaaagaaaaaaaaatttataatgaggacatctgtacttatctggcttttctggagagttcaagttactatccacaaaacacatctatgaaaatgtttagaccacaaaacaatatattaatcagcaaataagcaaagtaataacaaattttatgcgttgaaagatgctattaaatacaaaggaaaactcatcatgaacttcccgttaaacatgcgcatacaacaagaattttattggaactttttgttggttggaattgtataaatccagtggagtatatttagaaagacaataattaactagaaaagagattgagcataaaagcgagaaaagcactgagtattccctgcccttcagctgaaggaacactccagcttcttcagctgattgctgaagctggccataattatcagaagtacctaagtggcttcttgacccttagttgcagaatggcataagaacaaaactgataaccattagaatgcatgacaaattgtacataatatctctacctgacagaatacttaaaacaacattttatcttaggttttaatggtttggggaaagagcatacggtatctacaaaattcaggacattcattagttaagcattcttgaaatctacaatgccagccactatccaagtaaggggagcctcttaagtcacatttagagctattttctttaaaaggcactttgatattagactctttaaacataaattttaaagtacagcttgaaagcgagtgataactactaggaaacaggatttttgaaggatatactataaattctgtagcataaggtttaaaaaagaacctcatctttgaacattttttaaagtgctgcacctttaaagacacaggtgcttttagttcacagtccaaaaatgagtgactgaatatactaatgtcaaagacaatgacaaaatcagagttctgaaaaatacacagctttcaattaatttgtgaacatgtgtgcatgtgtgtatgcatatctacaagtccctaagagatcaggagacgttatacacaggattgctgttatttctagccgctcctaagtccagatattagacatgcaaaaagacattcaggaaataaatggggcaaggaaagagatactgaagccctccctaaaatccaaagcagcagcctgtgtagatgtcttcactgtgaggtttccacggaagcacatcaccctactcagattatgcagtctcatcttcaagtgccgttaatcagaaacctgccagggagaatactaaactctttctaaagatatctggaatatcatcaagttttatcaccaaacaataaaacaaacccgtcaagtagattttaagatttatttctcctctactattaaggagaaaggagcctgttataaatgactaacattagtcacaaatctgcaggtcagcaaatggaaaaaattgaaataaccatacatgaatacgaaaagacagcttgttaattacttttaagaacgtaaattgtgttggcatagtgtacttatttatgaaatattgacaaaataagaaatattctacatcagaatactgagtaatgatggggcaaaacaaactagtggaattttcaattacattctctggggtctaacatttcccatcttatctttgcattctatcctcaactttctcatcctcaatatctgaccactataaggcagcttcagaagaagcaaagatacaaacttatttcaggaagttactttagaaagcaaagtgtatagggctgggtgcggtggctcatgtctgtaatccaagcactttggggggctgaggtgggtgaatcatgaggtcaggagtttgagaccagcctggccaacatggtgaaaccccatctctactaaaaatacaaaacattatcagggcatagtggtgagcagctgtaatcccagcaacttgggaggctgaggcaggagaatcggttgaacccaggaggtggaggttgcagtgagccaagattgtgccactgcactccagcccaggtgacagagtgagactctgtcttaacaaaacaaaagcgaagtgtaactctaccacaatgcccgaagctttcagggaaacctaggaagcctattgaagatcactaggaaccaccactagcaatgcgtctaaacttaaaaccaatgcagatactgtgtgttaggaaggaggggagagatagggaggaatgacatattggacacaatacctgggaacacatcatgagaaaatagtttgcaaactaattaattattgtataatcatgatccttagagtggtacaataagaaaagattaaaacattttaatatttaaaaccttaaaattcatccttataaaaactttgttgttaaatctacatgctatatttctaaggtaatacatgtagataatttttaaatggtaaaaacgtaccatattgggattaatgcttatttttttctggcccttgggggaatacatggttaaaacctggataactttttgtctagataaagcactcaaggaaatctggcttcattggatcaattactccactaaggtatctttttaatgttatcttattttcacaaacatacattatagaaaattttcaaattgcagagaaatataaaagaaatcgcctgcaactttatctctaaaaatattttggcacctcttatgcacccttaaaacatagtattttacatgtacttaagtatacttaagcataaaatttcgatattaatatactacagtggctgttttaaacccctttttaatatgaattattttgaaacacaatcttgtctggacactacaaatttgtttataagttatgtactaaaatttagccagctctttatagttgaatagtttcttctgaaatatttgctattttaaaataatgcctatgaatgtcttagtagcttctcctccatatttctataacttaatacatttttagaaaaggaattgctgaaagataagatatttgatatgttttataatgttgcttttcagaaaaatggtacaaaatttacccatgaatagcttacaggaatctcctgacgctcaccaacagtagacatcaacattaaaaactacagtgatttgtcaatttgattagtgaaagatatccagtacccaatttccagtgtttcctaactcctctggcccaatttactcagacatggagagctttggatgccaaagagacaagattcgattggtaagatatggtaagattttatcctgtgagacagtggttctcaaggaaatggtacaacattcctagggaatacctaggaaatttgggtaaatgtttcagattttcatgattttgagagggttgctactggcatttagtaggtggaaaccagaggtgtcagctgccctgcactgtgtagagcaatcttgagtgacattgaactgtgtcccatgttttacacaactttcaaatgtcctagtagaaatgtatgaggtaagaagcttggttataattattcaagcgcagaacctaactgtttaacataccaatgccaaatattttgtggccatttttaatagttttctactaccatgtaaagcaagggaaaaatgatttcttcagagtattcgcaaaagttcataatttttgaaaagtatatcattaataccacactgttgctgttttcatcactaacatcacctacttataatagtctgcattcatagactacattcactgtgtttctaagagtatatgcaagaatcttatcacttccttatgtattccaatactgtcatgctcaagtatttatataataaaacttttcttataaactttctctttcatattgtatataaagtcttatgttgccttttacaaaactgtatagggaggtcatgtatttcattggtttcattttaggagagtaaagggtatattattctcctaaatattatatttactataaatagtggtcattgactctgaccgggttgagaactgttgctatatgggactagggaacaggaagcaagtcagagacttccagcagaagagtgacatgaagaagcagagacggaggtaaagaggggcttgacggtaaagaaaataaactggaaaaggagatggcaggaggcagagagaccagaaaagagacaaatacaatctaggtagggaagtaatgaagacctaagatatcataatgagtgagagtcagaggaggattttacggagggcgtcttgaaaaagtgaagtcgttggaactcaggcatccagtatcacagtgtcattgcattgttaggctacagtgattgtgttctcaaatagtctcacgtacgtgcacatacttgcaagcatacatatgcgctcatacccttcaactctccagattcattaccaaataatccctctccccttctgccgccaaatggaagatttatcgcaccagcgattctgaaatgtgacagctcaacctgacgttagtctgaatcagaggggcaaagccttatttgatttgtgattctctatccaagataaaccctgaaataaatttcaagtgtgctttaagtacactacaggttataaatcatatacttgtattctcattctacagtaagcataaaacctcataaactatgtgatatataatctcccttcccccttgccaaattcatgcacacttcctgacttgcagggagagaatgataggaaattaagaaactcagaaccagtgataatttgtctgcagcatgcattttttctattcagtagcaactataacaaatgaagttgttactagatcaggcaaggggaaaccatggttgtaaatggcagaaaagcatttccaaaattaagggatggagagtccaagatggctgacagtaaaaaaaataaactggatatttactgtatgatcatccattttggcaaatattggggataagagaatgtcccaattcctgttcaattcccaattaagataaaaagtgcactacaggctgggtgcggtggctcacgcctgtaatcccaacaatttgggaggccgaggcaggtggatcacctgaggtcaaagcctggccaacatggtgaaaccccatctcgacaaaaatacaaaaattcagctaagcatgatggtgggtgcctgtgatcacagctactcgggagactagggatgtgggaatcgcttgaacccgagaggcggaggttgcagtgagcagagatcgtgccattgcaccccagcctgggcgacagcaagactccgtcttggaaaaaaaaaatgcattatattctgtatttgagattagcttatatatccatactcaatttcaatttctctaaaaacaaacatgagtctgtctagttattctaatccctgtcagtccaacagtactgagttagacacaaatatcacattcttcattgtttttcgtaaacaatttctagcttagtgagaaaaatggtgaccctatctttctcaacttgtaatttctttctctaccctactaaaaaatgtcagccacatcccatcatagtgaaaaaatgttcctctaaacttcaccactaaattctcacattgtccagttcctgtttctctttatgggttacttaacatctgaaatgtattcttaagcactttgctattttgtgtgtgacaaatacaagacaaatccccaaagtctatgctacctgcctgaaatggataagggcacagatataacaccatccatctctccacatctttgctccctgagagggtttgataagaggtgtattctgtattggtcatctattatgttacaggttaggaggtttgagccatgaataaacagaaaatgacctgaagctaaaaggacacgctgccaagtgaggcaatcagtgaccatgacttaaaggctatgttctgccctcttccttctagttagactggggcaaaaatcccaagctttctgccgtggaaggcaaggctcccatgaccctccctctgcctgttactcttctcacctcccatcactgcttctttgcacccctgtggtctttgaatcacattctcccctcttgagcctctgagttctcatgctgtgattcttcctggaatctgcttctttaaaattgtcccctgactgacatctgcttattgttaaaaactcagctctagtatcacacattggggtagataccctttctctctactttcactgcaaacagttaatctccattcaggtacttcttggttaccttgtgattgtctctttactcattgtctctaggaatattgagtttctcaagggcagagacacgtccttttgatgtttgtatttccagtgcatagtatagtggacactcagcaaatgtttgttgcttacctgagtagggagtcttttgttttttgtcttctaaggggaaaataggctatggacaatgaaaattgcttttaaaaaaaaaacgttttccccctgagggtaaggagaggggtttgcaagtcagagcttttactaaccagggtcataaagtcagctgtgctgacttgatcccactcaagaggtagggaattgcctgattttaatggtgctagcccataagaacttggactctacatgtcatggccacataatccccagtgaaactcccatgggttcactttcagtatgcattatgttcatgcatccagaaagtgggatcaagtagtgttactcacgagactccatagtgcttggaaatctggattagaggcaggattataactggcagggccatgctaggcgaggagtagatgagacacaagcagtccctggagcctggggcctctcctcacacggtatcatcagccccaacagctgtgtgtgaagacacttccaagcacattttgttcgatgatcagctgaaacccactgcttagcatctcttttcttttatgtaatccccttgggtgtaagacatagggcctttgttgaagacagtctcacgcttacaaaaagtatcagatttagacttctaacattatttccaagtaaggtggtacaacagtcagagatgcagtagcagagttgaaataaatagtcattcatcacacaactttaaccttgtgtcccatgaccagatgtcacttcctgaagtacactgtgagccagaacttctaccttacagacaacctaattgttttgggtgtgtgtcaaccatgttaatttgttaaatgtaaacaatgtctacaactgtttggcctgtcattactttttaacaaactagaagacacttctctagataattctgtgcttgctaggccctcttatttataggatcaacagataatgtacactgaatctacttcatcaaaaagaaaaataccatttacttattacttaccaaattaagttttgcccagaactcgggtccttcttccatctctctgaggctcggtggaatgtaccaaaagcaaatattggcatattcaggctgagaattagaaaaaatataaagttgttatcttaagatttatcttagaatgcaatgaaatacttttaaaactcttagctagtttcttcaagagttatcatgtgtataaaattttaacatcagaatcttatagagtaacaatcccttctgccttcttgataacatcctatttaaaaattttctactccatagcgtgcacctagcaggttctctttcatcttaaatgtgcaaagatcaggaaaaaacagtaaagtttgaagctgactcaacccagctctgatcgtcagttagtgcctgcttacatacatgctcagagatgccctggatcctctctctccaacactgatccttaagttatttgctataccatcataggcttccaataattcttcttaaggcagccaaagttggcccctacacctggcaaatgcaaaagctttgattacctgtgagatgataacagcgtgacctgcttgggcttcactaaccagcactactatgaccctagccaatactgcttttgaaaaaagaacatcaccttgactcccggctctcgaatatcagtaaaagtgcgaattagctaggggacctattcaaaatgtagattctcataggaactcaggttcctatgttcaaaatgtccaatgtctaagtccatcctagaaaaggctaaagaattggcattttatgaagcatgtcaagtgattctgaagcgggcagtttatgttctatcagaaactctcatctacactaagtaatcataacccagttatcttccctgccagtctgtttttctatcagacatgacttgcttaaacatgggactgtattgtaacaggctttagcccagcctttgtcacgcagacaaggctttgtcctcactggacaaaaacataggaaatgcgatgactactcaatgactaggagatctgggacattatgttgggggttcacaaattagacatatagaattgtattcaggaaagattgtgtcatatgcatcttcctcatttgatgcttcacactgacaatatttgaactgattttcattttctgccataaacagtttgtaataaccaatgttgcaacagttctcaataactgtcagaattatgctccagtatataaagtttcaaagcatttcatcaagaggaaagacccatcatctcatatcttaataaaaagtagtttaaaatgaaacactgtaattcaactcaattttcacaaacatctattgagactacagtcattcttacaaatctacacaatttatacctggatctctgaagtattgaaagtaatggcaaaaaccacaatgacttttgcagcaacctaatataatagatttatctaggatagactgtactgaactcccaaattctttgagcatttaatgtgaacacatttttcaaatgaagtaactatacctgactagaaagtagaagaaaaatatagtaattatctgtcactagattgtgttatgtcagttatcaatttattgcctctcagccagaaatctaccctttttgagtgtcctaaaataatgtaggtggactctgcagatatttctcccatgacatgtggtccaatcttagactttgtcagcagagggtgctggagagacactggagaaggaaggaatgctttcctggtgtggtgtgctcactttcatgggtctcctacagaatctgtggttcatttcagcagtactggtgaccagaaacataagtacacccccacccatctaccccagtagcttcccccagtacacccctttcaggtggcatcacgtggcatcacagcagacaggcagcaagtggagagcccataaatggcttttcctggcatactcccctcaggtggtttcaaaggagagagatgccagctaggcaccttgccttggatgacttctctggcactccttctaggtagcttgcagtgatttccaagttgtggcatggcccctgtagatggcttccctcagctcagcactccagactagatttctagtgagtaccaccaatgtaacatctcagtaaacttttctgctatcccatgagccaaggtcatactctctctgaagaggtctagacctcagtcctgggaagggatggactctcccttgggcgctctatctcagtgccaggtgtggtggctgctctctatatcagctactcctgttcatttttaggtttttcattctctatgaggcaatcctccattactccaatcccttgctaataattattgatattacactttcccactttaccatgcagttcttgtcttctgagtggactctaatatgtcaccaaatttgttattccctttcatttgcataggaacattacaaaacagtttacgatgttttatctattatgggttctatattttacaagttaggacttagatctgattccttttgcccaaacagaaacttactaaaaaatgcaaaaggtctatcactaagcacttttagaatggaatggcttcagtgctacaacatttgaaagcttataaagcccttctgacacttcacttcattggaagaaatttgatgtttcatttggaatatctttgctttggtcatttccaaaattaagagttgaaaaagtctttgaatttttgcaaaaatatatttgactttttcctgtctctgcctctgtagcttgtattttacataattcttaaagagacttcaaagcactaatgagtattttcagagtaaatcatttgtataccccttaattttaattgcctacatatgtgaaagtctgacttcttgggtgtcctgagaacacatttagtctatgttctaaaatccacaaaattaggaaggtatttacaggagtccaagtatctagtgaagggtacaaaaactctggagcagcaagtgcattgtcataatctttaaaaaattcatgataaaggagtaatgtgccattaaagaatgaatacattctataccggttttcaaacaaaaaacattctaaagttctttatcaatttcaggaagaattatttagcaaattttgagaccatttgggaaagaaattagtggtcactaaggtagcagctcacgttctctaaaactgagttatgtcaaaagaaattcatctcctttgctttacaatgtcattagatcagaataataggtaacaaaagctaaagctagcactattctgttttaataaatgtaaatgcagaatccagcacacagattcaaacaatcatgcaaatatagagtgaaggaaaagctggaatggtgaattttaattgacttcaagcttataggtgttaagattagactattgaaaaatttcaaaggcagcactggatagcaaaaaagcctaagttttggagttgcaaggatgtggctttgaatttcaacttcatcagatctttgggatgagtatcaaactttctgtttctgcttcctaaactataaaatgtagatgatgtctgccccacagggttggtttgatgattaaagagaaaacgtgttttcaaaatttagtaccgtgtctggcacacagcaagcactggtcagttagtgactattatttggggccataatggcaaaaagagatgtcttttaaagtggatgagtagctccattaaaatgtgcactagtgaggtacatcactatgttaatttcttggtactatatttgaagggaaacattaagaaataatgtccagcgaggggtaaccaagctgttcaaattaataagcaaagctttctatgttatagatattgactaggcatcaggacaagaaaatgacactttctgaacttggaatgaatagaggacagggtgtactgaagagaggtgaagctagaaacgaagatgggagtcatgtcatgaaggacttctcgtatgatgtacttggaagcttgggcttgattctagaggaacatggagtcactggagagtttcactataggaaatagatctcatctttgaaaagctgctctagcagcagtgtggcagttaggctggagggatctaagactggaagtgggacacaagttagcagacagtacctagatagtaccaacctgaagagtgatgagatcttgaactaaggcagtggctttgggagtggagaagactaagcattcaagatatacttagcggggaagaaaaggagatagtaaaaacatcaagatttttggttagtggatcatagttctaatgaccaaaagaagaaagtagaattttggtaaggaaaatactacacttaagtttttagaaatgttgaatttgaggtgtctgtggcatctaggtgaaaatttcaggaaatattcatatacaaaggcctggagtttaggagctaagttgaggatgaagacatacaaagaggctattgataacaaagttctgaatgtgaagacatttcagggagactgtggccaaagacaaagtgttagaagaatatttaagggagtgccctgatgaaaagtcccttacatggagactgaaaagaacaagtcacatggaaaagagaaattgggaaaggaaatcaaagaaactaagacaggggagactatcaagagatggagtgatgaatgggtaacatacaatgctacagaatttcagcaagatgaagattaaaataatgtgctttggatttagcaattaggaggtagttatatagttttattagattacaagataacaatgtaagaaaaatcacaatgtgcttgatacatattagtaggttcactattagaacatgaataattagagctatctggaagaggaatgaactagtgaattctctgcaaataggaagtattcaatcacaggttgaccacctgttaacagatacattaagacaggtttgctgcattgtgcaggaagttgactatatgtcctcgaagatcttctataactcagttgatgaaacattaataactcctcctagtgtagaccttgagaaaagaaaaagttgaataattaggactctcccaagagataaaaaataaaatatgtgaattgacagtgtaagaatgaatatacctctaggaaaacatctattagatcttagatccaacacagaaaaatagagatgattttcaggggcctatgaataattcagaattcacttaaaataatacatttcttgaagatgattgaaagttatttttattctttccaggaaaaaatactcaagtactgggtattgtcttgttatgttcacttacaatttccaatgttccactttctccttgctgttagacaacagtgacacatactctctcaaatacatgtacatatacatatatagacatacaaatgcatataagcaaaaagactatcaactttatatgtgacattcagggtctaattctgctttattctcagtgtaataaaaagaaaagcggcaaatgcagatcacatacaaaaatccttacaccaggaattctggaaaaccatttagaaaaccacctgcactgcttgtgggccagctggctcccacagatgaaaaaatccaggggcagaaggctgactaaaatcccaccttagctttcattgcaaggacatgagtgtttgcaatttcctaatgacgatggtaagtggtttttcttttctaagactttaggaagaatatataaagaactttttaatcggcccatcttttttctcatcacttccagctctgtcaaaagactgtacagtttcaaggtgtataggacttttcataagcactatagctcccaacaccagagaaaataacacaactcaaattgagaaaatagaggaaactcaaacccgagaaaatataaagtgatcaaactcaattcaaataggactgctgtttctcccatacatgcttagctatccaccactaaaaactatagacattttcttacatgtttataatgccattatgcctcacaaaattgacaattccttgacaccatctaatagccagttcatattcaaaactccccaactgttacaagaattactttttacagttggcttgttcaaactgggatttcaacaaggtccatatgccttatttggttatgcctcttcggtctctttgaacctaaagagattatcactactccctctgttttcctcacatcaccggcctgttgaaagaaaccaggttgttctgcagaacttctcgcactctaaatttgttgtctttatagtactaccagaaagttgtttaatttttaatcattttggtatgcatgcaagatcttccatatgtctagctttctagcactttggaagcttagaactttctagtctgatgcttcctttgtagatactaggggaatccatgctctagattctctggaaagtatttcccaaacttccctgaggactattgtcatatttcactttggctactaaaaacagtttccaagtttgtcttgcttatttttctcttgtcctcttcactattgctttttcaacattcctctcttctcatgacatcaagaataatcttttaacatgcaagtcagactcctgtcttcttaaaacatctccagtgactacattcgggatacaggctaaaggcctcaccttgacttacctgaccaccacctgctctggtctctgcccacctctgcaattccatcacctgctgcacactccccttcattcaatacaactttttttggctgctcaaagacagaactctcttcagctttaagccttgcagttgtttaccaattctgccagaatatctgtccctcaaacatccgcatggcttgctgtttatctttattcaggtctcagctcaaagataaccttaaaatcccctacccagattactcaaaccaaataagccgtccccatttcagcattctacacttttccccccagtacagtactatatctataacctgtctaattatttgtatactagattatctcatgaacatgttttattgttttaagactacctgatttccctgttaattaatttgcttaattagtgcctttcagtttccacttgaatgtaaacatgaaattgggggaccttttctgttttctatctcctgtgcctagaaccatgcatgacatagtaattgttcaatgcatcttattgaataaataccaaaaaagctagatttctttttctttttttttttttccccccgagacagagtttcactcttgttgcccaggctggagtgcaatggcgcgatagctcaccgcaaccaccgcctcccaggtttaagcaattctcctgcctcagcctcccgagtagctgggattacaagcatgagccaccacgctcgactaatttttgtatttttagtagagacagggtttcaccatgttaggctggtctcgaactcctcaccttgtgatgcctgccttggcctctcaaagtgctggaattacaggcgtgagccactgtgcctagccagctacatttcttatgtatagcacaggttccaagactggaatctctaggttatttttacattaggttaaaaactgctataatacatatactataacaaaatctaagaagtttgcaatttatatttcttaaaaaccagaattacacattaaatatttatattttctaaacatgttttagaaaaaaatattctctacatttgtaaccacctaatttcttacacatagcaaacaatccaacatcagcaaaatgacttattttcccattgctccaaagctaatatgctcattattttataaaaagagaaaactgtatgcagtactgtacattcacttaattgatttttcacatgcaggcaccactacatcacagatgaatatttgcagtacaatcatgcaatttatataccaagatagaggtcataatttattcaatattatccttggtaattattattgagcattttaattttcaatacttaaaggcaagtatattctgtgaatccaacaaaggaaaagtactcactaatagagtaaattaacataatagactatgaattaagctaatgacttgtttttaactctgcaacacaaaaaccaatgaaacatataacagataagaaaattaccaccttcatcactgttaactgacaaaatcacaagcacaattatgcaatcacttacttccatcagtaacttgaatccttctcttttcttgatttcatctactaggtacctaaaattaaaagtcacaataatatttataatctgcaatgtaaaagtgtcatgaacatgactgatatgacaaaactgattcagacagggcttggagataagaaagatacagataaaggtcaaggaacaggcagagctatggatagataaatactccagacctactgtaatttccttggcctgagtaaaaggatgcatctttttgatgatgatatctatctcacatgttagcatcaggctttaaccctggtgtgaaaagccagataaagcaggctggatatatatctctgaacatgtgggtcttacattcatactgtaaatgggggatttaaccataggtacttacattaaatagctggcttggaggaaagagttttttgttttgttttgttttgtttttggtgtctaatcctgcttgtaagttcacttaaaatcaagaaagatcaacataatcttttctaagtccagcacagagaggaggactgataatcagtatcatgttaaaagtaggctgattatcctcagcaaactaacacagaaacagaaaaccaaacactgcatgttcttgcttataagtgggagctgaacagtgagaacacatggacacagggaggggagcaacacacactagggcctgtcaggggaggatgaggggagagtattagggaaaagagctaatgcatgtggggcttaatacctgggtggtgggttaagtgcagccaaccgtggtacatgtttacctaggtaacctgcacatcctgcgcatgtaccccaaaacttaaaaaatacaagaaaaaaaattacctgaatatgaggggaaaaaagtgggctgtagccattgatataatatctataaagtcattttgaatgttgggggaaagagaattgtcacacctaagtaaagggcatagatgaaatatggaatatgagtgagaaaagactaaaacaacattgagaacatggtgccctatataatattgactcctctcttctaggcttggcttttgtctgtaccaaaagagaagtctgaaatggctggccttgaaaactagtgattcacgagcctttgaaatattcacaacacttgacccagtacttcaaatctaggactcaaacataaggaaataatagagacgctgacagaaatgtgtttgtcagagcatttattgtgatttttatatataatagcaaaaaatcacaccgaacatcaggaatgcctttgaaaactagattccagtaatagttatgatcctatgatcatgtcactaaatcataaatattcaactaatatttaaagacacaaccatgctcctcttgggcctcaagtctcttacctgtaaaactggactaatacaatcttcttcaatttgaaatggttttttaaaataataaacataaatgcagactataaaaactggaaagggattattacgtcattttaggaaggccattctataatgtgaatatggaatacactagtttttaagatgttcctttttgcaaatttatacagctttttatattaaaatattgatgtttgtatatttcaaagatattatctatatgcaattgtattaaaaattgtcaatattaactagtaatatgggaatccttgagcgataacgtgagcatacacatgggcacgtatgctcacaaagtaccagatgttctacatatgccattctctgaacactttttcagaagacatgtagctataaagtttttaaaccatctatcacactggctagctttcataaaaagcaattccattgctcaacagatatcagaaaagttattcaaaatcagtaataatcaaagaagtgcaaattaaaacaatataggcatccctcgggggtattgtaggtttggttccagaacactacaataaagtgaatgctgcaggaaagttcctcagtgtatataaaggttacatttacagtatactgtagtctgagtttacaatggcattatgtctaaaacacaatgcacatgccgtgactaaaaataccttattgctaaaaagcgctaaggattatctgagacttcagtgagttgtaatctttttgctgctggagggtcttgccttgatgttggttgctgactgatcaaaaggctgaaggtcggggtggctgggacaatttcttacaataaggcaacaatgaagtttgccacattgcctgactctgctttcacaaaagatttctctgtagtaggcaatgctgtttgaaagcatcttacccacaacagaacttctttcaaaattagtcaatcctttcaaaccttgctgctgctttgccaactaagtttatgtaatattctatatcctttgttatcctttcaacaatattcacaacatgctcactgagtagatttcttctcatgaaaccactttctttgctcatccataggaagaggctcctcatccattcaagttttatcatgagactgcagcaattcagtcacatctttgggcttcatttctaattctatttctcttgctgttttcaccacatcttcagtgacttccttccctgaagtcttatacccctaaaagtcaaccatgagagttggaattaacttattctaaatccccattattagtattttgagctcctatgagtcatcagtgttttcagtggtgtataaaagggtaaacccataaaattttcaattcactttgcccagatctatcagaggaatcactgatatcacggctatagccttacaaaacacatttcttaaataagacttgaaagtctaaattactccttgatccatgagctgtaaaatgaatgttgtgttagcaagcatggaaacaatattaatctccttgtacatctccatcagagctcttgagttactaggtgcgttgtcaatgagcagtaatattttgaaaagaatctttttttctgagcagtaagtctcaagtctcaacagtgggcttcaaatattcagtaaaccatgccataaagagatgtgctgtcacaggctttgttccacttagagtacaggcagagtaagtttagcgtaaatctgaagagtcttagaattttcagaatggtaaatgagcattgacttcaacctaaagtcaccagctgcattagctcctaacaatagattcagcctgtctttgaagctttgaagacgggcattgacttccctctggtcatgaaactcataggtggcagcttcttccaatataagactgatttgcctacattgaaaacctgtttaatgtagccacattcttcagtgatcttagctagatcttcagcataacttgctcagtttctccatgagcatttgctgcttcaacttgcacttttatgttatgagacagcttctgcactcgaacctcatgaaccaacctctgctagcttccaactttccttattcatcttccacacctctctcagccttcatagaactggagaaagttagggtcttgctctgaattgggctttggcttaaggcaatgtcatgcctgctttgatctatccagaactctacaaccttcatagcagcaataaagttgtttcgctttcttattattcatgtattcactaaagtagaacctctaatttccctcaagaacttttcctttgcattcataacttggctatttggcaaaagaggcctaactttgtctgtcttggcttttggcatgccatcctcactaagctttaaccatttctagattatttgaagtgacagacatgtgactcttcctttcatttgaacactcaggccattgtagagttattagttggcctaattttgatattgctgtgtctcaggaaattggaaagcctgaagaggagagagatgggaatggccagttggacagcagtcagaacacactcaatattaagttttccagcttctatgggtgcattctatggagccccagaacaatttacaacagtaacatcaaacagaactgatgactcaaacatttttattatgagaattaccaaaacataacacagacatatgaagtgagcacatgctgttgggaaaatggcacttgatagacttgctccatgcaggattaccacaagccctcaatttgtaaaaacaacaaaacccccaaaacacaatatctggaaaataaggttaagcacataaaatgaagtatttcctgtattaaccatgtttcccaatgataccagaaataaattttagagtgacaacatccagtggtggtaagaatatgatagaaagttgctataaaccttttaagtaatactcatatcttatcaagcaaaccagttttgaaatgctggtctacaaagaaaaaagttatcaatatcaaggatagatataacagcatatatgtgcacatatatttatatgtactatctaaatgtctgtactgtgggtatataggtatattccatacaaaataactagaaacaagattaatattcataagtagggaattaaaatgcggactatagcaacataatgtaatatgcagctattaaaatgaatgaattatatccacttaaagcacaggatgatcatgataaattagtaaaagataaaagtgaggttctgagaaatggggatgatttgattcaatttttacactttttttttttaaatctctatccacatgtatatacaaagtatggaaggatacgtcataaattgtttacctgagggagggggaaacaagatgcaatgagggtgtgtggttttccattccctttttatatctcctttcaaagtttcatacatgtggttacttatatagtttttgaaaaagaacttaaaaatacaaaacaaatagatgaatatacttcctacctataggagaaaagctttgtgaaccatcctttttctcccttttcaggcacaaatgtactggcaatctgttaactcaaaagcttgttatgatttcatcctgaactgagcctatgaagaaagctttctccagaaatcttgggaataactttagaagattctaattgtgcagctaaataactttgtgagtctaggcaaattcctaagccttcctgagcctgcctccacttcctcatgcacgtaaagatgtacaaaaaaattggtaaaatccttcccttacaagttatggctacacaaaacttgcatgtattaaccatagtatcattttaaaatgcttgtcaaactggctaaatgtgctcctagaggaaaggcatcctaaaacagagctgaattatttctgttaaaactctttttgctaaccatgtagatctgggctttgtgttggggtaatgttcctatcgcagtcactttcagagcctgtaaagcccagtgatatggtttggctgtgtcctcactcaaacgtcatcttgaattgtagctcccataatccccatgggtcatgggagggacctggtaggaggtaattgaatcatgtgggtgggttttctcatgctgttttcatgacagtgaataagtctctcaggatctgatggtttaataaagggcagttcccctgcagatgctcttacctgctgccatgtaagatgtgcctttgctcccctttcaccttctgccatgattgtgaggcctccccagccacatggaactgtgagcccactgaacctctttttctttataaattgcccagtctcaggtatgtctttactagcagcatgagaacggactgatacacccagtgtaacactccagctgagttgaaagtagaggtgattttgaggcaagaggagatgcagctattactataacaaaggtcttacaccagagttttcaaactgtgatccgtggtataccaccttaataggttttccacataaaaagtcccactatcaaataagtttgaacactgctaggcatatcaattagattgatttttgtctatgcttagaagtacacttggccaggcatggtggcttatgcctataatcctagcactgtgggaggctgaggtgggcagattgtttgagtccaggagttcaagaccagcctgggcaacatggtgaaaccccatctctacaaagaatacaaaaattagccgggtgtagaagtgtacatccgtggtcccagctactcaggaggctgaggtaggaaggaggatcacttgagcctgggaggtggaggttgcagtgaaccataattgtaccactgcactctagcctaggtgacagagcaagatcttctccaacagaaaactatacttgccttaattcataaggccatttgtcaagctggttggattgttcaataatatcaggaaccagttatttaatttcagctagccatgctctgtgttagggaggtttcctctcatgttcacaagacagctgctacagctccatatgtcccatccttatacagcagtgtccgaagagcagagggggctatagcaaaagcactttaagttctatttaggtaagaatattttccccagaagtcttcacagtatcttgttgactgagccacataccctcccctaaactaataattggggaagatggctgactaaaccaatgttcccagattgaacattgctacgtgaacaaaatcaaggttctacaggcaagagagaatggtccttggtgagcaaatcaacagtgtctgcatattgattaaagttaaaaaatgcttctatattacaggccctctcaaagttttaaatatcctaatgagtacttcgaatctctaggagaggaataatatagtagttagcatctcccagacacatttaaccatggaactattttttgagggatgatctattaagatctcttggaagtctactggccacagcatactttcacaaatgctggtttataagtgtttctactaaaaagtaccctatcctcttcttaaataaatgcttaaatgaaatgtgttgttggaaggaaagccaaaatgttttaagtcacctctgcttatgtttctagggatgacttattcctcgtaacttttttttcaatatatgaaaacagcctaaagacaaaatacatttaataaactaatcttatacatggtgcaagccggaaaaaaagtacgttcagtttggggacataatgcagaaaccataaactactatcaaaaggcattcaagtaagtggactcgaaaagcagtaataacttcatgaaactctttgtcctttccactaaccttggcataaaagagagaaaaaaatacatattgagttttcaccaatcctactgtggggtaagaacatattagtattctggcttgatcttggcatatgcattaatgataaacttgctgcaaaacaatttttcttccttacaaagaatctcagttctgattgggttatataaatctccccctttgtttttatttttcttgtccttttgcaagacattctttcctctctgcaaatagcctctccagtccctttcttacttcagcagccgcttagcgcctccctgaaccattttggaccaagtttctctcctagtctcatcttctcatttgaaatctcttctgatgcattgagcctcccagaactcctgagatttttccatctgctttccgtatgctctgcatagatcagcacatgtcacatgacttgtggaattcatcacagacacccacgtgctctattctactgtaattgtaacttttaaaaagatcaccaatataaagataaaatgaaaacaaagactgttccctagtcttccagactctgtacctcccatcacctagagaaatacactggcacaaaagcaccattgtgtaactgctcaccttttccatactgataacaatacacccctcggtatccatgcaagtctatgaaatgatttccatttgagagattgcagagattgtgtgtcaagggaatagatagataaatgatactctggagaccaaacaaagtagcagagtgggagttcctgagctgtttgttgttgaaaagacttagacatgactcttctagcctgcttgaaaaatcccttagtggatatccatttaacctgaatgccataacaaaggcctagaaggtgccctcagcaacaggtaaccttgtatagtaaaacattttttactttcctaggcagatatcagaaatgtacagtcactggctttgtgccatagtggtagttttaaacctgagccccctgggtttcaattatgcccagtaatcacatgttgctttaggctctcagtgtcactgattttcgaaccaaagaaaaacaaaagcattttagtaattaatattttctgggagaaatgttctctcttcaattgggttgacagggtcaaatggaaattaggaaaagccttagaggtctcctaggcactaaatttttccttgctaaatttctgacaacccataaaattggaatcattgtcctcctgaaagtgtctgctcttactttcccaggggaatatgaagagggctatctgatcggtgcagtgatcattggtctatcaaaatctcatccttaaatcttagtcaatataaaaacttcaaagttaagctccatttagattcaggaacatggaaacattatttctatggaatcagtgtaattcttcctgtatcattatcaaaggaaaagagttgcacagcttttccagtattttagagacctgaccctagggcctagggaagtggatattttagctataagagcctgccaataacgtgctcctcaaatactaaaacaatcatcacgtgcagctttactttgctggagttatctactgaaagaagttacgcttcttggaaacaaaacaatgtttctgtaacttagaattattccaggtggagccttccaaccatgggtgaaatgcttttgatttggtaaactctgaagcaagttgctgggcatcagtgggcttcatgggaaatatcttgaccctgtcggtggtttgaacagattatgctacttcacattatgcacatggttagaagactgaaagagttacgattatagctggaagagttaagattatgactcacagaaccagtggtgttctagagctactttgtagtggttgagagtccactgttaaatattcaggaatttcctcaactacaaccattggtagcttgcaatttgctatgacagaaatatttacaccatgaaaattggcagacactacaaactggggctttctttaacttctgaaagaaaatttactgccataccactgcatataggcttaagcaaacagaatagaccccagaattgagaaaaatattctatctttcctaaaaagcagaactacaaatgaatcagtaatttgaaaagaaagaaatcatgaaaataaagcccttctgttgctaatttactataaatcttaattctagagaaactctttccaagttttataatttcacattcataccaaattacatgcctcaaagtactctgcccttttccttggcattggaggtagacttttgcccaccccaggaatagactgttggatatcaagagtgtggaaagttaaggcaaaaaaactattatgagtaacagcaggaaagaggagggattatttttcaaatacttaaacataggtcacagtctgcagcaatgctcactaaaatgttaattcaattcaacttgacaaacatttacaaacaataagtgtttgttgaattgaattgaaatgttaacatttatcctcctgtgatatttctctgcagaaattagaaagtattcttagactgtaaactaaattccaccctgagatgaatgttaactttataataaatacaatcataaaatatctataaccttatttcaagacacctcccattgaattatttcaaagcttagacaaaataatgcagagattctaccccatttaaatagtgcaagaaaatccacaaaaagggaacagagcttcctggacttctaatttagtgagcagctataaataatttatggtagaccgtagactgtcttgttttttcaccactgggttatctccccacttctaatagaagcacttcaaccctatctctaacaaaggtaccttcatctaggatcagtacacattctataagaagaattgacacactccccagtgccgagagagagcaggtgaatcatcgttactactgagagcatcacattgccctggaaaccatgactgattcagagatggatatttacttcactctcaaataattaaactttcctcgggattgttgagagaggagtactttatctttttgatcttaaacttgaacccgaaagaatatagatctgacactctttgcatccatcttcctccataggaataaacccaacctgaaggaaagcagaactgaaagatgcagagagactgaggactgctgatactgttgaagcacctagaccaagccttctgaaagtcatcactacactagtcttaaaagccttaaattacctttgtttataataccttgagttaatgtttccatcgcttactaccgagagtcctcatatagtattcacaggtttttcaaactacttcatacccataatcaccagaattactgacttctaaaagtcttctgaaaatgccaaagccatgtgtttacctgtccttatatccaagccctttgctatgtaactttgcaattcttcctgctaaaaggcagagggcacttcccacctcctcacattgggtttagccatatgattttctttgaccaaaggagtattataacgcaatcagctacagatataatacaatcaggagtttaaagtgggcttacataattggtttgccttcttggccttctgtcatggccatctcaagaatgcgctggctagtatgctgatcaaggaatatgaaagacgtggcgagtagactcaaacaccccagctgctgtgatatgatataaagtataaagtcatgctagccaacatttagacctctagggggaaaacaattgttgttttaacacattcagacagcttgttgctcagaatacccacactactcccagtatagaaagaagaaattgctataaatctctaagaaggtcctacatgattttccaagcagttaagtaaataataactaaaacttaaatagcatgtaggacatcccaggcattgatctaagtgttctacatgtatcaattcctttaatctttacagtaactgtttgagatacgtgttattatcactttcctgggacaaaactgaggtgcagagagactaagaaacttgccccagtcacacaggatttaggtcttgaatccaggttgtctgtacctctatgctattaggctagatttgttttttgcgttttgttttgttttgtttttgttttttttttgttttttaaactgtaagaaatgatagggactgtgtttttccagagtcaggcatcatcatgttcagctagttgttaccatgtgggattgagagcattctaagctttgagaaaagcaaaaaatccaggttttttataaatttatttttttaaaagcatttcaaatattgaaatgtttgaatgtttaacaccatgaaagttaaccttgaacagtataagctcaacaaaacacatttaaaactaaatttggctatggcctgtccaccactgatctaagtttagcagttcagtcctattcaagtagcaatgtctggcacctatatcttgagcttttctaatgttcttgaaagtgtgacaacaattttatttctaatgtttactacaaggcaagtaaacatggtgcttccacactgcctttcccttcgagacttaagctgccgccacaactcacagatcatttgcttttcaggtccttaatgtcacatccagacttttgtgtcacctcacatccagagacttgggcctgctgctccttccacttgggtcattcttctccccttctgttttagtctgttttcacgctgctgataaagacatacccgagactgggaagaaaaaggtttaattgaacttatagttccacagttccctgaggctggaggaggcctcagaatcatggtgggaggcaaaaggcacttcttacgtggaagtggcaagagaaaaagaaacgcaaaagcagaaacccctgataaaaccatcagagcttgtgagacttatgcactaccatgacagcagtatgggggaaaccacccccatgattcatattatctcccactgcgtcccgcccacaacatctgggaattatgggagtagaattcaagatgagatttgggtgaggacacagagccaaactatgtcattctgccccttgcccctccaaatctcacgtgctcacatttcaaaaccaatcacaccttcccaacagtcccctaaagtcttaactcattctagcattaacccaaaagtccacagtccaaggtttcatctgagacaaggcaagtctcttctgcctacgaacctgtaaggtcaaaagcaggctagtaacttcctagatacaatggggatacagatattgggtaaatacagccattccaaatgggagaaattggtcaaaacaaaggggttacaggacccatgcaagtctgaattccagcagggcagtcaaattctaaagttccaaaatgatctcctttgactccatgtctcatatctgggtcacgctgatgcaagaggtgggttcccatagcctttggcagctccacccctgtggctttgcagggtatagcccccatcatggctgctttcacatgctggcacacagtgtaagctgtcagtggacctaccattctggggtctggaagatggtggcctttgtctcatagctccactaggcagtgccccagtagggactctgtgtgggggctctgaccccacatttcccttccacactgccctagcagagggtctccatgagggccccctcccctgcagcaaacttttatctgggcatccaggggtttccatacctcttctgaaatttaggtggaggttcccaaacctcaattcttgacttgtgtgcccacatgctcaacaccacatggaagctgctaaggtttggggcttgcaccctctgaaaccatgggctgagctgcaccttggccccttttagcaatggctggagcagctgggatgcagggcaccaagtctgtaggctgcacacagcttggggaccctgtgtgtccccaggcccatgaaatcatttattcctcctaggcttctgggtctgatgggagggactgccatgaagacctatgacatgccctggagacattttccctattgtcttgaggattatcattcagctccttgttacttaggcaaatttctgcagctagcttgaatttctcctcaaaaaatgggttttttctactgcatcgtcaggctgaaaattttctgaactttgatgctgtttcccttttaaaagggaatgcttttaatggcatccaagtcacctcttgaatgctttgctgcttaaaaatttcttccatcagataccataaatcatctctctcaagttcaaagttccacaaatctctaggacaggggcaaaatgccgccagtctgtttgctaaaacgtaacaagagtcaactttgctccagttcccaacaagttcctcatctccatctgagactacctcagcctggaccttattgttcgtatcactatcagcatttttgtcaaagccattcaacaagtctctaggaagttctgaattttcctgtcttcttctgagcccttcaaactatttcaacctctgcctgttacccagttccaaagtcgcttccacatttttgggtatcttttcagcagcaccccattctactggtactaatttaccatattagtctgttttcatgctgctgataaatacatacccaagactgggaagaaaaaggtttaattggacttacagttccacatggctggggaggcctcaattcatggcggaagccgaaaggcacttcttgcatggcagcagcaagagaaaacgaggaagaatgcaaaagtagaaacccctgataaaaccatcagatcttgtgagacttattcactatcagtgcagtatggggaaaatagcccccataattcaaattatttcccaccaggtccctcccacaacacctgggaattacgggaatacaattcaagatgagatctgggtggggacacagagtcaaacaataccaccttctcttcattagatctcagttgaaagtcacttcctccaaggagcctctgccagtgtgcctcaagaacacactagagaagccctcctgattgatcttggactctatacctcaccttgccaaaaatgagggtcatttgtgcatctcagtaggctaggatcttggagggaggtgataggactgctctgttcataattcctaacacttagtaggtactgagaaaatgtgtattggatgaaataatgcacaaatgaaaacatgtacttgcaacacatttcaagtattactttccttaggtcttcctattacagacacagatagacacacacacacacacacacacacacacacacacacacacacacagaaagagagagagagagagagagagagaggctagtacctagataaagcaagagcacgattaactctttcttcaaggcctaatgtacccagggccttccaggtcatccagaacttgaatgcatctggtcttctgctacactggatagacttgtctcctgtgtcatagctcacatcatagaatttatcctgctggaagaggtaagatgccttggcagagtagcattttttaagaagatccttcgaaaaagaaaagattacaagactgttaaactttagaatataacttgattttgaaagcaaacacatgtacacacacaatgtgtatattctacctgtgccaagtgtacatctcactttgactgccttacatcagacacaatcagtgtacattgactttcagatacacattacccatggtgttaccaaacaaaacttcagagttgacaatgctaaaatccatcttcacaattttactgagtattgagaagctgagaagaccatgtcattatcattatgacatcaaggtggcccagtttttcagtgtgaataaaactgtctataactcaaagtgctctccattggccagaaaaaaaaaactgacatatttacatatgttatacaatttcataagcaaaaaaactaggttttaagaccttctctccttcatattcatttgaaaaggctagacccaacataactcagggataaaaacccagtgaaagagctatggaagaggtaaacaagagccaacaagttttcactaccacagaacatcagctataatcccacagggccttttgtgtttgtctcatgctggttttatttgcaaccaaattccatttgcatttactgacttgttatcattaagaaatgggtgataatttactattcatcacgattatagggcctttgcctcgacctcaaatcattaaagttgaagccatgttgtcttcaatgtcatctagtgtctacaaaagccaagatttcctaatcaatcatttacagccctgacaactcccccaaaatattttagatccttatgctcctcagtggagccaatgtactcaatgtccttgaaccactacatcctgtctcatctatgtcttgtcttataccatttgcttgaatctaactctctattttattatgatacttgacactttcaaaagaatatatgcagtctacttataagctgcgaagtttactgacactaaacatagcctgccttctttcccaggtctgccctgctatcaggtcccatctcaactttttcttccccttcagcttcatctgcccatctccttgggctcaaaggagtaactggtatttggctgcatttgttggccttggtcctgtgctttccgcatgcaatgagcagtcactacctatattctctccttgtgtggtcaagcaggttcttgggagcaggaatcatttcctatccattgttacatccatgcagtttaacactgtgctgggcacagagcactctcattaagctatcaagacaatgattccactctcaatgccctgacatgtggtatgaatagaataaacacagttggatgagcttctcatttggtgaattttccaaactttaacaatgcaaaactactagtgctgtacaggaagctacaaaaaagcttctcagtagacatggcggtcctagaaaatgtttccttctgatcagagaatgtattaaatgtgcttcatttgactaatcagcttgtgctaattagctgaatgaaaaggaaatctcaagatatcacatttcaaatgaaagcataagtttgctgacttaatgtaagcaacattgtcttgtgtagatactactctggatctaaatatattctattacaaaaaagtatgattttatactacagagaaattatataccaaatataaccaagaattacaatatgcccctcatccagtatccacaataaactgagtataaaactgataaggctgggcactgtggctcacacctgtaatcccaacgctttggagggctgaggcaagaggatcacctgaggccagccgtttgatacaagcctgggcaacatagtgagaccccatctctacaaacataaaaattagttgggcatggtggcatgtgcctgtggttgtggcgtatgcctgaagtgggaagatcacttgagcccatgaggtcgaagctgcagtgagctgtgagcacaccacagctcaccagcctacgcaacacagtgggaccctgtctctagaataataagaaaaataaatattagtatgccttcagcctggttctgatgggtattcttgagagatacagggaaagagcagattgctctgacctgaacactaaagtagaaaaatcccttacttttaagtcttagattttatcatcaatatctctcctctgatcacagttgccactgctgcatctccctgccctcaaaagtcaggaaatttggttgtttccatagcaactacactgaccatatattataacactaaaaggccactgcatgtactttaaggacaaatcatgcacacatgttcacgacacaggcacacacacttgcattatgattataaatttactgtcaccaaccatgaaagattaaaaatccccaaagcaaacgaactttggacatttcttgagcaagttttaggggcctatggtagtgattgaaagggagaggacgctcatccattatcagaagacaaattgtatcatcataagcaagtggagaacaagagagccaagaaagcaaatagcagaataaacaattgtcctgcaatagtgacagttaattttatggcactaaaaaattctgccttgggaaggtttcctaaagaacaactggaggcttgggatttactttatcaaaaataaactttcctcccaaagatttcactttgcattttagtttatgtccttgtattaaaatggatgagatgtcctttagttttaagacatcaactaagagaagatgctcagatgtccagagaaaacattttagaataagtatagtaaaacgtaacattgttgaaaatagttattattgtgctatcaaagagaagcaccatatttatcttgctcatcttcatactcttaatcctagcaggacaataaatattagtaacatggctttcagagacaagtatccaatgaaaagacaaattgctttatattgatattaattcaactctcctcagcggattagtagacattgtattaggacttgtacagtggcaaatgaggtttaagcaaaaggagggagtatttttataggcttttgtatatttaaaaatctagtcatatataatcttcaggcacagttgaatccggtactaagtaatatccatcatcaggaatatgtcctttcatcttgttctattgtagcctatattggcctcactccctacatatggaaagctggtaggaagcctgaaaaccaaagcttccaggtagaatctgtgagcatggagaggaggctctgtttgaagacaggaaatgacaaagagacaacttctgctggtggtgctactaacaaagattctgtttttgactaacatttagttacttagtctgcgtcctctaggtctccaccttgacatttatctttctgtaaatgcatcaccctattgtagcaagaatcttgctagtcagtttggaaagaatcccccaccccgatatctccctttatctgaccaaattcttcatccttcttacttatctgactattctagcctgccttcagcaagaatcttgttagatgtctaacctgtatccttttatttctaatgttttcttagtcattttccacccactgactcccaacctgccccttggctatgaatccctacttgtccatgctatattcagaagtgaatccggttatactgaggtctatcttcctcattgcagtagttcctgaacaaagtctgtttttactactttactgtctggttctggttttctttaacattacccatgtagagagagactcttggcctcctaacctcactatcttatatgaacctttttgtgaccaaacctagcaggaagccaattggcaaaagagcctggagaatatggcttttaggagtctggaccttttgcagcgcaaagcagaggaaataaagaatggattggattatacagtaaagagaagccaatgacaagcacagaaaccacaacttttactttccctctttgcaatcacaacacctaacctagcgcacataataatgaccagagctaacatttattgagctcttactattttccagacacttcatatgtaataactcacttaaatttcacaacccagtgagataaattctatttttgtcaactccattgtacattttgcaacacagcaagttaattacctaagttcatgtagctactacatgatagggctaggtttcaaaccaaaaatgcttagattcagggcctgaacgctaacctattatactttattgcatcaacagtgggcacttaaatacgtgtgaaagagggtgctccatttggagaggctggtgaaaaggaaaatggcagaagagagaacactgagctagaggtcaaaataactaagatcctgtttcaaactcttattttttcctataaacatgacctctggtcttagcaccagtaatatcctgtttttaaagcattttgagatctttatgaatacttgtgaatctggtaacattatggaaaatattcactcattatgtgaaagaatgaatccgtaggttgtatattctcctgaccaagattagccaagccatctttgatttctataggccagatcagaatctgcggtctctttttggtcagtgatcccatgggtctactaagtcaggattctgtgcaccagcagtccccagccttttttttttttttttttttttttgggcaccagggaccagtgctcatgggagacagtttttccacagatgtggggtgtggtgtgggggagatggtttcaggaagaaacagttctacctcaaatcaggcattagagtctcataagaatcacgtgacctagatccctcttacgcacggttcacaatagtttgcactcctatgagaatctaatgccaagactgatcttgcgggaggaggagctcaggtggtaatgcttgctcacctaccactcacctcctgctgtgtggcccggttcctaacaggccatgaaccggtacaggtctgtggcctgggtgggaggatccttgctgtccacaacaacaaacctttgtatttcctccttgcaatgatgtttttcagctcatcaaagaaaagctaccaaaagctcttcccgtatggcccttcctatattctgtcctatgtcaccatatttacatgcaaaaaaaatggtctaaatgacttagaaaataggaatattaatcatcttttaataattcatctaaaaattatgtattgaggacctattatataacaagcactatcatgccaggagcctcggtatacaagcccatgaaggtgctaagtgtctgggttaatatttgttggcgtaatgtgcaaaatcaaatttaggttgcaaataaaagacttggctgtaatctaaaatataaaagtgaacttttaaaatgattatgccatctgatattggctttctttattgatcaaatatttgggtaccttaatataggctgaaagctgtgctaagcactggagatgtaatggtaaataaaaaagtcaccatccttaaggcatttcagatgggaataggagcagaaaaaacaagccactactgtccagtgctagaataggaggaagaacaaggcacaacagagcacaaacgagggtcatattcaccaccttagaggtgtgagagatggcttttcagaagaagctgagagctgaaaagtgagggacagctggacagatgagagaacagaactaattgagtacaactggagctaattaaggaggtgggccatagctggagagttcaggctagaaatctagagtagccaagtcaccacgcatcttaaatgccacaataagaatgattagtgatggaatcttccaaggctcctacagatattacaacttaaaacttcattactaatctggcagaataaagtgagaatcagcagatgtgaattctgcttttgatttagttacttggtgtcagagctcaaagcctgtcacttaacatcttgggcttcatttttctcattggcctaatgaaaatgctgttacttgttctacccatcatacataagtattatgaaaatcaaaggaactaatgttaactgggaatactctttagtcttaagccaaaaatcttacccaccactcttcctcttctcgaacattccagtatcccctgacccctcccagctgtcactgcctgttcttcctttggtttactttatttccccaggcaagctacagaacagaacatcagctctagacttccccactgtttatgaaatgaacatattacaaccctcacccaccttcctttttaatggaatgtatttgccagttatacagttatagaagtaggctgagttgacgaaaatattacaagaaatcttaaagcaataggaagttatcaatgctctacatccttcaaatggaatggatcctgacttaattaagctcccatacttgatgtccttggtagatgctgtgggtctttacaagtctcagtgtagtttaaatggaacactctaaaggtatcacataaaataagaatgacccagggtagggatgctaggtggacttgagagctaaggagccatcaaatggccaggtgtaacttgagttttctccagtttccttaagcaaagagggaaaaatggttaactcctgtgtagttggtgtgggggatggaagagagtaagcagaggacaatagtgaatgtgcggccgggtgcagtagtggctcatgcctgtaatcccagcactttgggaggctgagtcgggcagatcactggaggtcaggagtttgagagcagcctggccaacatggcgaaacaccatctctactaaaaatacaaaaatcaggcaggtatggtggcacatgactgtagtcccagctactcgggaggctgaggcagaagaatcgtttgaacccgggaggtggagattgcagtgagccgagattgtgccactgcactccagcctgggcaacagagagagaccccttcgggggggaaataaaagtgtttttcccaaaaggaagcaaatcagactgacccatgtaaaaggtcagtgtattaggttgggccatgaatagtctgagaaggaagaaaaaggaggaggggagggaaagagcgagggaatggcagggcagagaggtggaaaaaggaagagagaagcaaaggatgaaccggccgggcccagtggcctacgcctgtaatcccagcactttgggaggccgaggtgggcagatcacttgaggtcaggagttggagaccagcctgaccaacatggttgaaaccccatctctactaaaaatacaaaaattaactgggcatggtggttgcatgcctgtaatcctagctacttgggaggctgaggcaggagaatcgcttgaacctgggaggcagaggttgcagtgagctgagacagcgttactgcacgctggcctgggcgacagagcaggactctatctcaaaaaaaaaaaaaatgaggatatcattcaaatgtgagatttcaagtgctaaagtataggtcaatacaaagcgtctgtgtaaatgggtgcattttgagcttgtggaaaccagcagactatttggatgtcatctaacatacagattcttacattagcccactacttttatgaatcttttgccttttttgtctaaaatgctgatgtatgaagttagcaagtgggaaaaataaccctctcttcatttctctaaatgcaagtccacccactacttttatctttctcttttttcttccctcactgttataaatattccctctttctggctttcaaatgtatacaacatgttacaagtcctatgataagaatgagagcaggtcatcaaaataattcgaaaactcaccatctttgcacttatgttcacctcactctcctgtgtctgttcttctgtgtaacctctgttttcccagtctcatgcacagtgactaaacggtggtggagagtgtgcttcatatactcaactctactgtaagagctattcacttataattgggaatttgccttcaactttaaccagccaggactcatttcctgagtgtctactcacaatatttctgcattttgctgtatttatgttcacctataatccaaagcaggtattctttcatttctgacatcttcaaataaacatcttgcattttttcctatggcatgtctttaattcatttctttacttggatttatttagttagttcattttctttctgctgtagatttttcattctttgtcagagtagaaaatatttaaaatcatccggtttgcatacagcttggagagagaacttattttttataaagggtcacaattattttttgaatttaccatcaaatctgaattcctatttgccttttcatctgcaatttgagaggctaattcaagaggcagacacattgtgctccattggatgtttcaatgtaggaggttcaaatcatgatataaacgcttgcttctattaccagttctgaatcattttttgatattgactcagctatctttcccattccagtcaagcattttccaatcactggtatcacctatagatcaatctccactcaaatcctcaatttgttctccaattctcacttccttcccatgatctcttgtactttctggaagatgttttgtacagaagtttgctgatacttgttttaatagtttagaggtgggattgtagagaactttcatttaagttcatatttttatattacttggatttattacaagtatatattaacaaaaagtgaaatttttaaacacaccttttcctccaaaaaatcattgcataacattcatactgcaagaagggtctctatgcatattctgtggggatatatacatattttttgtcttatttcaatttaaggagcatgaggctataaggagacaacaatcttgctctaatattttctcaaatattctgaagtttataagctatgtaatgaagtttgctgatacatgaggtgcttgtgattgaatttctgttctggtgaacagtctgccctgttctcttctgccatatagtgacatgtttgagcttgttgtcttgccattttgacatctcctttcctcgagtttattttgatctccagtttctcaaaaactgtgtgctatcagccctttcacaaactggcttgatggtctgcctggttcaagccgtttccagaaagtttctgggtgctgtgtgctaggtttcccacgaaatgtgatttcctctcgcttcagttaattgatataatgcttttaacttcacagctatctgtgaaaatgtgttctttgagaaaacatcagcatttcaattcatgagactatgaaagaaaagttacatgatatatatagacagacagatacataggtagatatagagatatatatatagagagagagatctgtgtttgtcttccacctttggccctttggttgatatgctcttaaaaattcttaagttgctttacaaagctgaggtcagttgcttctttccttaatacatttgacgtttttgtggtggttcaaaatcctcactttcccactgtgtatattgctttacgtaataagttatcaaagagatcctacagccctgtgtccagctcaaggcagaagggcaggaaagggcatgtttgtgcagtgggcaatactccccaggtccctcccatgagcccccagtcctctcttggccgcaccctcctctggctcgcctttcttctcgcttgtcatcctagctactctctctcccagtcacccacagtagtctcacagcaaaatgcgcaaaggaaatagcagccttccacgcaaaatgagagggggagggggaaggaagtccctccccctcctgctacaagggtggggctggaaacacaccagccttcttgatagtggtttacgcattaccagctatgaactgctaagagctcacaggcactggatcagtttatcatctgtaaaaaaccactgacttctgaaatattctgaacacttagtgttgagatcaagactccccttccccttccagaaaccctcttggaagattctagaaagctttaagtttcagggctgcagacccgttagggattttcagagaactgctagcatactttagtacaagatctgagatattttctcccagagtgtaaatcttccttaaatacccctaactaagggttagaatgagctgcttagaaaatgaggagactgaactaagatatttttagaaatgcaacttaataattttaaaccataacgctgcctacaagagaggaaagttggactcagtttcttagagaatgtgtaagtgcctctataaatagttaagaaacatttgatagtgcagagatcacttggcaatacctctgcatgccctacaagcatttaaaaatagtacaatcggtcttctctcttaggacagatggagatttttcgattttccctaggcaacaatccacacaccttctctattaaagataatctaaaacagtgtttttcaaactctgactagaattcacagtaagaaattatttttaaatagtgacacagtatccgccctaccacacatgaaactgaaagaaaaatttcatggaatagtacacattattaccacatggagtgcatactgattttttctatttcagtctattctgttctgttaatttaaaggaaaaaaataaaaagctggcatgacttacaattgactgtgtaactcaagaacaattggtacagtgattgttaaccctggataacattagaatcatatggttttttttccccccaaaataacattgcagggttcctactcaaggccaaaaaaccagaattttcagtgtgaagtaagggcagtgttattgtttaaaatgtttcccagtgatgctaaggtgcagccaggattggaaaccactgttctgatgggtcttgatctcacattgaaaaatcctgatctagaagtttaagtcaacattacattcatgttgggactacagaagtctgaagtgttgagtttttctgataacataaaccagggtgattatctgacttacttttttgctactagtacccattataagagttttatttgtgtgaatacaagtgaagaatggctttattccgtgcaacccaaagagaatgtgggttacatgtggtccatgctgaagtcttaatcagtggaaggaaaaaaagaagctccaaactataaaacctaagtctatgggttatgtacaaacaaaaccaagaaccctaacctattcaaccttttgctttgctatgtatattagtctgttttcatgctgctcatagatataccagagactgggcaatttacaaaagaagtttaatggactcacagttccacgtggctgggaagccctcataatcatggtggaaggtgaaaggcacattgctcatggcaacagacaagagaacttgtgcagggaaactcccctttctaaaaccatcagatcttgtaagacctactccctattataagaatagcatgggaaagacctgcccccatgattcaactacttcccactgggtcctcccacaacacaaaggaattgtgggagctacaattcaaaatgagatttgggtggggatagaggcaaactgtatcactatgttactgtgatatggaagaagaaaaacttgtgttcagaagctagtatcaacagataggggaactttgctcacttggctctgataggaagaactgtgatccttcctcttctcatattattgctaactctgagtttctgggatccatttgaggccctactttgttgagaaagggattttaggtagcctacaatatggtaggattgggaggaggacaggaggaaggagagaagagagatagaagtgagggaggtagggtagatcggggaagaagagaaggaaggggaaataaaaaggggagaatgtggaacagaagaaatgaggttcaaagccaagagaaaatgcagtgaggaagcctggagtgactgcacacacactccatgagaaggcacatgagaagggaaacagaagagattacagaatttgacaaatttttggcatatctgggaactgatgcatagtatagcaaaggcattcagtagtcatttgctccttctgaacttcaggtatttgctatgtaactgtcaactacatcaccttgcttcatcatataacattttcattcatctgcaaattgaggataataatattgcactgcagcccacctcctggagatatttggattatttgtggcatgattaagtaaatgcctggaaaaaatatatttattaacacaggacatatttcttcagtctagatggattaattgcatctctccaaaataggcagacatatagaaatgttctctttcaaactggacaaaacagacacagagtgagtgttctgctttggaatgaggctggaagagcaaatcttcaccaagagcacaatacttaacaaaatcaatctatgtccccagcttattgtgatgctgtcaacaaaggcatggttccttctcaaatagaattttacatttcaattttacctgtagcagtaaggcctgtggcctacatttcttggagtttgagcattcttgagaggtctggcctctgaggcctggagtataggtaggagattgatttcacagacaggaaaatgctatgcaggaatgcaagttctgaaacacgagttccctggtcgtctttgtataaatcccattgaagatttgtgggatattactgacattactataatcatgagcagtcctatttaaaactatccttaaatagcagttaaacatttaagaagtacttggcagaatctttggatagaacaaaagatgtagtggacaatagcattttttcaaggacttatgataaaatgcagaaatgcgctgaaatgacaaaaaacgtttccactatactaatggctatttgttcaggcagaaagagcctgtgcattagcatgtgggttactcctcaacatagacataacaaggaaaaaggaaattacatttatcgtgtgcttactacttgattaacaatgcactgcacacgtttgaacattatctcatttaatgttatattagtttttcaaaacagaaggtgtcttcattatacagataaaagcatcaaggttcagaaaggttaaatgacttgtcaaagtcacacaaggcagtcccaagcagaggaataatttgaacacaaatcttgctgggtttcaaggtccataggttcatttacccactgagaaatcatagttaatcccagaatttcccagttcaaactatagccttaaagactggtaaagcaaacccacatctctggatgttctaaaacaaggatgagcaagtgagtacaccttatatatcctatataggatagatagaatcttatctgtatagggccaggtagtaaatactttcaggtttgcaagccatatgatctctatcacaaccactgaactctatggttgtagcatgaaagctgccatagaggatatttaaatgagcatgcctgtgttctactaaaactttataagaacaggtgacaggccaggtttaacccaagggccataatttttagaccccatgctttaagacattccagtgaagagacattccataagatagtcatttccaaatttgtagaggcagaaaaagttaaacatttatatgaaggctgcaaaaccagagacattattcttgattaaaaaaaagaataagagttcaagatcagcctggccaagatagtgaaatcctgcctctactaaaaatataaaaattagctgggcatggtggtgggcacctgtaatcccagctacttggaagactgaggcaggagaatcacttgaacctgggaggcggagatttcaatgagccgagattgtgccactgcactccagcctgggtgacagagccagactctgtctcatttaaaaaaaaaaaaaaatttttttcattaaggcaaatttttaatcccttttacacagtaaatacttagccactaaaagagatacttaaactgggagataaaatggccatggtttatttgcctttctggatttgagaaacattttacacaattcccatagagaatggcatttgaaaatcaagacccatactggcttataatttctaattttcattgttcccccgatgccccaagaagaaaaaaaatttactctgtgataaaactggttaaatttgtgttcattttctgttttactgcaaacagcaagtggaagttactagtaaaggaacaaaaaggaaggcagggagggaaagtagacagttctctctggtcggttaggaggagggctatgtgatgacatttacgattctctggcacaattctaggtctccaggtatgagaattatggtttccaaaccaaacaagaaaaccgttgtctgacagattgcaagtgtcccgaagggaacaagagaaccagatgtatttagaacaaccatgactgcaaatcctgggggagagtgactatatctacagaatttctgtacaaccttggctgaaagagggaaagtgtaatgagaaaaacctataggcaagagtctggggaccgaattgagttaggtggagatttataggtcagtttaacccgactggctgtggaaatgagttagaattagcaaaatcatcagcattactacttcattttgtataggttccaaaggggattaaacaatcaggttttatctttctaaatcaatgttttctatttctgtacactgttacggctttacaattcagttttaggtgggaaacagggttgatccattacctgccatcttgttttaggcacacataagctgtgtggttaaaagcatggattgcggactaagcatgactgactgaatcccagttccatcctttatgagcttcatggccgtgagcatgttatttatgctttctgtattcaggttcctcgtctgtacagtgggaagggggaatagtccctacctcatgggatttgatatgtggatttaatgggttactatatttatccacttgttttatctgtttattgaacttgccaggcctgcactggacatgagaacaggtaagggagcctctatttcagtatagatgagaggctaatggctccaccattagaggaatttgcgatatgtactgaacaaatgcttggctagagaggagacccctaatgcatcctggaaaagcagaaaggccccctggaagagttgaggcttgagcctcaactgtttcatgagagaaacagtaggacttaggactcaagtgggcaaagaagagtttctggttttccacacagaaggaacaacttggctgtaggaaaataaatgcattcttaatgtgatgttaaaatccctccatatgtgatctgaaattgcttccaagcctcatctcccagcacatcgttccctagccccagacacctggcacatgtcattgtccagatctgactttgctctccccaagaccatatattcttaatttgttttcttttttttttttttttttttttttttttttttttttgagacagtcttgctctgtcaccaggctggagtgcattggcgctatcttggctcactgcaacctccgcctcccagtttcaagcaattctcctgctgcagcctcccgagtagctgggactacaggcgcatgccaccatccctggctactttttgtgtttttggtagagacaggatttcaccacgttggccagactggtcttgaactcctgacctcaggtaatccacctgcctcagcctcccaaagtgctgggattataggcatgagctaccacacctggcccacatactaatttctgacagttcagtgtttgtcagaaatcaggggataactgtattgtatagcatcttagggtgaagagtacctattcctgtcccatatccaatcacttatatagtccccaagcctatcactgctcagcataccctctaaaaagtcagcatgggctgacatacagtgcccataccccagtgacctaaaatgaaccgtagacattttctttctcccctgccttacaaaatccatgaacccattacaatgatgagagacaatatgtcttctctatagtctcgtgtagcctggcatgcgtgtctgtttttggttctaaataattatgataaatgtcctgaatgtaagtgacaacctttctcaaaattgtctaaagctgtagaggcattgagaaaaataaatccccatacagggagtgttaaactccatgagttcatactaattttattgttatattgtaaatccaatatcagattctagaatatacttaagattccagctctgtgaaattaaccttgccaccaatcatgggtaagtcatttcctcaatcacaagctttttaaacaaagaagacatttgaagaactctacttccctagagattttccttttagatttcaattgaactttttaagtgcaggggccctatatctttcaaaattgggaaatgaaatctattacagtggctaatcctctaatgcttgatgttgctacctcacaggcagaaaacaatcttttccttattacatataaatttctggttcacactagctctgaaaacagctatgtatttcattgcatttcactacctctctggcaagttgaatattgaaatggcacaaagattctgacagtgctataaatgaatgcaccagtatttctagaactggatgtcgagggtataatctgcactatggtgctgtctaagactgataataaaacagaagaatactatttcaaggtaagatcaaaaggacatataatagtcatatgtgctactttgacaagggcataatgaaatgtactgggaagacagacagtagccttacaaaagagaagtggtgaacttctttctgtgataactgctatggaactggagatacggaagatacaattcttgtttttttagtttctggactacatttaaaattcggcaatctgctagtaaattgccacagcaagacatggaagatattcattgtagacacaatttagcctccttgcccagttcacaatgaccccttacttcccctctcatccatagacatgggcataatgaacccttgctccatcccgctgccctaccaattggaccagaggctaagaagactagaaatgtggaattaacactgagagattctaatttagctttgctggtctcttgggcagagatgtaaacattatactgtggaggtgccatattttacctgtcgtgagaacttaaaagcaaatataattgttagaagttttaaaattatatcactttggatgtacaaaaagggaactttatttttctttaaaacatttctgatttggagccaccattacttctaatgcataatatttagtctggtcactttcagaaaaactcaaattgactagtcagaccattcagaaataaaacatggttgattaagatttttttttcctgagaataatttctgcctccccttgttctctatttcatgttattgtgaatttctcaaatgctgctgagaagagttgccagttaaaatacaaaatacctcattaaatttgaatttcaagcacattataaatttataaaagccattaatataagtatgtcctatgtaacatttgagatatacttacactaaaatattgtttaatgaaaatcaaatttaactgagcctcctgtgtttttatttactgaatctggcaaccctacactgaggtgtgaaatttccttgtccaatttggtcactgcagttgtgtgttgagctccacccttagctcatcccaagatggtcttcccaccttgctgcttatacctgaatatctgctatggcctctgaatgtcagatcacttgaggcctgcttcttgcttcatgcccctatttccaggcttcattgtgtcttgttcatgttcagtcagttttggatgatcctccataccagccattctgaagcctgcaggaacacagggggctatcccaggcactcttatgcctagataaaaggccatctctagtttctgcttgaacatattgacgtgggagattgagggggaggcttcccacattgagtttcacctagaattcgagctgagaggaaagaacctattatcatttcatttacagggaggttctattctttcttggtgccccgggtttacacttatacttaagaattgctttctcttcagagagtcctcttccctccccaactctgaggcctgtttatctacttgggaaagagggtgtgaactaaaaatggttttttgtataagatgtccttccaagaataactatgaagtgtaaaaggtaaaaatttgtcactctttatctctggtttcattctgatcattgagtacaataaaaagaaccagaatttcataacacatcttaagcacttgggaggttaaaatcactttcataaatcagcctttgctcagagtaaactcagcctttgctcagagtaaactaacatggttattacagattaattggaaagtaatttagatgagcacactccaaaatggaacttaaggagctgagccaaaactgccctcaaatgtaaaatagcattcttacagaacaaaaacataaatcaggagaaaatgaatattaattacataaatttaataaggacatgaaaaataaatgcaaaaagtgattcctcatggaaagaaaagtaattggaaaaaattttaattaaaaattaagatttcaggcaggaatacaagataaaaatgagataaaaataaggacatggcatatattatgctaagatctttgaaaatcttagcaaaatatatttgagaaaatattgtaatggactcaactagagcagaaaattaatagttcaatgaaaatgtaaaaactgaacacagaattatctaccccaaaatttctgagcaagagttttataattaaatttcctgaacatttctaaaaactgatgcctgttattgaaattatttttttaaagaagttttaaaactgcactcaaaatactatccaaccaagataaaaacacaaagaatagatctatattatgtacatggaggcaaaaatcatccactaatatatttaaaatagtttactgcagtaaaatgaggttaatcagtaatacagaaaatctgttaacataaatttagtttaaggagtaaattgatagaattaccttatttgataatagaaaggtatgtggtaaaactcaatactagataatttctcaagatttataaagaatgtataacttagggcaacttcaataaaatcacaaagacaagaatgtcttctgtttaccgaacatatttttgaaaattctatcagtctattataattgtaaccaatatgaagctagatattagaatgaaaaaatgacaatttatactgataaaatcatattcttggaaatgcaagagaataacttaaaatctctcagaaccaattagcaatctggtgaagtagttaaatataagtaaatatttcaaaagtttttcttacatcagccttagcagttagaaggtttaaaaaataaaatataaaatgtataaataaccctagcaaaacatgcaggatcctctattagaaaagccattgatggggttgtttttttcttgtaaattggaaacaacaggtgctagagaggatgtgaagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaaattggaaatcatcattctcagtaaacttatcgtaaagacaaaaaaccaaacaccacatgttcccactcataggtgggaattgaacaatgagaacacatggacacaggaaggggaacatcacactctggggactgctgggtgtggggaggcggggagagaggagggatagcattaggagatatacctaatgctaaatgacgagttaatgggtgcagcacaccagcatggcacatgtatacatatgtaactaacctgcacgttgtgcacatgtaccctaaaacttaaagtataataataataaagaaaaaaagaaaagccattgaaactgaaatacttacaagtaaactgatataatgtgtgtcttttttttctctttttttatacacacggcagaggaggaagcagtagatatgaaactggtcatgaactgatccctactaaaaccatgtgatgggttcgtggaagttcatctctacttttgtacatatttgaaatttatcataagaagttaaaaagaatctttgtgtgaaataagatctgaataaatattactaggttggaaggctaaaatcacacaaagatgttaagtcttctcaaattaattcacaggtttaatataaaccttagaaaaaatccccagtggaagttttttaaacttaagtttttgaaaactggaagaataaatagatgataataagtcattttttaaaagagtgaatatagacttaccctactagatgaaatatattctgaagctataatgattacagcaaggtggacttggcaaaacaatcaacagctgtttgattcaatgaatgggattatttcagaaatggaatatcaagttatcttcttgccttatccagtcttctgacccttaattaaaattcctctacttttctcctccagtttatacactaatgctatgttttattacaaattattttcactttagactattccacatttcctgtagttgatatgcaggttttgtacaatattaggtttcacttggtacacctaatgggataatttgctcatatggaagtctggtatcacttggaaactttctctatagatgaatagttaacatgtgtcacaaaaagatgacaaaattccacaacaagaatagatggctggatgatatttccaaataccaatatctcctaattgaagaagacaggtttagcttcccatgtttctggcagtcactgatcacctcagtaaccactgttgtaagaggtgtctggatggggactgagatgagggaggaggtgttgcaaattttgttataggaggaaagcttctaaaaacatatatggactttcatgtaatgcaaactgctgagctgggctgaaggtgctgaattagctgctttcgtggtaatgatggccgtgattaaagaaatattctcaagcttctttaaacccaaggagcctctgttttttagatcataagaaggggtagaagtggataaagaaagcaagatgctggttatataagcaaaatatattaatctatacttatcagcctagatatatattaatatgcatctcaagaaaattttaaatgatttaatattggctggtgttttacaactaattttcgcattcttaattatgcttgactctgacagtgtgatcatataatacttttaaaatatggaaagaaaataccagttaactgatatgtcacctctgctacaagtttcttgaccagccttttcagcagtgttctcattttatttacattctccaactcctgctttttaatcattacataactaaataatagcatatgtttgcttaaaatgttactaacctttgacttagggtagggagcatgtcttattcactgaatacgcagtagtctctacatattttcaggttgaatgaaaggctgaataaacaaatgcttatttccagtggcagtattgaacagctgctaattattaaaaattcagaacgtggcacatatcaattctaataaaggaatagatgaattaaagaccttcccactgaatacagccaagaatcctggaacaaaatataaaaactgcatctaatgaaaagcctagcagacctccacaagacagggatataaactactgggaggtacaatgagggaaagggaactcagggaggtaagctagagacgttcctactccaggacactttcagactcagggaggacagccaagacaagaaccagaatggtgagaagggagggaacaaagattgaggtcctgtgtccaccaagtgtggagacctggagtattatcacttctcactagcagatatcctaaagacttcaggaaacaaaattcaaaagtattcattgttattaaggccaagaaagaaatcccttttcttgtttgggacccaaaggtctccaccatgaagtggaggtacaggctataccctgaagatccagaaaaatgtcaagcattggtcctgaactgctaattccctcagatacacataaaaatgaaaatagagattccatttttataagaaagatcaattcaggtctcaaattattcctaagggtaaattttcaaataaaatattaagtaaaccaccaaagattataaggtacctctctagacaataggagagccaggaatcatggacacaagaaatagtaataacaccaaagggaaactagatattgaagttaacagaagagatggtaaatctatgcttacagtgttcaagtatataaaagctaatcttaaaaacgccaataacctagagatgacagtatgtaggtaaaaagaatccattagaaattataaagctagaaagacaaaataacttgagatggctttcgcagcagattagatacagctgaagagaaagaatttcaagataggtcagaagaaactgtacacaatgaaacatggaaaaacaaaattaaggaacatacaaaatagagagtaagaagaaaagaaaggaagaagtcttaatatgtatttaattgacatgccagaaaaggagagagaaatgaaagcagggataataattacaaaacgtatcaatctacagattcaagaaacccagtaaagctcatgcaagaaaaactaaataaaattcatatttggaacatccttgttaaatagtagaaatatttttaaagcttgaaaattttaaaagaagccagaggaaaaaaagtcattttatcattaaaggaatgacagttaaatagcagatattttaacacaacaacaaaaggcaaaaagagaaaaaaaattaattagaaaaagaaaaatatcaccaaagtattgaaagaaaattactgacaatcttaacaccagcaaaaatgaaaaacatttttaaagaagcaaaatataacaatatgctaccatttgacccacaagaaaattcctaaatgtggtcttcaagaggaaggaaaattattccggatggaaccttagagataagaagtaaagatatgtgcacaaaaatactcatagcaaatttttataaaagccttgaaataaatgcccgtcaacaatagaatgaataaggaaattgtgatatattcacatagaatagtataaaagaatgaaaataatcatcagattgtgccacaaaatggataaatcttaaagacataagcttgagcaacaacaaaaatccaagcacaagaaaatacatactatatgattctatttgtataaaattcaaaaactaaagtaaattatattatttggtataactacagagcaaaactaataaaagcaagcaagaaagtatcagaaagaaacacgtgaagatctctgggtttctggttatgttctttattttaatctgtgtgagaatgacctgttcacattataataaatcaagctgttcatttattttatgcatgtttttatatctatctatcttatacttcataattttaattttaaagtaaagcaaacaactttcaaattcccaactagcctaccagagaatgaactaccagggaggacattgagttccttttgcaattaacaaaaccctctaaattatgattttcaatcagcatcataatgacctaaaggtatgtttgctgtgcaagggtacatgcacatgagtgtgtacttgtgaattatatgcagtttcacatcttggaagcaggagattcaagaccagggtaccacttttattttctgatattttttctgtgggcattgggatccctacttaaaaaataagcttgctattttagagtttttatttttctgcccaaatcattatttattatatgccaccaacaatttctgaacaaattagggtttaaatacaattactaaaagtttatataaaatctattttcaacttctgagctacttacaaaattagaacacttattcacatggacttggattaacactttgaatcactatggaacaacacattcagcaaaaaattgactccctgtaatcttttgcccatgaagcaacaaagctagaaagcctaattagaattatcaggtatgttttaagatatcttccttggaaaccaatatgacaactaaaattctgcaaagaaaaacaaatagaatgatttattccaagaactcaaaagggcctcaactatcatatcagagtagcgataaaagagaaggccttaacttgcacaggaacagaaaaccaacgctgcaggttctcactaataagtgggagataaacaatgagaacccatggacacagggagcggggaatatcacacaccagggcctgtcctcaggtggggaacaaggggagggagagcattacaacaaatacctaacacatgcaaggtttaaaacctagatgatgggttgataggtgcagcaaagcaccacagcacatgtatacctatataacaaatctgcatgcttagcacatgtatcccagaacttaaaaatagaaggccttgttgccgtgagttaataataaaataaaaggcaaaaaaggcagatacttggaatccattaaaaaatagtaaaaccaaattctagcctacctgaagcaggcacagcatgcttattatggcataaatttttcttttacgttcattccaggcttgttttattcctttaatcttatgtctcttcctttcttagattttaatttatgtaatctttgtgttgtgggaccctaatcagttttgtttcaagctgagatggaaaacatttagtgtgtaaatagaatcctctctctgggatatttttcaactgctggtctttatcaaattaaagatgacaaaaggacacaaaggcagaatttcatatttttctttctggttattttttagcaaatctgaagtcctctgtgatgactggcagagaagcaaaggttggcgttccatactgaaacaggctggctgccaagatgagtgaattctttacctgggaagggcattagagagatatctacaccctcagggttctgcacaaataggcagaaaatataaaatccaataataggcaaaaccccaactcatctaagccaaactgacaaaataaatgtagtttaatcagtaagaccaggtggcagccacccaagagttttgaaggaactcaaggatgaaattgggagaccgttggccaagatgctggatccaacattataaacagccatttccagcaaactggcagattgtgaatgtcattctgttcattagaaggggtcaagagaggacccagggagccttagaaaagcaagtatctcttctacttgtccagtctccaataaaagacagcatcattagatactaaaacaaaaataacttcctaggggaaagacaatatggttttctgaaaaaggaaaccatgagtcactgatttattattggtctctgaggcatgtagataaaaggccaaatgctggcacaacccagagtcaagatttttaaagtgccaacgtgggatgggatgagagaaggtaatggctacatcaagccatatggataagacaaacaatttccataccccttcaaaaaatttcctatgtattttccaaagcaagaagggtcatgctttgagacttgaaagatcaggatgcatgataaaggacatactacttcacattgtgggtaaaaaatttaaaacacattgccatttggtggtattggaaatagatacagatttagtcacttcaggaaacattttttaattgagaattaactgaggcttgggttttatactcagtagtagagcgatagtggtgagtgagacccattctgtcctcaagtagctcccagtgtactacacagatgattctaagacctgtgcccagttcaagccctgcattaggaccagtacacatttatgactaggtggtaactgatgattgagatcagatagtacaatcacaattacataacaaatctcttggggccacagtcagcaatagaagcaatatactgagctgtatggggcatggatctaaagcaaaatgcaaattcccttgttaaaatgaatggcaatggtaataccaacaaatcctaaaaatgttattggtttgtttggtggagaaatagataatggattctgaacacatgaggctctaacattattatccctttaccttatagagaaagaaagcagaaatgacagaggtgtttgtgattactgatgaaatcgttttttaacgtgatgcacctacaaagctttgtggaaagaaaattacccgttgcttattataattttaaaaatacaagaattaagagtatttatcaatcaggaattgaatgaattctctctgtttgatttctcaactttgccaaaaggtctgggaagaattttctgagctcaagcaagaacagcccagacacagagaatgattttggcagcacgaagcacaagagattgatctctctcctacaagtcaaatgcttctcttttctaatcagttttaaacacctaccttcccctttttctgctacattagctggtaggctgtcattctaaagaaatttataatgtacctgtacagaaaaagtgtgagtgttccctggcaggagagaaaatttctttgatcagattgttcagtattttcaaaccatctaatggcatttccataggagctctatgaagaaaagcaagagctagaaaagaaatccccacaaaagcagattcagtttgttctagtttctctgatttaaaagaaaaatgtactttctttcctttttctctttacttgcacactttttaactggcatgtaataattgtcatttgtaatatcaatcattcagaacagaaacgaaaatggggctaagtaacctgcttctcaggtatattttccagcaaaaattctgtcttttcctggtgaccacactgggaaatgacattagtctcctttttttttcctttacgttgtactatgtggctcagcacatcctcaataactatgtgttgaatgactatcccactcttttttctgctactccttctccaaaaataaaagtggggggggtgcgggggagggtctatattccaagcctcctctagaatgaagatgaaaggaaaggaaaagcattgcaagcttatctccaagccctcacatttaaaacctaggcaatttacaattgtgtgtcaatacactgagccaaagatccctgagaaggaggtataaaatgtcaatagataaaattagaaggaaaatgtttgcatctatgtcattaagtgtacaaatgtcttgcctatcaaattgacaaaactatgcctgtgatgtcaaaggttagaacacagacgtatgcatgtacacacatatgcacatatatactctactctgctcatgagaatgtaaatgcttttgaagaaagattaggaaacctgaatttaaaaagcattatgaaagctaactattgctcttccacttctatagggatttatgctaaaggaatactaaagaggaatcatttatacttaaaaggccatctgattagcatgtttcatgttctcatacctgttgagttttttttaaactaaaaaatctgtctcataaacactaaaaatcaaaaatctgatactgacatttttctccatctatgcaactgattcttagaatatattgccttttattttagatcaaagcatcaaaactgtctttgatccaaaacagccacgcaaatcccgcatttacctctgaagtcaacctatttataatcacaggttttttttaaaatccctgattttctttttattcctgtgattctttttattcctgtgattcaaagaggattagtgatagtacaactttgagagcatcagctgtgctttgttcctgaagcagtcctatttactaacacaggaaattaaaaatgcaaaaactaccagtcaatcaggaaatcagcattgtggatgtcagggctttgtaggtacaaattggggaattagttttttccatgaacagcagtatatttactaagtaatttcttttaaactagagttatccttttacatcaacagaagaaccaattagaatcactattcatcaattattgtcctaacacaagccttgtgttaggacctaggcaatagagcttatcaactaatcaactataattttaatcattgtatcttggagttttcaaaaggaataatttggggtaagggaaaaattcaaattcttagttactgctgacatgaaggcagatacttctgaggatgattaatgtatttaatcaaccattcagtttttaaatagatattagtgggttttttttcccctttttagtgaatacttgctaggcactgacaacacagtggtgaatataatgacattctttctcctcatgtagcttccattctagtgggagagaatattacatgaaaaatcataattacaaatagtaattatacacactattatgcaaatagtaactatataagcactttaaaggagaggaacagagtctgagaaacaacactggggaggtgccagtttatcttggtaagtctggggactcttcaaagaagagggtgacaataagctgtggcatgaaggatgaaaatcattcacatgcctcacattttgtatggctcagaacacagttatccaaaatatggcaccttggaggtcactctctgatctcctctcacctttcttccctgaaacatggtcataaataattatttgacctacctcccctaaaaggaggctgttaagaacctcattctggaggggtcctaccctatgcctggaagtcgagaagactggacaaacaggccctgcaaagtccccccctgccagcttatgaccatacttctgcatgattgtccagaaaaatatagttttccctgggcctttggatcttcatctctgaaggttcttgtttcacaaaaaattttggttaaataagtttgttatgcttttcttttgtcaatgtctttcgttatggggaagtcagccatgaaccttgcaaattggggtaaggaaaagagatgactttttctttcttacatgttcttccctgtctggttagcatcactctttctggtcttcccaccatctccctggccattctgactcagccttcatggggaatccttcctcctctatctaatctctcaatgctaaagtttttcagggctaagttctaggccttattttcttctaattccaaagatcctcccaaggcatctataacccattcctatgacctcagatatcatctatgtgttaacaattctgtaatagactttaccagtccagacttcttttcttagatttgggtccatatgccaacttcctatgtgacttcctcacttgaatatacctcttaagaacctcaaatttactatgagcagcactaaaaggtgtttcactctcaactctttcctccagtgatcttcatcttcctaaatggaatcattcgttcagttgctgtatcagtaatcaggatgattacatgacacctgcttctctctcatctcccataattgataattgataataattgataattgagccctgtctaattgatagctaaaatgtatagtgaatttcacattttcccatctctcttgccatcaactctggcatagatactgcaagcctttttcttagtcttccatctattcttgttcccctccaattcattgtcctaaatgaaaattttttccaataactcttttagttcttctgttgttctaaagatcaagtctaaaatcatcacaatggtctctaagacccttcatgatctacccactgcttaatcctttagtctcatattatgtcaatcttcacattattctctatgcctcagccaaaatacgcttttttcagtttctaaaataattttttttaaaaagggcgttcctttcttaaagaattttcacatgatgttccttccacctgagacatcacctgctgtgtattactgaagtactatactcttctctgtattagacaagggtgcatttggctgcaactaacagattacccaatggagatggtttcagtagtaagaacatttaattttaaccacttgatatcgcaaagtctgaaaggagtcacgttttgggggtgcaacatttcaaaattaccccaaaccaagactttccctttgtttctgtcattctgtgcatattaattttttaaatttagggtaattgccttatggtaacaacccgtatatcatgtctgatgcaactgcattcaaggtagaaaaatgcgagaagaatgctctcgtataaaattattctcaaggtcctcaccacatttccctacatcacattagacataactatgtcatagaaactgcaggggaggctagttaggtgaatattgggagataggcaagaagagaaggaggctggaatgcctgttgatttttacaatcaacagagtctgacatttgttagtgcacttatcaaaacagcagttaaaaaattaaatatctgcattttgttcattgtcttccctgtgagattataaactctttgactctggggaatatgtctgtctgattcaatgctataagagcctagactcgcacagtgtcaagcctacacagatcatttatgctgattgatggaatgaattaatgatatggaagagagtaacagaggcagaaaccaggtacaaaagagatagaaaactgccaacacaaaacttaaactgattgccacatctcatatctcatggtttagctttcctattccatttaaattgaaaacggtcttttcattaaaaaaaaaattggcaactttttgaaagtgctcagttctttgcacagtgaatagaattcccctaacctcttaattcatgccatgaaaatagacatgggttttattgtcactaagattcaggaatgaattctttaaaaaaaaaaaaaaccctgttaaggagttatatgatccagaaaaatttaaattgcctcaagtacagaaatgtaattcagttgttgtctaaattactcaaatatcagttaataagaaaagtatatgaaagctagaaagttacttaagagtagtcataaaatttttagtctaagttctccactccttagcatatcacaccaacagataagtttgtcagattggccgatttaggtagaaagcaaatgtaaaatacctcactcataaaggatgcttgatacatttttgttcttatacctagaccaaaagaaaacttgggtttattcctatctctgtcccatcctaaatgtgtacctatgggcaagttgattacgttctttggttcacaatcaatatggtaatcttaaactaccttttagttacaaatagtcataccacaattttgaaacttaaatttaaaaattaaatggtattgaatacattcaactctatccaacctaataaaacattaaggaactgattcatatttctggtagtgtctatttctatagaagcaaaacctgttcctagtttctgatggacagtctgatcatgtcaaaacgcacagggcactaacataaatatcacaatttctttaaaaagttgtaaatagctacacatgcaagactaggtttcaagttttaaaaatagttttcatttcaaataaaattccttaaaaacagaaaatgactttaacattggcaaagggagtcccctaagaaaaaaatgtaaacagatggctgagaaagatcacccacatgctgaacacagatcttgaggaggcatttctaagaatgaagtagcacttcccagcctgggccacttcccacaaggatccttatttaacccatggaaaacacagagtttatacctccggccaagaggagcctcaactttttttccacttgcctcacagtgatccagacagtttccaactctccctagcattccaaaagaagctaagtaccaaccacttgggatgagcaatcccctaataaattagtgttcgaagatcagccctgaacaaatgtcttcccatataaacgggctgttaagccctagctaagcgtattaagtattcaatttaatgtatgacacacatctgttccactttctcagtgagcagaagtttcaagataacttaaatcccagacttaatcaaggagaaaaaaatcttggcaatgtttaaaactgagttttaaaatataatccaaatgatggtgagagagagaccattttgctgtaactaatgagattatataatacctaaatcaaatccacaaaattacctgagcagaatcactaaatattttatctaggcttatttgtctttcatgtagagaccatcaacacatttcccaaacaccttcaatttacgcctcgcccaagtcaccaagagatgagcaaaaatgaagcccttggcaagcacagtggcttaacccccttgaagcccaaaggaccacaagaggaaaacttacagatttgtctttcacaaggagagcacagcactggatcccagccatcagcatcttgtgtgggttccaggccacagagtcagccctattgtttaaacaaagggacagagtagggagaggactcaattagtttctacaggcaatggaatactatcattatcaatatctgcattcagtactcatacatagtttactgttctatagaactccttatctgagtggtttaaggaatttggagggattttttgttgttgtttatttaaggaaaacaattactttgttttttcctattttcaaaatatcacttagtccaaagagatccctttgcctgacaaaagttggctgtacaccaggaaactacatttacctgtggatgccatgcagaagcttgcggtgcttcctcgacatcaaagctgagccaccccaagaagcctgttgagatatttacagtaccagaacaatgttatttcaatgttatttgtttaccagtgggttgtcatagaaaaccctcagtgaggacctcaatctgcattatttgatattttatgtcatgttaactaatttgtaccccaggaaattctgatcactggctctactcaggcaaccagaacctcatcacaatagatgggccctcactgacccttagaattataaattcatgcatcataaattggtatattaaccaactgagctatgtgtggatggaagaggttcaaagtccatgccctcttgaagcttagactctaacatagacaacatcttcacaatgctaacattttgctattcagtgtatgatgagacatgggctaaggactagtattttatataatgaatgaggcatattattgacaaggtagatagaaggccaactaggatgagctaggcggaaatatctgttaatgaaaaattagatcattttagctaaatggctttcagaaatatctacaaatgagagagagggcaagcttgggacaaaaggaagttatccactggagaagtaaattttgtgagcaaaggagaggggagctcagataaaatcccatagtcaacaggtctggagcaaagggagaaaaattgatgtaagaaatacaaaagtcagtatgcttcttgaaaatggtgcagacataaattttaatttgtaggacattaaaggataactgtattgagagaatttgaagggactagcttgggctgtattgaatgctttccaagttgatttaaaccttacagcattccattaggaatggagttatgatcacttccactttttataaagttcagaggtgttcaggtaaattgtccaaggtctcgccaatgacaaaaatcagatctgagattcaaagcccattctcctgtcatgttaacatcattacttaaggaaggtgacaatttggccaaactggggagtatagcatgtagaatgagggtgacagagatgctttaggcaataggtaagttcaggggttgcttaggatgtagcaacttctatttttggctatggaatttaaaggcataggtagaccttaatatcatgtaaaaagaagtggcatggttggctgcaccacagatatggaagataaagaaaatgaagtatctccacgatcctcagagtattacaaaatttgggcccattggtagccaataacaagaaagtacagcacaagcaactttgtggccttaaatcccacttaaaaacaactttcattgacagctgagactagggtgaagtgaatgagtcagggtgcataattcaaggaagaactcatctcagagctggactcttgcaaggccctaagagtgaatgcttcttaaaatttgagccctgccaaccccactggcctcatattagcaccagccttgtcccatggactaaaggctccatcaactccatggggtccccagaggcctgcgagctctgatgtgtttcaagggtgttgggtgttcaaatcccaaggattcccaggtaaagagttagtaacttggcattatcagtcaaattcccttcctgctgcatttcctcccttacttggattcacaatggaccacgtgtgactcaggctgagccacaaaggcaaatgccctcagcatctaggaaaattttatccccagcctacaactgaggatctccagatctggattttgagaacttggtccttgcaaatattaagatgtgttacatatcacatttttcttgactttcattacatattctaaatcctaaattacctacttttctcacttctcttatcccccaacctctctgagaacctatcagtgacaactacaggaaggattaattagtccagtcagccacacctgtttgctcgctcacactttccacctgcctcataccctacacttctactccttcatgctccctgagctagcctctgcctccactgcttctccaaaaaggtaaataatctcccaattctagtgaactggatttaagttttgaaatcacaggaacccttccaaggcattagttcaccacttcacaaagtactttggcagggttaggaacagctcatccataaatttattccttaaaaaaaaaaaaacacccctgatgtaaatgccctactttaatttgctgcactctaattcctaactccagaaactgtgaaattatcaaacctatcacctaaatgatggagtttggctttccatctcaataaagactgtcatttattaagctattactatatgtgaggcaccacagtatatcattttatatatatttgtctttaattagttaataaattaatagtagaaccaatcttgaaagggaagtgaaggtaagaatggaattgagatttggcagcctctaaaggccatgattttaaatacgtttgtgccttctatggcacttggaatgaggaatgggtgagagaataggaagctttgttgggaatgagaggctttccagcagctacaacctctgattttgaagaagagctagaccagcccgacgttttgttctcagacagaaactagcataacaattgccctcatgaaggaagagaacagtactggagtgaaagagtctaataaaactagtttttcttattcggttgtttaaaaaacgcattatattaccaaattgaagacagtatcaaatgtaagcacccccattttttgtgtactactaataaaaattgacatcaaaatatcaatttcagagttaaaatttttttaagtaagtgcatcttagaattaataaaacatggtatgtatgcagagcagcatggttttactgaaaacccagaagaacaagtaaatgtctttttatttttaaaaagagataaacatcagtttaatatttgaaagaagctttaaaatactctagaagatttcaaacaggtcaaagcaattattgcaatttgttaatattttctttaataaagtacctatggcatatgaagtttcttcaagataagctacatgttcctgtagtaatattttattgatttgacacccacaatactaaaggatgggtaaacatgtctttaataagccagataggcttgtgtcaaatttaatctaatactataggcatttgccagatgtatactatgcacaaataggataatttggtgtggtttacattcccttataaagatgttttcttcaaagactcaacctttaatttttagaaaacctgaagagcttttcattcataaatcacaattttctctaagccccataaatctcttaatgtcattcccaatttaaaagctgctgtggtgactgttttacataaactatttacttttctccattttatacaaactacataaactatataatccatatgtgatgtttcttttatgagagtacaatatttaggtagaactgctgatgtatttgattttcccccttatttccacagttacaaaaatgctcacttcatattatcttttaggatataatgtattgttatgcttctaagtctataaaaatcaataagatataagttgaaatatgaacagatacaaatgctaaaatcccgttaacgagtcacggataatctacctcaagtattgccattggcatactaatagaagcaataactctagtaaactttatactactgttgcttttacaaatgttagtattcagttaatgtaaactttgaatcatatcacagacactctactaggtgatatgatttgattgaaataaacactttgaaagcataaaatcatctaaactacaaaattatgtgggtatatccccccaaatgctgtttccttttgttcagcaagtcaaaaaatatttcttctgccaaggaggatctgaaactatcacttaccagaggaaagctcccaaaacaccatgtgcaattgtctctttggttagaatcaaactaattaactgctggtttcacacaaaaaaaattaattttaaaaaagaaaattaaaaagctccacaagtgttcatagttggctgaattcagcattctaacccgggataagtagaatttttaaagttaccttcgatttaaggaaatatgtattttgaataaccgcaggacttacaaaaattcttttaaaaagccaatcctttgctagaaaataatggagtatattatcccaacccccctcaaataactatctgatagatccagagaaaatttgctttagttatagcatgcaattatgcattgtagcttttttgcattttccagctgtttggaatcataattttagagctagaaagataccttacagcccacatctaccatcccccctctttacaaatgaagaaattgaaatccaaaaggctaagatcgcaatgaagaagaggcagatcagaatttcaaaccaaagtctctcggctccctaacctaaaatgggtgccttacaccaggctgcttcaatgacagtagatttgaggaccaaagatggctcatgggagtaaaagaagcaaaatggaatccagaaagctaaaacaaaatatacacaaagtcgtggaatcttctcatttatactttacaagaaagtggcatacttatttcccccaatttgagacacaaacaaaagcgttggggactccacatctagtttctgagaataagaaaaatttctaccaaggctacaaaaagaccaaaggttaaacaggtatgtacacataaatgaacttacatctacatgaagccagaggctgtgcctctcgcagatgtctgctatttcatccagagggtcaaaagctcccaacacagttgtaccagaagtggcacagacaagaaacggtgctgccccctgtaagaaggatccacacacacaaaattatcactgtcatcactaaatttgtcctgtaatagctggaaaatataaagggttatgcatccagagagttatttgggttttttggaggtagtcattaattcaatgggtgtttttaaattttgtgaatatgtggcctcttggcattataaacagattaaggaaacagaaaatgctatggcaatagcattttctgtcccaactcagtacatcttcagtattattctcatgttttttgtaatgttttgttctatcaattgtccagatagaaatttaataacttcagctgcaacagcaaactgacattttgtatgactcctaatttcttcctgaaaaaatacatttagcctccattgtgccatcattgtcatcttctcaaaaaaaaaaaaaggttggaagacagagctcccggagtaaaccatgcaggcctgtttgctcatctccttgtaaagtaagtgcagttataaaacaaagaatgtagaatattctcaggtacaaattcagcatcagaggagataaggcaacctcactgggatacattctccaaaataggtgctgcaacagagaaatccattggcatgtgctggaaaagaaaatctgtgtcacttctatcatggttattcctcctcatatagctgatgactgcatcttgtggcatgaacgggtactggtgggaaatagagaagaaaagggagaatgtgggtgcacacaaacagatgaatggttatctcggtcaagctagtcacatgctttgtccccattaaaggactctatgccaatcagatagatgaagagtacatgagattgtttccaaatggattgctccaggatggtggtagagatgtgttgctcgctgtgtaggtgaagtttgcagacaaatgtgggggtgaggggagcaagtagaatattaagattctagagcacctgagaaatagacaagaatatttactgcctctgaaagtttagtgcctctaaaagttatttttttctccatttagcatggagccattttttcccctcagttttataaagtgcatgctcattgcaatacatttttatgtcctttaatgccagggattattgtgtttgaaccaactctttccaatttaaccgacttttgacagaaagatgttatttctcaatggaaagtggggcagagcaagaatatgtggttcgcctctctaaactgagatgcatacggatcaaagtggtggtatataacaaatccatttgccatcttgggagacagctgtggcaaatagaatcaatcccatctacccaaaacttttagagccaagtcagtaggtgacagagccctggagaaaccagaggctttgaaacttcttccctgtattcaaactactgacaactatggctttatcataccagtgacctaaaggacataagaccagctttacaccaatcattaaaatcattaaaagcaatagaaaaataatttactaaaaccatttaagttgtctttaatggttgcgcttttcctcataaactatatgacatcctgacagtcatgagaaaatacatttgcaagctattatagcctattaatgagttttcctcacctttaaaaaaagatctcattaaaaatacaggaccagaaattaaacttttgcgatctggatttaacctagactttcttccccatatctcctgctgttaatgagaattcagtagaaacagtattgatggcatgctgccagtgagctgtattgtctaagaaaatttgtcatttctaacacaactctaacaaaatgtctctaaatattcaatgttcatcctagtttgagcttgtcagtaagccctttaggacctctgatgctttgtgtttttcaccatctatgtaatgacatcaagacaaggtcactgcaacagtttttcaatggattgtcataggccagggagttgaatcccagcagaaaaaatagttgatggtactattcctcatatctgaaacaacataagttaaaagcttgaaacaaaacaactaggcctgaagctactgagaaaaaatgaaccagtcatcatgtattattatctcagaatggatgcaaggtttgtccttggtgaatccaggctcaagtattagctgacttgaaagaaaactgaggagacgtactaactctaaccccattgccctacttttaaatgtgcctaaagcaatttttacttttcaaaaacttacttttttgagttctcaactttagtattatgtccgtttcatgtactttcactgtcaaaacaaaaatttgagcgacaaaaatgataatgactgtggtggaataaaaccctctatgctagaaacatgaattcctaatgacactaaaaaaaaatggggattatctttaggggatgctaggcaacaaactcactattttaaaaattgataaataaggggaaagaataagacgtttatcctgtcttgcctgtgcagtgtttccttagggaaacaaaatgaggaggaatatttttctttatagtagaatgcctgacaataaagaaggaaggagagaaggaattaggacatcacttaatgaaataatgggtctagacaatgatcatcaatggcagcaaaaaccactaagtgagaagctgatggagtggagggtattgtgatggatggactgacgataccagaccccaccaatcaatgttattacaaaagagacacaggatgtctcctgatggcaggagccaatgaagcctccctggttttaaaaaaagaaaaatacaacttaaatctcattgagtctcaagatctaactgccaaattacagaaaatataaagaacaaaccggatggtgcagaggaggtgagcacttagggtctcaaattcttgatgtaatccacaaaaatctataatgtggaaagctatatgggacaaaagacctgatcttttcaacaaatcaatggtagtggggggaaagaggaggaggaggaagctatagatcagaaaacatttacatttgacgtatcaaccaaatgcaatttgtgaactttatttgaatccttgattcagacaagtcaactattttttttaaaagggcaatggggaaattttaatatacactgaagatttgatattaaaaattatattttaaacaaaactatggtatgttgtttaagcaagtacgtatccttcataaatatactcaactatttatagatcaaatggtattatgtctggggtttgcttcaaacctatctagtggtggtatgagggtatgtggtacagatgaaataggagcatgagcctaatgactgctgattacagaatgggtatatgaagcctcatgatattagtctcttggtttttgtgtgttttggttttttaggaaacatttacaattttttgtaatgagaagtttaaaatttaagaagtggggaatagggaatggagaaagggaggaaggaaggagaaatgagggagggaagaaagacaatcatgacacaattaatattccccaccaacaagcattaacaacataatgcaaattatttttgataggaatttatgtaaaaagaaatgaaactaaaactagaaaacaatatctgtggttctcagcagaacgaacttacaagttgttactcagaattataccagagtcaaagaaatctgatcatgcaaaccaccagataacaataaagttcacttgtcattggaatgtttaaaaaaaaaaaaaaaaaaaaagtaggacacacacctgaagtcaatacatctgcaataatggcagaaattttaaatacagaagttcaagccaaatattgtgatctagcattctccaggactaggtagtttttatgaaaacttgaaaaaaaaaagtacaacaacagaactataatattcaaacttaaaaacattaaaaaacccatccttgttaaagtatgaactcctatgaggatagatacacttgtatcccagctcaggagccaggctttttatttttcagtagtcatgcctgcctttgttgctacctattggaaggttattggagaacggtctgaagctccatcagcaggcagcggtgggatgggagagaagcagcaaatctagcaggcttttggtccaaaaagcaaaatggctgagaccaaaataatgatacacctttttttttttttttgagatggagtcttactctgtctctcaggctggagtgcagtggtgcgatttcagctcactgcaacttctgcctcctggattcaagcgattctcctgcctcagtctcccgactagctgggattacaggcatgcaccaccacgcccggcgaatattttgatattgttggtagtgacggggtttcactgtattagccaggatgggctagatctcctgacctcataatctgcccgcctcagcctcccaaagtgctgggattacaggcgtgagccaccgcgcccggcctaatgacacccctttttaaaatgcaggtgttaaggccagccttggctggagcacagcaggtgcccagagccatgccttgccttctccaatatttcagttctaatatattctagcagctaaggaagaaaggatgttctgtcactgaactactagatacagacccaacaggggttgatagtaatagatgggtttgggattggaagcaacctgggagaataggttggtcaagaaatcaaaaatcaccctgaatacagcccagagaaaattggtttgtcctgcagatttctcagagggaggaattataaggagaggagaggctagggccctgctggagaggctggattgatccttagagctgcttctagccaagaatcctgaatacgggtgatttcagtgttttaatagtctccagccacctgggaacaagaatatccgggaaactccacagaacatggagagccaagcacttggaaatagaacatctgtaaatgagttttcctattttaattccaacattctctctcctctctcccacacatagaaatggttttggctgtttgcattctctccttgctattccctctctttcataagcgcgcgggcgtgcgcgcacacacacacgttctctctccctctcgctttctcccctctcacctcttttctggcttgccagacttgcttctccagttcctcaggtatcattttacctctaagggacaaagatttgagactttcagttatgtttagtaattaacagataatgatactgctttataaaccatataaacttttccctccacccaccaggcttccagatcctgttcccattaccttccatctgtttccacaaagcaaacattctcagtgccaatcccaagaaaagaggctgccttcttcatagagtaatgacactgaattcaaagggacagtggggaagggggagacatgaaaacatagcacaaaaaaagcattgcttattatcaaaggtagatgaaagtatggctgagcacaatctttgggacattattgcataaaaaagtaatttaattgagctccttagcatagtggttgagaacattcactttggggtcagagaaaccaggattgaacgtcaagtattccagttacagctatggaatcttgaacaaataatatacactctccaagcctcaatttcctactctttaaagggatcatgccaataatgcctactccatctgctcgtgctagacaaaaatgggttaataatatatgtagagggcttagcacagagcctggcacatggaacaaactaggacaccggaggctgttgttttccatcccattgagaaaagtaaagtttctcctgatgctcctcataagacttagtattaatggaaacttagaatctagtccactgctgacttgaaaccctctaaggagagggcaagactctatctcaaagattgcaatcacaggctagagaggaatctaattatttcctagagcaaacaatgagttataagtgctgatcagacacttgaccaatcttgtttaatactgaacacaagactgaaacacccaagaatgtggctaaaatcctaagaacaaaagtaataatagacaaactactttactcagctatggcatgagtgaggctaatagatgaatatggaattaagtctggtctatttcttattgataaatagtagtgtgtgctttacattattgggccttctctatactacatgaagcccataaaataattagcatgcaaacattggatatgtcgctcttcatacattagtgaggacaggtggtcaattaattctttttcttgccagaaaaatgaaggtgctaaaggacattattgtaccaaaaaaaaatcttagtaatttgtaggtatgaatacattaaaagagtagtcatgccttcacacttcacttgatatattccctcaaatgtggtaatttttttccttttgtcaggagagttttattgggagctctttttttaactctgtaaaaataaatgcagaagtaacatcaggaaaaatgaaaccgttctaaataattaatttccaaatatcaaataggacatgtccaaaatgcctgtaggatgcttttatttcaggttgttaaaagaccatatgcatattgaagagtaataatgtacaagaaagtgtaattaattctctacttgctccaccagcctatgctggctggcggtaacctgcctgccatagctaaggtgacatagctcgggtgaattatttctcaccagagagttgagctctggcaaccaaacagctattgatttcataatgataaatgctagcctaccccactgacatctaactataaggaaaagcacaatgctctccccctgagaaatagcaaaatatctccaaccaatgaatctgctgaataaaaatcttgtaatcagaattagaaaagtggagctatctttaagtacctgagggcaaaatacaacccaatgtcaatctgagatagatagatcaaaaaaaaaaaaaacaaaaaactgcaaaactgaagtttaaacatctgaaagcttcagagaaggaagagccctggaagggagaacaaaagaaggtgatgcttcagacatgctgagtagtttcaaggaaaggaaaaacctagaaggctggaattcagaagtaacaactgcatttagaaacaaacagtggcgtttctatcattggcaaaagataagtcagttgttctaagactcaacctccccacaggtttcataaatctacagaagacgaaaaaaactctcagcgggtgttcatttctataaagataaaatagcaagtgcctacatgaaagagagcattgagctggagttttactttctggctcccacaaggatttttttctatgaccttgagcttctcaatgaactgctgctttctcctcaatgtacactgtgccctggacacctggactccagtgctgactaatttgattctcaagttagctggtagagagaacggggtatataaatgtacactgtgccctggactccagtgctgactaatttgattctcaagttagctggtagaatggggtacataaatgttacattttagagaatgaacaaaaagagtgtccaagggatgtctctaacaacacacagctggtttaattccccaagaggccagaaccagaagccagatagactgaacccagcctcatgctctgcaggatgtcctacgaagcacctgcttgcccgtggagaagacctgcaatcacatcccatcgcaactcaacctcagccctcacccagcaatcaggaggaagagaaagaggcacctagagtgcaaaatttagaggcatgaccctgagacacaccctacataactcacttgcctctcctggcctaagccctgctagagaggagctagcccattgattactggcctgggaggtaagggtttctttttaccctactttttagtggcaaatcataattactgctttatgctaattccagaagtgatctgaaatatacaggaactttacaaacacgggatttctatacacccaagaaatttatatcaaagtgcaaaccaagacatagatttattacttttatttctccaaaagtccccttctcttagatgcctatttagcactagagaggcaaccttggatatattgacagtgcaaaggtctttgtcatgaccttgcaggtctttatcaatagtaaaattacaataaaagcctaacacatgcaaaaacaccttcagtggtgggtacgtatattctgcactggatggtgcaagatagaaatggagtaatttggggtagcacaaaaactggaaaagactacctaatataacagtactgggccatggaccaaacccttaaaagaaaataagggaggtatagcaaaaagactaacgcagagtttaagactgtttactaaacacaaccttctttaattctttaatgaaatagatggatttgttgtaataagtagtaaaggcagtcaataaaatatgaattaaaatagtgcaaatgctataacctgactctttgagtagggaaaggaatgagctgcaaagtagtgtcttgaccaatggagtcaaaatataaattcaaggctacagtgtgctcgaagtgatgtaatttttctgtggaattcacacctagttcttggtttttctggctccagcttctgctgacatgttagccaaggcatatattttgcctctctttggaaagtttttaaaaaccacttagttatggtttcacaactacataaggtttcaatttcttttcactcccaattcataagccccacctgttactgatctttcccaggcgtaatctctgttctaggcttccacgtaatatcttttccctttccatggtaattattccagaaaagaactccagcaagctttaaaccaaatgaagaatgaaaaaggcaaaagtaaaaaacctgagctgataacctgggcgctatttaatcagctttcccaagcttggaaatagcagtttgaatgcagaagagactctgcatttattatccactggggtccctcacattgaaacatccagggctgaagcatgaagaaggaaactctattcaataacaatcccaaataatcaagtactttttcccagctgtccacattaccaaacattcttctcttggtacagaaggaatgacttatgaacaagagcctcgaatggctgagttaagaatctcaggctagatgattcctcccagttgcctcctgtcactcaactcccactttgcacttagtgctgaaagatccagagcaaaggtcagagtgagaggaaaacatgagagtggtcatattttctcctactgaggagaaattagtgcacaatttgtccttttgcaataagaaactaacttttgtatttagaagaaaatgatagatacaggaaagcctagctggaaataacagactctcagttttttattttgtccacttcatgttagtggcaggatacctgatattatctcagaaggtaagaagctaaactcattctgccaagaacctgggtgatgaagcagtggtagaatagacggaggcatccactagaatcacacaagaataggaaagggaaaaaatctcttccaataaaggctgcacttaagccgtgccatctacttctgcccaccttgttgcagctggaacattctcctagtaacaattatagttaatattttaaaaaatctattatatcccagatgacactttacatgcaattactcatttaacatttgccaaaactcactaatcagcaactactgcgtggttgctggattgttctaatggttccagttgttctctgttccgtgtattcaaatcctttgcctggtgactttacagcaagtccccccatgaggttgtggggtctttcttcccacatcttgggtctgggctcacagatgggattttgccaagaaaatgaggcagaagtaacaatggccagttctgaggctaagactcaagaggcctgatgtgttgccatgcccttttatacctgcaccattgccatgaggacacacctagactgacctgatggagaatgagagacataaggagcagagaggcatcactggaatcatcccagctgagccactcgtagatgggccatcagccagccaacccctagacatggaagggggcccagccaagagcagcaaatctgcccagctatcttgagacttataagtgataatatacagttatagaatgataactctatatttggggtgatttgttggttataaaagctaagtgataaacttatttttacaaatttaggaaactgaggcacaaagaaattaactcactcaaggttactcagacagtaagtgacagaggcagggactgaatccaggcagcctaactcaaagcctatgcgcttatctactgtctgacccacctactttagtggagagtaaaataagagatggagaactgtggcaatatctgtgtgtgtgtgtgtgtgtgtgttttcattgttactgtatatctttcttttccctggaaaagtaagatacacatcccttatattagccaatcaaagcaatcattttaaaaggaaatgtgagtagaagacatagctgagatccacagtgttcatctaagtactaacaaataagacattcaaaaaaagagattcacagagatagcactttcaaattaaatattcttttcttaaaatgttgttacagactataaattttaaataaaggtaattatacaaaattggaccaggcgttacaacatcaaactcgttagaatttactttggaatgaaatactatgttatactgcagcatattagtcacatgggtataggacaaaatcacatcaggaatcttcaaacaaagccctcttaaatatgctttctcagaaaatctatattcaataccaaaaataatttttacctctgcagatgtgaaaaggattaatcttggcgaaccagacagccccttttccttaatatcaggacaatatttgtatctagctaaattcattgcatacatattggacactgagccacctgcaaaaacaaaattaaaatggcatatttatagcatgaagttatagctcgcaaaatgctgaatacagtggaaagcatgaatggccatgactgctctagtctaatgaaaaatcaccgtgaaaagcacatgaacaccgacctccctgctcccattattctgaatattttattacataccctaatctctaattctagaacttttattcttagaagataaattttggtttattcccatgacaggctttttttcaaaccaaaagtctcaatctgtgagctctggacttagggcctttacctaggtctccatagttaatattctttgtcacctaatcaataaaattgaaataatatttgttggtctctggctacaaaaaaggactacaggataaacaaatgtaattcagaaatcttctcaagtaaaatttgattttaaaatttagaggacttacagcccttccaaacttccagcatcaaatcgattcatttgtgttagatataaatcctaaactgtaggcacctcattcattaagtatgtatgtcatctatttagcattaatacaaaatattatcactctggagaaaggcataagctagattctcagcaagtagaattattaatatccaactttttgtcgtgtataaatctgcaaggagttgttcctcatggataaatttttacgtggttgtattggaaggttgatatcaataactaattgtactcacctgggttaaatattccatccccttctttccagccaataaattcaatcattttcttcagaaccgcttcttccactaacagaaacactggggacacctcatacgtataactagatagatataaaaaacacttcacttctatgactagagtcaaaacattcctttggtgtcccaagaaatgcacagagttctattaaaccaagtggctgctgaagtgtaggcagtctttggaaatttatccattgaaaatagagaattactccatcagtgacagcactagtcatggttagataaatgccaatagcttgtggcctcagggatctgcaagttgctgcagcagtctttcgagaaaaacctcaattccgtgaggagcaataaaggcaatgcatttgcgtgctatgtattagccatgagcagtggccatttcactctgtggatgcttggaacactgacttggatgctgttgatggtcaaagaaaatccattgtcatggtaaccaagttttatcagattactgccatgagtatgctaacagtcccctctagatattctaagtggagactactccacctgaaccagggcttcctctactacactctctgtgtctgtataaatgaggagtgttttgtgagacatctcttatgtgataattttactgcaaagcactacccaaatcccttgtcaatgaaggatgtgttgctccgggctggaacgctgttgtcagagcattgatgttttagcccctttagagattgccttggctgcagggagctacctcctccagggtcacacccattcttgtggtggtctacacctgataactgctggagatgtaaaggcctagccgtctgggcctaactccagacccctcttgaagggccactgtagttccagagatctccgagcgtcagccaagattgtcatggagcctgcgtggcaatttgactcctatacttgccctttcttgcatcctcctcctccttccccaggtcgtcactcatgttgatcccaagggtactccttaataaacgtcccactcactaaacaccatctagagcagcattcttgggaacccacattgtaacagtcaccatgccttgtttgatatttattttctctctccagacaacttgagggtgactacatatctatgatctccttttcaattgagggattacattaaattgtatctgaataaatgtgtactctaaatatgtaagttaagcagacacatttagatttatagtcacagaatttaatgcaattattttaacatctggaaaggaaaactttggattgaggcataaaagctggtcacctactatgtatcacctactatttatcacctacatatgtgtcaactctacagatgttatgccatcttaaaaataagatagattcagctgggtgcagtggctcatgcctgtaatctcagcactttgggagttcaaggcgggtggatcataggtcaggagttcaagaccagcctggccaagatggtgaaaccccatctctattaaaaatacaaaaattagccacgcatggtggtaggggcctgtaatcccagctactcaggagactgaggcagagaattacttgaacctgggaggcggaggttgcagtaagctgagatcatgccactgcactccagtctgggcaacagagcaagatttcatctccaaaacaaaatttaaaaagatagattctgtttcttaaccacgttatgaagccagtgtacatacacaaaaagtatgaaaaaagcatatatttatgtgaacctacaaatatatataaaatagttactttcataataaaaaaaaaaagtatttagcctgtctttgaaaactggctcaattataaacctaggaatcagcctggagggtggaggaaaagataagatagaacacactcatgggttggcatattttgagtggatggtttagcttagcagcaatttaacactcctttaatctgaaatatttagagatttttgaacttagatgaagagttagaaaacctgggatatacaagaaaagattgaaaaaggtgtgtaattttactgtctctcctgacttaccctcactgtaactgattgtaacctggtatctgctgtcatcactccatcaaaacctccctaaagttgccagtgacgtccatgtagctaatccagtggatgctgtttaggctcttagttgaatattcaacaacatgtgacactaggcatgctctcctcgtggctgccacagctagccttttgtttttttccttctattctcgccattgtaagctgaccctgttcctcctaaccattaaatgttagatgtcctcaaggcccagtattgagccgccttctctccccactctatactctgtcccctaggcagtggttctttatcttggcttcccattgaaatcacttgttgaactttctaaatatatcaatgcatggggcacagccacagaatttcagatttaattggcctgggttggcacccaggtatcaatacatttttataaaattctcaagtgattttcatgaatagtcagggtggtgaatcactgacataggaagtctcatccacgtccaccatttcaattaccataatttcactgataattcttaagtttatacctttcatatagacatcagaattccaagcccatatatttctcagcttagttcctatgcattcttggatattttaaagtcactgcaaactcaaatgcccacaactgaaaatgtaatgcttgctcttgcctccttcaccatatacttgaaaaccagttccctctcccagtgcttatttctatgaatgatatgaccatgaacctagctatgaaagccagaaacccaggcattgtcccaggagtcttctcccttttactgttattttcaagctgtgtatcccatcctttctgttttattttttgaactcattctttcccgctctattcctatctcttctctccaagtccgagctactttcctctctcacccgactaaagtaatgccctcctaacgggtcccctccaacctatttatatttttagagattttttcagtaagaaaatggcacctagtgacttagaaaccttcaatggctttttgttacatttagaaagactcataaacatggtcacctgggccctatatgtctggcttctatctctctctctctttctctagtcttattctccactacagtcctgtaactctctcagctgtacccacactggcctttcagttcatagagaatggcatgctgtgtcctgccacagggcctttatacatgtcattctgtctatttagaactcatccctcaccttatcacctaataacacttattcagtgtcaactgtcatctttgcagagcacactctcctgagcttccaactaggaaaaattgtcccattcatatgaatacttagaacactttgtacttttccttcagatgagagtttggattttacattaatttttgtggaccacttcgattagcatttttataccagatattatgctccatgagggcagagtcaaggtttatttgtgttcaatatgtctctccatcacttagcacagaaaatgacttttcatgcaagaacaaataaaaaattgcctaatcaattttctcatctgttaaatctcattaaatgagataataatgactgccttttccatctcacggtaccactatttaaatcaaatagctatttgaatactgataagtatcataaaactattccattatttgcgatggcactatgcaaaagaaaccattaaatagagatttttgaaataaaatttcatctacttaaagtctctaatccacgtttggtgtgaaatttctatagcatggcacttacacacttggattcaatgcttcggtcataaatcgggccaccaaggagtaataatcaagtccagcatacaattggttgaaaaatcttgggtggtctgtaaatttaaaatggagtattcatctatgcagcaataaaaaaaaaaactactgatacagcattaacataaatgaatctttcagaaaatgaaagcagacacacacagaagagttatatataacgtaattccatttatatgacattcaaaaccaacaaagctatctaaggagatggcggttagaattctaggtactttgtggaaagaattatggattgggaagggacttcagagagcctctggagtgctagaattggtctatatctagatccaggtgatggctccatatgcacagctacgtacaaattcatcatgccgagcaattaagatttgtgcactttactgaatataaattatacctcattctaaaaaaatccaaaacaggatcatgcgcaaggaaaaacatgttgaagacacatcgtagagccctttctactggtcagtgtttgtaagtaaaatctgagttgtcttttaagagctttgatttacttgctcctcttttttacaacccagacccaaaccagaacccttaaataattatttgaacactatttgtccaaggatcacagggtactgcctttttttctgaaaatatcaatattaacttctcacttcatatacatttcactcacagcagagttcaccccaggctatggcactgagcagccttttcatttttcagattggacccatgcgactggcagtatatagatggagtaagatgtgactcactatgcggcttacatacacttctgattcaatttgcttgaaatgcaatcgcctttaagagacaaacaatggcttgttccaattttaatttttttcccccctcctataaaaggtctcataaaggttcttggctttacaccatgtgaataatcacaccatacacccggctaactggcttggcattctcaatctcaggaagctcagcatgacagaacaaagaggcaggaggtctatttctacatttgagtatttgggaatcatttaatttggtgacctctcattacaacttacagcatctggttttagtttattttagttttttttttctctctttaggggttcaataaaaaaacaagtctcaaaagaaaatgtcttttcagcttaaacatggaaaacttcctctgatctggcaaaaaaaaaaaaaacggcattgctacaagtaattttaataagttttttttagttctgtgttaatttatgattgatttccatggtaacatggaaaatatccagtaaactgaaaaatctactgcattaaatgtcattctgcacttttgacatgcactggtaataataagatacatatctctgcttttgaaatgctaactgagtttttgatacatacaccagactttcccaaaggaatataatccaattatttttagccagaattttactatgttctttccactaaacttagtccagtgtcagaatttacaaagtaatgcctgtatgatcttaagcgctagatacctttacattacactgacaaatattttggaagattattctcccatttttgaaacttgttcgctggatgaacaggatattaacaggtaagctagaatggtgcctcagtgtaagattgacatcacattactgcacgtacaaagttcacagtagttatgacatcactgtgaaataatctcatcaaaaacttggaatgtattcatttgtcttatatccatctaagggcttttatttatttgtttttggtacagccagatttgatcaaatagtttggcaattaccaactgccaagagttaatcagtgtcttccaaataaatcatttctgtttatattaaagataccttttgaacactttttttgcatactctgggccatcaagatttaaaatcccttaacaaatttatataatcaaaatactatttgccagtttggtctaacacaagaaatgataagtagcagtgataatatatgatcttgattacaactagtatgtgggggttggcaaggagaagaggatatttacatacaaacactaacacctacagttttcctgtcaacttatctttggccttggcaatgaatctggattagggattaaagggaccattgcaaaaacatcagaactactaattttttgatccagatttctcgttccataagcattgctatactcagctttgagaggctttgcaaacataagaacttgtcagaggtacagatcaaggaagtaaattaaagttcttactagttttgacactgtagtgtatgacatcccgacagagttccaatagtttatggggtggctcgcctgagtctctcatctccaaatcaagaagctgtttcagttgttcaggaggcctccattcacacacctggagattcaaccacaacacaaattgagtatccaccatagccaggtattgagaggatgttacaaacgtggactctaccattacaaagcttctgggcagcgggtgatttaaacatgcaactatagttcagacgaaaagaactattacagtaatgtagatgttgatgggaccaatgaggggcgccatcttagatttgcaaggtaaagggagatttcctagtgatactgatatctaagttgttacatagaataagagtagagcgaatcaaagtttagggaggttctagatggaagtgacagaagtaacaaagatcaaaagtaaaattaaaaaagataaaaaattcggatcctatggcacatctgtaaaatcaagtacatttggtatggcttgaacatggatttttgagaaatggagaggaaataaacaggaatgctgaagcagtttttctctctgtgtgtacccggccctatgcagtctgctatcgacctagcagccagaatgatcctcctaaacttaagccatggccattcctctattcaaatacatctgatggctccctgtttctttcaaagtaaaacctgaggtccttacaaagatataaaatgatcctttacgatctgcttctcctggtttcatttttcctctagtctcatctgggactactttccttctggctaactctgctcttgacaccctagcctccttactgttcttaactacacgagggaggttcccatactggggtctctgcactgtgtgtgccctctgcctagaatgtttttcaaaatatcctcataactgaatccctcacttatttcaaatctttgctcagaagtcactttctcaacaacagcaatcctgactcccttacctaaaattaaaatctacccattacctctatcaatcccctttaacatttcctactattcctttttacaaagcacttatcaccctctaatatactgttacttattgtatcctacataatctccatacaagcagatctgtctttttgctcactgatcccaagtgactaccacagagtctgcacataatagtgctcaataaagatgtgttgaataactgaatggataaacagagataagcaaggctcagatcataatgggctttatgtgacatattatagagtttggacttggctctaaggaagccattaaaatgtttaggacaggggaatgaaaggatcatatttgtgtttggggcaatagctttagttgttatgtggaggttcccaataaaatttgaaataagaggttgctgtaataagccaggcaagagaaggtgatgatctggatgacagtcaatgctgtattaaatatgtagtttttagagatatttaaaatgcagaatcactagaacctggaaatcagttagattttgagggtgagatgaatgagccaaggatcatcccaaggtttccagcttggacacaagattggatggcagcaatggggatagcaggagaaggatctggttggggtggtgtggggatgatgaggtgaaagcaggtttaggacaaggcaccttcagaatatccaaaagctgtatagcagttgatctgaggctcttgcaaaagattgaggacagagttccagggagacactatgataatgtaacagtagttgatgtggctcagagagaacctacagcagggcagaaaggagcagaatctttctgggcatcaccaacacttatgaatgggcataggaagaggagcctgactgtcctgtggagggcacgccagagaggtagggagaatcctaagagtttagtgctaccataaccaagaagaaagaatgctttaggaaggagatgttcaccactgtcaaatactgctaagaagccgaattagatagacttgaagtgctcatggaatttatcaacaaggaggtgttcttggcaagagcagcttgacttagagaggtgggggcggaggccagattgctttgaagtgagaatgtaggaggtgaagaaacggagggagggaatatagataatctctaaaaattttggctgtggaggggaggagagagatagggaagtagccagggagtgaaaagactgggaggctggggggaagcaggaggaaataccaagttgtgcaagtagtatgaaattaaactatgatgctataaccatgacaggcagaggtaaattggaaatgcctgagacaatcaaaaggaatgactactggcgcattcaacaacatggatgaatctcaaatgcattttgttgagggtaaacagcaagactcaaagcctactaaaatactattccatcaacatgacattctagaaaaggcaagtatcatagggaaagaaaatcagtggtttcaggggctagaggaaaggggaggattgattagagaggggcacagaatagttatataactattctaatgaagatatagaacagttccatcatatcgtagtaatagttatgacttctgaaactcatagaaccacaccccaaaggggtaaattttactgaatataaattataattcagttttaaaaactggctgatgaagaattttctgctaatgaaactagcagtgatcactgcaccaagcttgggtatatatctgcaggctaccttttaatggtgctctgttggatctcaaacaaggtaggctaagttagtggtatcaaaacttcacctccttcccccaactctagcatagctttcaatccaacttcccgtgggtagcctgcacatctattacattgtaattgacttgtggttccttaattgacaacttaggatcttaagatcttccgtttctcatcttattagtcccctgtgtgagctctttttttctgggcaaaaaatggtccccttgctgtgttaagtacatcttgtccttttgcaatgctctttccattattgaccttcctgctttcttcctccagaaatgagtaccctaacgccaaactttctcttcccctgccactgccccccaaaattctcacttgccctttacttacattccacatctgagctcaaagtactcgctcctgagtgaaatcccaaaaatctgttccagtctcaaagcatttatcacatccttactgggaccccccgctgccttttctaatgaaaacatatccttccaattagattataaattctgttcagagctgggcctttatattgtttttctttatattctctagggctgaatataaagctttagtcatagctaatactcagttaatatttaatgactgaataaaggccaataaaaaaaactgccagaggagcagtgtactccaatgtaaagcagatccaaagtatttcacaagtacagagaagaacagaaattatataattataaatatgctatctgggcaaataccaaacaccatcaggattttgccttgaacataacttccaaattcatgcatcaatctattttcctactagttttccgaaaggcatgtgatcaaaaattcagaataaatatcacctcactttcaaaatcttttaaaaatgatacttatttctaactaatataactggaataaaaatctcttccttacatccatttgttgataatccacctccaacatgaaaaccaatgtgataaaggttgattcggtaattttaagaggcatatggaatagttaagagtgcagattgtgaagtgatactgcctggattttagtcccggctctgatacttgtgtataatcttgggcaacatatttgacctctttgtgcctgactttctttcccagctctaaaatgggggtaatagtatctgccttttagtgcttttgaaaggattaaatgcataaggagtagtccttagaacatagtaagtattcttaagagtagatgtcattagcggcggttctaatatcaatttgaattgaatttgagcctgaatttgaaatctacaaccaataattggtaccagaaaggagtcagacttaaccacctaagatttctaggctaaatttagacaagctcttcataaggaccttaagataaatttaaaatgtttttacatccttttccatcttttgcttgattttcatgaacaacatgaagagtgtgcactagaaaatggggagcaaagagcattagagagttgcgtaagtgagattagcaggttacttatctatgttattatctagggtgcaggaagtttcatccctgtgcttcatgtccttatgtgattaagctctagggtctcagccaatcttcccacgaatgatgactggcagagtaaggaggcaacccttcaaggacagcaggaattgcctgaaggacagcctacacttttatatctggacatccttttgagacaaaggcatagaagaaataaaaacttggccttcccatttgctttctattcagccatactgatttggggaacatctatctttcccatttctgcaatttcttacaggttttaatttttaccttctcattgacatctgtagctttcaaaaccacctcttccattattagcctacaggcctcttcaacaaatttttctccagcttttgcatctgttgtaggaccattcagcacaaccccatccacaagaacagcattcttcttacttggaatcatctcttgttgatcaatatctcctggaagcaagcaaacaaattgtgtttgagagataatctaattacaccacataacaaagcacgggacaaaatgcatcactatcccagcttcagatggcacatcttttaatacatgaaggcatcatttgaggtgttgagctgacaatttcttatgacacaccatggtatgatagttaaggaaaattttacaaagaaagctcacaatttatggattaagtaaatctaccttattatatatgtcactctgtactgggctgagttagtcatggagtatatgacctcctaattcagtgcaatttcaggtctgatggggaaaggtaccattcacatacaattcccatgctagatggtgtttgaagttgaaaaaaaatgttttccataattagaatgctgattcacaaagcaactgcccctaggagagagtaaatattcattggcatttctacacatgcacaaatgattaagtgatttccctaatcctttcctcagagacagccgtcactctaccacaggagagttcgagatggaggaacaggagttaggcatttggagaaaaggatgaggagaaagcccttcagattttatctagaattaacaccacctctatgctgtcagtatccccttaaaatataaataatacaatatcatacaatagtggttttaactttcagaatctggtgcattgagtagacaaatcctataattaaggtagcaagcttttagcttcatttccttgtacaaagtcctttagcatttctgagccctaggatgaagctttgggcagagataaagaaaatagcacctgtccttacacaatttattttcctcaaggaagagataatgcatttccagattgaaataacaaattgaattttatgaagatccatcttgtattggatgtatctgaattatcgaagtatctaagagggatcacctggtcaccttcaacaaagtgaatattgaaatcttcaaaggcaaagagctagctgcttccttcttgaactagcacacatgaatatgtttctccaaatgtatgtcccctcttcctttaggtgcgtgtagctgttggccaatttctctatgaactagattacaaagtttacacaaaagttgtatttttcattcttgcagcatcttgtttagcatcagggagtgtggaggagaccaagaaatgtaaatgtaacctattttactcattcttgcagtcacctttcaaacacatgtacaaagagatcttcgtaaacataagcccatgtctgtttcacacacacacacacacacacacacactctctctcacactcacacactcactctctctctctctcgtaatttgtcagggataccatattttcccttttaacaaatcattccttaaaaagcagcagcgatataaacttgtcactaatcttaattgtatgttttaattctatgtttaaatgttcctctatattacagatactgctttgtccctgagagcccctaatttttcagccattttctacatagagagtgatagaggaaagaaagcagcacaatgatttgttaagcctgtattaaatgcctttaaacttttcaaccttgcagcttaagcacaggcaaaaggatgagacggaacatgttcaagactgtacatgccgatcattgactaaatgttaaaagtcaacatgaaaatctatatctgagaagaaaggttactgcctacccaaaatagccctccacaaaaataattctggcaactcaatccagatattcaaccaatttccagcacaagctttgattcaatcacattctctttttctaatcagtatgtttctccaccttataatgtatatgttcatttaattgttgaaattgacagaaacaatttttaaagtacttttcagcactgtacctcacacagtatcttctattttaaatccatcttaaatattccaatggtctacaaaaaaaaacccttctaaatatatgtatttcaaacacttctactcttagtgagggctctaacaatattaacatttatcatttcttagactccaccttctcctcaaagttaaacgttctgataaaattctatggctccacaaacactttaattctgttattggcaaacacaaatggtgtctatgaaagcaccagataaaaatgttacaggaagatcccccagttggggaaagatggaatctgcagcaaaggatcaatcttttgtcctctcactgaaaaagaagccatttagagctccaatgaagaatgttagttccagccctcactttcacatgaaaggaaacatttaacatggtttagggccaaatattgaaaccctagaattgagcttttagatggaaatgctctgcacctgaaggtactttcctctcctcccaaattttttaggccctaaaaatagagtaagaaagagagcaattattccaggaactctggttatgtgagtaggcagtgctattattaagcacgcagaaaaagttaagattttttttttttaacctcattagtaggatttcaagcttttattacccagggaataacagcagctctatagcctgctcattatgtttctctttctctttctctcaccccgttccgtgtgtgtgtgtgtcacacacatacacacacacgataaaataaaaaatgtcaacacccactcgtaaccagaatagcagtgaaatttaaattatcactgtcttcacaccaatgaattaaaaaaaatccccataattcacacaattatctaggagaaaatactgtaaaaatctatacagaaatgggtctagatgatgtcttttctttgatagacacattttatttttatagccagatgtgataatgtgcctctttctcccccagcatttgtccaggtcagaaaaggccctctggagactctagaataggtcaagctgtggtctcctgaggaaggatattcagaattttcattctaactgctagagtttatagtggctcttaatgaagtctttcaatttgaggaatcttccatgaagactatacctaggatatgactgcttttcatcacccccacttttactaccttagttcaaaccaccttcaaatgctagggttactgcagtagcctcccaactaaccacctttcttcgccctttcccctcattttctgtggactattctcaacacagtacctcctacgttcccttgaaaagataaatctgatcacatgatgactcctgcttaaagcattcaatgactcctcatcaaactaaaagctaacatccttctaataacctcaaaggcccatttccctattatctcatggacctcaaacctcatcttgttactgtcctccaagctcacacagctctatcatctgtggtctttttcaccatgctgattctttccttaaacatcagtttctcagggaggccttccttgactacctcatatgaagctgcaatcacctctctgcactactttctctgctttgattccagagcagtgactaccatgggatatataatacccacgtaaattaatatatatatatatatatatattttttaatatctgtctctccaataaagaaaggttaagctctgtgagagcatgagtttgtgtctgtcggtttcactgttatttccatagcacccagaaagtgcctggcagtttgcaggagtttgatgaacattttttgactattaaatgaaagttcttcctggttcctttaaccaaccagtgataatgtcttcctcccttgagatgccgtcgcaggttgtctgtatgcctttctgaactgatagcacagcaaggagactggacctgattaagcaggggaaacctttggctggggatgcaatagacatagaacacagttaatgggctagagaagagacagtggaggctgaaagaaccccgggaacagtcagcaaggcaaacctgggtttctgttctcttcattattaaaggaaactggctgcaagaccctccctttcctttcctctcgattcttgttaccgcagccactttttctgtgcccttattttatggtagtcatttgacttctagaagtcagcgcacggaccacaggctcactccagaaaccacacttccaaatttgaaagccagtcaattcctaaagactccaacttctgcattttttaccaattcctcccctccatagcttccaaaattctgtataggatcaacttttgctttgttcagagagatacattgttctcccttgattaacaaacaattcagcttcaaatattgtttcagattttgagagatagcctcttcctctgacatagaattaagtgaattaatacagataatgccttaaaacagtgtctggtacatattgggaactaataaaagttagctaacagtagtaaataacaacaatatttattcaatacataaatgacaccaggcacggtggttcacacctgcaatctcagcactttgggaggctgaggcaggcagatcacttgtggccaggagtttgagaccagcctggcaaacatgatgaagccctgtctctaccaaaaaatacaaaaattagccaggcatagtggcacacacctgtagtcccagctacttgggaggctaaggcacaagaatcagttgaacctgggaggagaaggttgcagtgagccaagatcataccactgcacttcagcctgggcaaaagagtgagaccgtgtctcaaaaataatagtaataatagtacataaatgcataaaggaaacttgcatgtgatggtaaactgtgacaatagaaaggggaggtcttctcagattgatcaaatgaccagggtaataaactctagaccaagtggctggtgagttatcacctctggaagggcaggaagagaggaccacagtggttgggggttcccctgtgagaagagcagagcttcctccaccatgttcagaacgcaagatggtagctgagtagttcagcccacactgggtaggcagcttcctagaccttctgccttgttgctttccaccttgccctgtgtttacctgtgtagaggttttatttcttataccagattataaacctacagaaaaaagccatgtctcattttactgaccattccagaaacagagttcagcaactggctttcaatagctctctgaggactgactggctgactgtatatttactttggaagtcatcttatctaaccttttcatacaatccaataattccctccacaacctgtggcccagacatgagaagagctgacttctagtcccacttgatcactcccaagttctctgatcctgaaataatacaacctctctgtgcctgttttctcatctataaaaattggagcccatctgaggaaagtgatctgctagcttccaaaaaattcctgggaaaattaatgaagattcagaatccggattcctacccaaaaggattctatgtggagcctaggatctaaaatttcaggaagtattcccatttatattaataatactgaaatacactaatatgcagtgggtatggaaatggctattctgggtgacctctaaagtccttccaaaacttcaaatcttcagttgtctagcccctctctctactcctttaataattatgtatttatcttaaatatgcatcaatctccgagaagttaagaactgaaaaattacaatactacatatatatatatatatacacatatatgtatatatatacatatatatgagagagagtacttactatgtgccaggccctgttctaaaagttttacagatttaacaaatgtaattgtaacaaactcgttactcagtttttcagatgagaaaactgaggcacagagagggtttaattcagttgaattgccttgcccaaggtcacagaactagtgagtagtgaaactgaggtaaatttttactgagtactaaatatttgctgaagttctatgaaggatcaatgagattctgctttatgggtatctaccattagcaaggcatcattagggagttaataatgacagcaagacgaattactgtacttgggtaattgggggcctcaaagtgctgaataacagcaatagaagataataagtgtcaagtagtgccacgtggaagacaccaataaaatatgctgaatgtaaacaatgtagacatttgaaattaagggttgtggttataggagaagctgaggtgtcagggaagatttctgaaattagaagacctgccttctctttgaacatatgcactaataaataatatacttttaaaacctcatcacttctgaagtaacaacttcattgacagctgcccagacctcccaccttgtcactttcacaatggtcacaaaacttttcctgagagtgactccaaatatgcatttctgtcatgtctataggcttttatagtaaatgagttaagtacatggaatttttcttccacaggactgtaatccaaatatgtgaagactttttatcaatgcttttaattgtcagttaaaactgctctcagttttttcagtggtttccgatagtccgtggtctgtagtctggaccaatttgcttttatcttataaaatgaggcatctcacaaaattccaggtgtgatctcaccaactctcaacatggtgaactcatatttcccatgctctggtcaccatgatttcattaataaagcttttattgacaccatagtggattccaaagcctgagctttaagtcctggcccaaattctaactctgcttctgtgaccttactcatgttatttaacctctgtgtgatccgtatttcttttctggcaaatggggaaaacagctatgagtcattgaaagggtcaaatgtggtaatgtgtgcaaggtactaaacaaagtgccagggacagtgtaaagaactcaataaatgataactattaatgagtttcagtctatatgaactctcttttggcactcacgttacactgttggctcaggtagaagtcataattagcagtcttagggttttgtcagaaagtctgccagtaaaagccaagtttcccatccaagtctctttaattgttcagagcaagttagcaatagaaaaataatgtttgctttcaaaggacagaaatgagaaacaatgaatcaaaagtgaatccagacatctggttgggggaggccaaggagctcttcagaaagttagtgcaaagacgctggggaccaagggaggcagaagggtcaggacttagagaatcccgtaggccggtccaagagagtctgagaagcaaagtttaagagctggggtagtattaattaataaattaataagagcctcacccagcctggtgcctgtggatacagaagtaaaaaacagtctctgttctcaagttgttaaaagtctagaaagcgaatatttaagaaaccagggcaaagaaaaattgagatttaaaaaaactgaagatatattttctcttctggaggtttctaagtcaggcatttcttccaggctcaaaagaatggatgcctaatttacctgatgtacctggtacatcagcctcatagattgtttgccacacttttgaatttcacactggttttaaagctattttagttgtcttaaaaatgacatgccaatgagagcgggtaactgtgaacaacctacaaagaagatgactatgggaaatattaagaaataacaataacacaaagccgtgagaacagaagctctgaagctttgggtaatggcgacaaatgtggcaacttagtccctggatctagccctgtgatttgatagaatcataaagaaggcttagggattgaaccatttccacatccaatccacaaacatgaattcaaaggagtaaacagaaaactatgtttacaactttgtcagcaagagatatgggtatctattttattttatttttttttgaaaagagcaagacgagaattttaatcatttctttagtctcatcttggggtcaaattctccttagctgaaatccacagtgagcagatacttctcttactcatactttcatgagatagtcataaaatattgaattgctactatgttcaagacattagggcaggcactatagaaaacttcaagaccaaaaagacacacagatggtgaccccaaaatccaataagggaaattagacatgtttattaatacttgaaatcctatccaaaaggcataaagtttgataggtgaagtcagataaaacatactgaaatttcagagaagggtattgtttctcaatgtgagaagcaggaagtccttctggatgaggtggcatttgagacagacctccattcatccaatcagcaaatacttatatttagtgcctattatgtatagaactctgtgtaaggcatttgaggttgagcaatgaacaagaaaaatttacatttagttggggtggataatatatgcagttaagacaaacagataaattattaaaataatgcaggctataatgttctaaaggaaatacctgaatgacttcatagaataaggacaaggagctattgtagatataatttggaaaaaatgtttctgaacagaagatatctgaattgagttgtaaaagagaaggagagccagacacgaaagatatggaaagagaatgatccaggaagaaggaacagaaaatgcaagcaatcaataagctggcttctttaagaaatggaaagagataagtgtggcccaagtgtgagggcaagggaaaggaagggtgaaattagatttggaaatagggactgggagcagatcaggtaaggtcgtattttactctaaaatcaacaagaagccacttaagggttttaaacagaggagtaacatgaactggcttacatttatggaagattcctctggatgccgtgtagagaatgaactgtcaaaagacagatgtggaaatagggagactgcttaggtcacaactgtagaagtccaggcagtagacaatgggaactttggtctggatggtggcagacgagatggagcaaagtgctgcaacttgggagatatttaggtgataaagcttaaagaacttgcggatagattggatgtaggggtcaagaaagcaaaagaatttaaagtaattcttaggtttgagacccgagcaatgagacagatggtgactagtgaaccctctatactgatctggggaatgctggggaaaagcaagttagacaaatgtgtggctgggacataggaagatcgacattttgacaaattcataggaattggtcatgatgacatagagacaagattcatgccatggacattcatgacagaaaaagcaacatggactaaggcagaaaagtgtgtgtgtgtgtgtgtgtgtgtgtgtgtgtgtgtgtccaagaaactcaagtacttctgtttgtccaaggggcagggtctgtaaatgagggaaggagcttttgagaaagaggcaaggagaccaaccttgcagggacttcagtagaaactgaggagttcagctgttacttactgagtgggcaataggaggccactgaaagctgttgatgggataagaagactgccttagaaagatgaagcgggactggtgtaaagtttaggtgtgaaaccaagaattgaaggaagagagaaatgatggcaataatccaggccagggagagggaggaaatgaactaaatagtagacaggatggtaggtttacattttattttatactctctcctacaataccattactgaatttgagccaggtatcccatatctttgtaaagagttctacaactgtcaatggatagacagcttttctctcctccagtaagtctatgttctaaaaatgatcattagataaaaagtgacagaataagatgggagaaaatcactctgtgcatcagcacctttcttgaaaagcacagatgaacatgtaatatttctgggagggaacatgttcccgtcacccagagttttacattatgagactacgttgtgttagaatctcagataccactcagataattctgattctactgaaacaccaaggcatccccacaaaccaaagagccaggtccataaacaccatccagcttctgagagaacgtgctcctcagaagggagtctctgaaacagccagaaaaatagctggcagtgtcctaccaatagccaataaatacatagtacatcataaaccctgcttattttaatttcagtaatgtttttctttcactgggcacaaggccaggaattagataacctaatcttttcaagagagtagatttttcagagacacttactcctattgcttgagtaaatattacttgataaggggcatgacgtgctgcaattgtatatcttagattgtcatattaataaggcagctctccaaaccacctccacccaccaaaccatttctaaatcttttgaacttctataatgggtacaaattcagcttgaaaacacttatgcaattgggctccatgaaaaaaatttgacttaacatagccatttagtaaattttatccctgtccttcagtcccagtttggagcactttactcgatcatatcctttaatgtggcttagtggtagctactgcaccacagagcagtattttcctcaggagctgtatcttccttcttctctccattaaccactgtcaccccccatagtcatagtttctgttggcattttcctcctctgacatcttggctgtttgtcctttcttattcttcatccttttcttgtctatatacatttataaaacaccaggtttcactcattgctttaatggtaacttctgtgttttctgagattcagggctgagtaaatagaaggcctgtttttagtttgcttgtttacttgaggccatttttggtctaactagcatcccaactagaaccacccttcccctaggacatggtcttggtgatactgtcagttaaatacccttttgtgggtatctccaagttctaagttttccagatctcaagtcaccttggttcctgtcttatttaagacctaattatttatctttctctaattctgtgagctttctaagatactctcaataaactcccccttttggtgagcaagagtcattctgcactctgtgaaactagagagccatatgaatactctgagtagcttggattctgtagccatttccaactgatgaaaattaaaaccaactagacacaccttactaagtatactctcttgaccttcagagtctctcatctatttacactgttttccaaaacttggaggtcaaccagttactgtcagacaataaatatgctgttttttttctaactttcttcccatgtataattctggatgcttgaggtcagtgtgtatagtgcagtcatagcaaaaagagtccagggcagtgctgccaaaaagaaatataatgcaagccactgacacaagccacctgagtaattctatcttctctagtagcttttctagttgtagtgtggcataaatgaaacaaaaatataattgcacttataaaataataatggttaacatttaatggatacttacaatggaccaggtattgggatatacactttatatatttatatacatatatatgaggttatttcatttaatcctcataactgccttatgatgaagatatctttattaactctattttatagataagaaaactgaagttagagaaagagaattgcccaagtcatatagctagtaagtggtggagccagaattcaaagccaggcagcctgattccagatgccatgttaataattaccatattctccttttttccaaaaaaggcaaggaagaacatattgctttctgtgtcttatcaaccacactaaactatttggatacatttttgtactcctaaagcaataagcgattatcttagaagtatgtattaaattgcaatgtgttacaattaatatatagttttaaaaccaatttgctcaagtgttgactacaggactttaaatgaattccatttaaccagcaatttaaatgaaaatttaaataaatgctataaatgggtgcctcatttgcatcatctgttgatttactctgatatggggattatctttgcccagggttctgcctccttagggctttggtgaatcattttctaggtgaacaggaggcacttactctcagctctcttgcttctcaatgcacatgttgtaacattcacatgtggccaccttcagatacagaaaactgtacttaccaaattcctttagagttactaaatgtgattggaaagtacatattgagaagctcattggaatggcagtaaaacctttccaaggggtacatttaaattaaaacagatggtccaaactgccttctagggagggaggacactgttacctgcaagaaaaatgcattgctgagtagggtttgcaaatctggggccagagcttgaatttcttagtgaagtaggtagtgaagagggtgaggctgaaactcatccctttatgccacacagattcagcttcacctctatataaaattggagcaaatgtcctaaaaattgtagcttcctgggagtcatcacagtaacacaaactacattatagattgtaccgctggagtggcaaatgcaggtgccctgaggaatgcccacacatctcactgctactgtaatgttgagaaatgaagtactcgcagaacactgcctaacagatcatagtgacactggcctgggttattcctcagctgaaactcactgagagatgggtttggaaccatctaggatatgggccaaggatgtttttggccatttatgtgtaagattttgggatcttagagctttacaagcacttacagatcagttagcaaatgtcctcatgttgaatttgagagaaccaaggtttgatgacacagagattgcttgaagcctgtgtaaccccttctaaagattcaccagatccactaagtgttatctacattccaccactcgtaagcatctagaacctatttcatataatcgtagctagcatttatttagtgcttactctatgccatgtttttgtaggtcctttgtaaacagcagcacatttatacaaaacaacaactctttgaaaatacaaacaactaaactcactctggttaagtaaagcagaaaaaaacctgcttgaagggtatatcagctgtctatagttgtaccaaaaaaggaacccaaaatttagtagcttaaagcagcaccaacgtacataattgcttcggggtaattctggtcttgcctgggctcactcacacaactgcatccaacctgtgcattggctcagagctcagctcagccaggaagattgagatggctgggtctttctatgtaggcttttattatcaaagagataagacttgtcttcctcataaagtaataccagctttgaagacagtgaaggcaaaagctacagcacctcttgagatctcagatgatttgtcataaatatcacttctgctgtctagtggtcaaagcaagtagcaaaagcagccagactcaaggatatagagaaaaaaaaaaaaaaagctcacctcttgatgacagaaggcagttgtcacatcattgcaaagtggtaagcatactaggaagaaaggattctgaaaccaattttgcaatctatcatagtccagtctctgatcaaaattcatattcctctcatccacaaaatatcctcattcccatatgaggaccttccaaaatcttatctcattatagaattaggcttgaagtccagaatatcgtggtctgtgtcttgtctataggcagacaagactgttcagttatgttcttggtccagagacccctaaactaaaaacacaagttatcagatgtcgcacacaacatacaatagtcatgcaggccaggataatttctgcagacactctcacgaaagaataggaggcagagggtaatcactgtcttacagcagttctgaaatcccgctgggcacatacttcacatattaaataggatctgatttgccctctcgggtggtttcctaatccagtattctctgtggcccttggctccacactctggcagaagtgaagcagtggcccagcctctctgaagtcaaatgccgtgatgggtagatacagacataccagcatattgcagtttatcctcactctcttctcatctagatgcttggttattgatcctagagatatcattcacacacaagaaaaagcttctccagcccatttcactatcacagtttggcaattggacacgcctggattaccagattttcctacaagctccaacttggccattcttgccagttcctcaggaagctgatccgtgacttttctctgatttccaattctcccttatgaatgttttcttcagttcctgctacaattgtgtgtaaggtctaattcctataatacattccatattctataatgttctatacatataatatgttactgtatttaatcttcacaacagccatgcaagttacatactaacatccccgttttataaatgaggatattaaatctgagagaagttaagtaacttgcccaaggctacacagctagaaggtatcagagatcaaattcaaataggtctatatgattctcaaacctatgattgtaacccctattttccatttatggaaagagatgggatagggacagtaatgtgtactgataaattggtttctgaagaaaaggctctgattggtagcattcgcctatttctatggtgtaaagacgccgatcatggctaatttcagggccaattttaaaactggctcacaacatttctgaatatttaacacttgtaatgaacaagtatgaggtggtttcagcatgcctctgcatggggagccaagaaaacaaaagttcatcaattgaaaaaataacagaaacggagtagagtgtttcttcaggtgtctcttccatgcacaggctctctaatttccaaatgttagcatctcatatttttgcctgcagcctattttggtcagaacctactcttgcccacttacatgccaagtgtgaagatctaaaaaataaatatccatagctcagcatccttcaaccaataagtgatagaaactgatgtattaatagccaactttcttgttcttcacatgtggtaacactaatgtctgtcttcttcattaacacccagagttacccagcaggattaagctttagttacccacagtgagaaataccttactttattatgcatcctctattggctgtctccctgaaatcaccttacaaactaactaaccacactctaattcttgattcagagtctgattctgaaaaatctaacaaatacctattattttttgaatcccaatggaccagaaagacactgtactaggcacttatattacacgtttttggacaaatattcatagcaccctagaaggcaagtatacccagttctacaaatatggaaatatgaggatcagagaggttagttaactctatggaggtcacatagctgatatagtaaatagcagcgctgatattcaaattatgatcaattgtaacatctcttctctttccatgaatctatgcagcctctctcaccagaaagattgaactaacacacatgaaacaataaaagaacaattaaatgctaagctgacatattgtattgaacaattttgggcaaaactgtcatcaaacttatgttccgcaattactttctaaaattctcttttttgtgccatcaacttgaaaaataaggccactgactaatattagggaatccaatttttcataagttttctttatcctctatcactgcatcatacaaattaggtactgaaataaaactgagtgtcatgacagaatataccatgatgaaaatgcatatgaaggaaatacattgcttgggtatatttttcggcccacatagcatctgaaaaatcagatacatcataaaataccaactaagtctctattgattttgtaagtcaacacaaagtattaaaagatcaaacaacacagcatacagagtgctgaaatgggaatagtcttatcagctaacaacatcagcaaaggaaggactttgatttgacttttgtctgttaaaggggcaaaatctgaagtgtggaaatttaagatggttaatggtgtagtattaccatatagattttaatatttaaccataatagattttaatatttaacagtggcttgctgtcatcaagtaatttagatagttgctctacaatatttaacatgaagaaggtcctgaatgctgaaattattagcactacaccaaaaaatctcagatgctggtagaaacacacataaattccaagtatgatttgatcagtgtcttacaggttttgtttcttacttttaattacctgtcctggtgatatgcacaaaagggaaccctctggagtttggggtgagagttttagccctgactctggcccccaagtagctctgtggctgcaagtactttaacctttctggttaaatgatactctcagttaaataatgctctacaaaacaccttgtcactctaacaatgattctatggctaaagcctaattttaaaattaagttcttatttacgtaactaacaaagatcacattctaccatttctaaaagtggtccttattagtgctcttcagaaccataaatttctaaaatcgtccaggaccttcatggaagtagctcagggaaggaagtgatggagaacatgagcaagtagtctttttggcccatgaggcctactttaggtatagaaatgcaattttaactgaagtatctctgtaaattattttccttaaacaaacaggctggaatgaatgcatgaatactttggcttaaattataatatgactgatagacatttgatacccatctcttttccctcttcataaaatgcataacttatctactgagacttacttatcacaggacactccactcagaggcctgagacccagctttgaacatatttacctttggcaactgcacttatccaaagacagtgccagtggcagtggcactagctgaagcagtcaattccatttgttttaagcgtattgtggtgctatcatttttatgacactagggtatatagagaaaatatagtatccttattatgttctttaattaatcctgtcttccacatgagcccacattgctgaaaaaaaggtaacaacatttattttatttagtccaatctggttaaaacatgatatatagtaagttaaacagttcgtttaggcaatgttctgtttaactgtgtaaacatgtttgatatctcagatttccacttctctgaatacttttcttgatgacttctaggtatgtggggagtaaagaatgtctcactcaacctcagagtggaggaagagtggtggagtccttggatcactgcagtgtgtactgactggtacctttgtccctgggcaatctcacttgtctacatctttagagcattcatacctggctgtcatgtgggatgcatactcatggcttcttatctctcatgttagtcagagactggggttctctctgaatgaggtggtctcactttagcttttggtgatggtatagacatttctgggcttatgccccatccttccttggctccccagtagagaaaatgcatcccatagcttttgccttcatcctcatcagagaaagcccactgggaggaccaagggtactcaattaatctaccttcctctgaggacaaaaaggcttttctgaatcatttccaccccttgaagagatcaatacaggctctccctctctatcctactttagtgagccatcactttggctttgataagtctgcaaggtgatctcctccaagagaagctgataaaggcctatgttgttgcttaccatatttccataaaactatcatataaccatccactgtctctccacccctgcttccatcccaagtaataagaaatcaagaatgtgaatttctgcactcgtctctcttgcttaatccttctttctcttctcattgtcacttcctgccagaaatggagatttttccgtgactttgcctgcattaaatattactttttcttgatgctagcctcatgggtagccattgaaggtgcacaaaaatatcttttctgcaccaggaaaaaaactctgtaattttgttctctaggcaaaattggttaagttaaagggaaaataaaagaatgtagaaagcccaaggcaatagtcggaatgataaaattattgttttgctttgaaactcctattttgactgcctgaatctaaacagtaactgcctttctctttgcattctacttacaaagatcagaatctttcacagccagacactgctggcataaaggaaggaggtattcataaaggcagcagaagaaaagcacagtaattttttaaatacattcctgaaaacacagtcctctgcctctgagttatacatctatggattcaataaatattttaagatattaaatatttttaaaaaccaacaatgacagtgcaataaaaaatacaatttttaaaatacagtaaatatttacatatcatttacattgcattaagtattgtaagtaatctagagatgatttacgtatacaggaggatgtgcacaggttatatgctgatatggtttggctgtgtccccacccaaatctcatcttgaactgtagttcccataatccccatgtgtcatgggaggcaactggtgggaattaattgaatcatgggagtgggtttttcccatgctgttctcatgatagtgaataagtctcatgagatctgatggtttttataaaggacagttcccctgcccacactcttgcctgctgccatgtaagatgtgcctttgctccttctttgcctatgccatgattgtgaggcctccccagccatgtggaattgtgattccattaaacctctttcttttataagtaacccagtctcaggtatatccttatagcagtttgagaatggactaatacatatgcaaatactatgccattttatataaaggaattgagcatcttgtggaggattttggtatccacaggaggtcctggaaccaattccctgcagattctgagggatgactgtactctaaaattttatggaggtgaggattaaatgactgtaaatttgttaaaaatggaattgtactcaaattgatgaatgttgtggaatataaattagacctcaagaaagctcctaaaaaattatatgcagtataaaaaagagtgaaacataattggccacccccttttcagctgtactatggactcttactggtgttgcttatgagagcagtgcaaatggagaaagtaaggaaagaaagcataggcattgtccttttccctaagggttagagatcaatcacattcccagtgcagttaagtgagtagaaagctgtaatattcctttcaactgggacttacctcacaattctgtttatatgtgtatctcttgagcaataaaatattatcagcttttccaaatcatgggcataaattgtaattatgcttgtatacatttacataaaaatattttcatttacatacactttgtatgcaagcttcctatctgacaaaatcatataactagaacatatgcaagaatacagaagaatgccaaaaattagaacaatgtgaaagtaacagatacttaaactcttatagtagatcttaacattttcagaggcaacctaaattacactatatgtaattccaaccttttttgggctaaaaaactagaagacaaaacaatggctaagcttgttaaatgcaatacacaaaagcatcaagtggtgattaaggatgctactggaattcaagagaaggaagaaaatatcactgaccttcatgggagaccctgatgagggagatggcaacagtataaaaaaagatataagaactcaagaacagcaatctgagattgttcaatgaagggacaaacaactggacacatctctactctttagaaaatattacgttatgatcagtgctgtctagcaatgtcaaaatacaacaaaaaaatgataaatttgttaagggactgctatggtttgaatgcttgtctcctccaaaaactcatgttgaaatttaattgctattatagcagcattaaaaggtggtacctttaaatactataaaaagtaattaggtcatgagggctccagcctcatgggtgggggttgaagttgttacaaaggcaagagtgtagcctcctgttgctgtcttgcctgtctaccttccatcatggaatgatggagcaagaaggcttgccagatgttgacccctcaatcttggacttcttagctccagagcagtaagccaataaaattgtttattataaattacccattctgtggtattctgttatagcagcacaaaatagactaagacagtttgacaagtttctaaatagttttacacacttttctatccttaaaatatttattttttttaattaggtattttttattgtggtaaaacatgaataataaaatttaccatcttaaccatttttaagtgtacagctcagtagtgttaagtatattcacattgtttatttggacatatataacaatgtttcacattgtgaaacagatcttcaaaatattttcatcttctaaaactgaaactgtatactcattgaataattccaccttccccctcgcaatccactggaaatcaccatcctgttttctgtttctgtgaattttactactttaaatacctcacataaatggagttatagtattggtctttttgtgactgacttcactctgcataatgtgatgaaggtttatctacatagcactgacagaatttcctccctttttaataatattccattgtatgtatacactacattttgtttatccattcatccaatgatggatacttgggtagcttccacctctttactatcgtgaatagtgcttctatgaacattggtgtgcaaatatctctttaccctgttttcaatttttaaggtagatactcagaagtagaattgctggatatggtagttctatttctattttttgatttttcattttaatgctattttacatagcagttacaccattgtacaatgtctctaacagtgtacaagtgctccagtttgcccacatactctccagcacttgttattttcaggtggttggttttttttttatagtagccatcttaatggatgtaaggtgatagtgtggtttcagtttgtatttctctaatgttagtgatagtgagcatctttgcgtacatttgttggttattggtgtatcatctttgaagaaatgtcttttcaagtactttgcccatttttaagttgagtgatataattgttttgagttctaggagttctttattcacaatattatccgacgtattatttgagaatattttctctcatcccatagattgccttttcactgttgattgtgtcttttggtgcacaaaaggttttacgtgtgatgtagtctcatttgtctatttttgcttttgttgcctgtgctttggtgtcatatccaataaatcattgccaaatccaatgtcataaggctttctctttttgtttcctgatagaaattttatatttttgggtcttgcactacttctttaatccactttgagttgatttctatatacagtataataaaaagatccaatcttattcttttgcatgtggatattcagtattcccagcaccatttattgaagagactgttctttctccatagagtggtcttctagcctttatcatagatcacttgactgtatatgtgaggggttatttctgatttctctatcctattccatttatcaatacgtctgtctttatgctagtaccacagtcttgactcctgtagctttgtagtgttttcaaatcagaatgtgtgagtcctctaaatttctttttcttttaaaaatcattttggcttttcagattccttgaaatgccatgtgaatttaaggataaatttttatatttctgcaaaaataatgccatttgggttttgataaagattgtgttaaatctgtatattgctctgggtagcatggacgtcttaataatacaattttctaatccatgaacacagtatgtctcttcatttatttgtgtctttaatttcttttagcaatattttgtagtttttagtgtataagtctttaatctccttcattgggtttgttactattttttatgctattgtaaatattttaagtttttaaataaaaattttaattacttggctttttaagagattagcagtgagagagctgtggaaagacaactggtatcccacttgtctaagtccttcaactctaaatatcctatttgctcatccaactccaaatgcttccacgtcttagtctacaaaattctgctattccactgccaataaggaacaggaagggaatgagagggatgcattccatatgatcttggtgggtgtgaggacaacactttctacggtccgtctctaacttgaaaagcaacagccacagtagtcacagatcagacaacattaagtagaatatttgaaccgcatatggtgacctgagatgaagcccagctggggaaggaagatgccttccctgagacaatcccatttcatgagaactttgtgatatacttttcaaaaattagcatcaggcaaaaactcatattggtgatctctgattcccttcctgtgcaagtctgcagcacctgtcgaagggacagtccttaaagaggtggtggcaacagaagcagaaccaaattcagttccctaaatccacgagagatggaatctgagcacaggttcaggaagttaccaacctcaaccactataacttcatcagtagccaaaaaaacttaatctatttacctcctacacttatttttctatcatattttctatctgtgctgtttccattctgagcagaaagaatctttgataccgccctttttcagttacactatattacgagtgataaaagtcaaaggtgtcccttcctcattatacattgcatttgttatttggtttggaggatatatttaaactaatctttattaaaaatcatactccccagagattttcatgcatatgtatacatataattcaatgtgataaatatttattgagggaggaaggtagaaaatacttattatgccaggtacttaataacatatattctctatcaaccctcacaaaaccctaggaggtaagcagtgttgtttcttatcacctttatcgtatgggggcagtgaactgatggctcattgctattagagtcagaacccaagcctcagtctatatcagaataatgttcaaactttgtttttcccctttgctctcctgacaagcacctagtatttgttcaataccaacttaaccaaatataaattgatcaagatgatcatttgtaaaaataagtatttccagtcactgatttcctgggattagtaattctggcgtgttccttagcaaatttctaactcctcattatgccttagaacattattaatctttttccagaattgcactgttcctccattttttgcttctatatttttaattaatttccagccaattatttttttcttctgtcttatctatgatttaaagatgttaaaataagtatccagcaacagaggattaattagaaaacattttagattccaatgtaagaattttttaaacaatagaatgacattcatgcctgtataagatgatgaaaaccaaaccagatggataaagctaaaaagcctggcctaaagtaagtgagaaaagcatttaagcaaaacaaaagcttcatccccaccaagttttgttttctttttgacagaaacaatacaaactcattacagaaaatacagacaagcgaatgaatctaagaaaaattctattatcaacccaatcacccacaactacttttaattcctaggtgtaaatattttccattccagtttcatatgtataaatggatgattatttttcaacaaaacagacttctatataaactatctttcaaactactataaataagacagcatttacatttttattttaaattttattttatacattttttataaaattaaattttatatatttacttttaatagaggtgagatctcaccatgctgcccaggctggtttcgaactcctgatctcaagtgatcctcctactttgtcctcccgaagtactggagctataggcatgagccaccgtgcccagcctatgtttttaaactaatatttatttctaagcaatttaatgaatatgaatattttactattggcagagaaaagaaataattgccagaaaattaataaagagatcaaaaacagattagcaataaatttgaaaaattctaaatacacatcaacaaaaggcttaaaatataaaagtttgcaaaactgccccataatgcatcacaatgaaaattactaatatttgaactaattggtaaatgacaacatcaatttttaccaatcattataatggttcatgaagctaatacaagaactgtacttgatcgcctaataagaagcccaatagataaaatgacttcatgcttttttctggaatttgaggattagattgaggaatgtactgtagtcaagaggactagatatatccaaaagaagaagcaatatggagccatttctgcacaccaaaagacaaggtgttgatttctcaccactaatttttacagtatccatagtttctgcagaagtaagcaagaccgtcccccatgagtaactgtgcagttttgcattataaagaacaaactatggacacaacaagagcaaacttgggctggtgagaagaggacagggcaaggccaagggatggggagtggggtggaatagcaatgtctgacaaaggggcatcattgaaggaggggactctgacctaaccagtgctgttggagcctgttgaggtagaatgacttctcagcatggggttagctttatgctaataattcatgttgtaactgtttgctcaccacaactgcgttatacagagaagactagacaattctgattgctttgcagcatccagcctgaatggagcttctgggtcccaatctatattgttgtgtgcaaggtcacagcctagagctcctggcaggcagcataagatagacagtggacaaaaccacagacaatggagttgatagggtacattggagcttcggtcacaaatgcagtctgctacttctttctacttaataatgataatcataataacagcagcacgtacagaatgagccagtgctaagtgtttacaggtatcatctcatgtcatcttcaccactactctgggaggcaggctctgttactagttacagataaggaagctcgacctcagaacttgggcagcatgcccaaagacatagttcagtgcccacagtgcctagacttcagtaactggtagagcctggactccaacatggtgtgtcacctcacctcattatagctgttacttaatagagtacttagcatatgcagtcaaggactgagaaggaggacacactagggttgtacaaactggagttaaaaagaaggtgctgtggtttgaatgtcccctccaaaactcatgttgagactgaattcccaatgtggcagtactaagaggtggggcctttaagaggtaattggattgtgaagcctctggctctttgagaaagcatttatagattattgagttaatgaattaatgggttatcataggaagggaacctggtagctttataagaagaggaaaagagacctaagtttgtgcattagcactctcagccccttcgccatgtaatgccctgcaccaccttgggatactgaaaagaatccccacaagcaagaaggttctcactagatgcacccacttgaccttggacttcccagcctccagaactgtaagaaataagttcctattttttttatgaattattttgttataagcaagagaaaagagactaagaggcagtcttcaggaaaaatgttgaaccgtgagcacaaaagtagtgaaatccagattgtcaattttacaagctgaatggccctggttcttcaacaggtaaattttaagaatagaaaagaaagagagaatctatacattaaaaagacatatcatagtttctaaatggtaaaactaaattgttataactagcaatgcatatatgaatggtaaaactattttaaaaatgcaagaaagtaatgacagtcaatgcttggtgttcacaggggattggtttcaggtcccctatggataccaaaacccgaggctgctcaagtcccttacgtgaaagggtataatatttgcatataacctaagcacatcctcctgtatattgtaaatcatctcaagattatttataacacctaatacgatgtaagtgttatgtaagtagttgttatactgtattgtttttgcgttattttttgttttttatttctatttttttaaaatattttccttctgcagtttgttaaatatgcagatgcagaaactgcagctaggaagggccaactgtactatcaaaatcaggatgctggttacttataggggagaaaagagctctgggaatggggcacatagaagagccttcttagacaatggcaaaattatatttcctcatctgggtggtggttacgagtgtacaaaataatatttgggtgttctatgtgtgcatacctcataattcaaaaaagtttaataaacagaaaacagaatcaccatcgtggagttgcggagaccctcaggaatcctcagaagctcatagtgaaagccaagtgggaaggagagagaagaggggtgttccaaaatccctgagtgtcagcagcagatttagtagggacagattctgagacatttttttcaggatttttcccattccatacctattatccccaagtgggacgcaataggggtactgccttcaaatcaagagattaggacttctcattagaacttcttattctttcttcaagagaaggagtatattagggctgcataacaacaaggagacagtctcaagggcactcaacaagtttatcagagtgcctatgagggaagatattaaaaatgaagtagggctttcctttaagactgaaaaagagttccctacatgaaaagtaatgtggctggtggatcctggaaaaagggaccctgaattccacttctgtcagaaaaccaaagaggcaaccagatgttagaaagaaaacaatgtcatatgttcccagaaacagtgcggaaccaacagtaaaatttttgcaatatatataaatgtataatattaaaagtttactcattcatacctctattcgcaaatgttaatttaaaaacagagaaaagttgtattagtacattttcatactgctatgaagaaataccgaagactcggtaatctataaaaaaaaaaaaaaaaaaaaaaaaaaaaaaagaggattaatggactcacagttccacatggctggggaagccttacaatcatggcgggaggcaaaggaagaccaaaggcatgttttacatggtgggaggcaagacagcgtgtgcagtggaactgccctttataaaaccactgagtccctcccatgatgtgtggattatgggaactacaattcaagatgagatttgggtggggacacagccaaaccatatcagaagccatcttactttacaaagtttctcgttcctggagctgcctttgcagacaaagaaatgatattcaatggtggccaccttgcaaacacctcaagcacacgtgcaaaacaattagggaacacttacacaggaggtattcgtgaactgtcagaaaatgtatacataacaaagcaaaagccaaaagcagaaatgagaccaaaagttaaccatgacttacagcaaagcaatgtatttaacgtggcaacatgctgaaaaattaatattcttagtcactggattccagttaactttttttttcctactttgagtttctttttaaatcacgcatctcttttaactcaattatgcaattttggaatgctgagaggttggaaactactgaaatgttcaaaaagagttagaggagggcaaatttagaaaattagctgagaagacaaccttaagtgcccagtgacaggtggtacagtataagtgatcttataatatacatagtttatatttcttatactgcattccctccttgtaaaagcaatgcaaattcctacataagaatcagaaatataatcaaaagaatttaaggaatattcacaatcccatctacctagagacaacacctattctttgctatctagccacctagaacctcttgcaatgtgtagtcattgtccaaacatgaaatgcattcacatagtattctatactctaccataatttattttagccatccagctattagatatttagatgttccaaacaatgcctctttgtttgatatgtaaatggttactaatttttactattacaaacagcttcaaggaggcaaaggtgaatataaacttaagatttaaatgcaaaaatgaaaagaacttaagatttcgggaatcatgcattgtcatgattcttgtcactctaaatcattcatgtatgagtttactgaacaaacacatgttaaatatatgtacctattatgtgccaggcactttgctagatgctggggatgcagtaaatagacagatgtgttccataccctcatagacatcagggaagaaatagatatatagaattacaagcatgtaaaaaagaatgatgatatgggcaatacagcctttaccaaacacattagaaaaaccagtgaacagagataaaaatcttgaaacatctgtggtggtaactccattatgccagtgaccaaaatcctttctgaaaatcgcctccctatgaatcacctggactcttaattcattctcctgttttaatatgtaaattaactactcattctttcctaaaactgaaagcccaaattacaaagactcagcagcagaccaaatgtatagagtgtggggtaatcatgcagctagtggatattcttcatcaataggtgaatatgagattgtgcttggtagcattgtggagttgagtgaacatcaccatgggctcttcctgtaaaatcacatggtgcttaacacatttcaataacctcattaactttcacatacaattttctgaacataataagtctataacctactacctgccatgcattgtgcatattattcctaatcttcatgataatcctaaacagtagatatttttatccctaccttacaaattaacaaactgaggctcacagaggttaaatctggtatccagagacccaatctgaacaggctgtcggctagagtatttactttgcattcttccttccttccttccttccttccttcctgtggttaccaacaagagaacagctgtggtgagtctgcctgctcccagggtactgccttataaaatggattcatctgtcatgatctgagaggaacagaatcagtaaacctaccccaagagaagggctgttatagagagttcatcccttgggatgctgcccttttccctcagagccaagctgctttgatccttagcaaccaaacagcagagcacatatacatgcccctgagagaggggcagtgagctgcctcctcaggactgccacatccagccctaccatgagtgcgaacctcccaaaactgacagcttttctccccatccttcccactcaaagaggaaacaatgctactgtcatttcaaggaacttaaagccacacacatctcagggtcttctccagcattcttcctgtggtcccagcagaggcaggcaaaggaggctgttccaggtcactggcccatattctgtaacataggccagggccagggattaggtgttaggagtgtaggggtgcgggactctggagtgagagccctgggtttaacgcccagagctgatctttaccctctccaagacttggtttccttaaaataaaaaaaaaaataaaaagcagatcataatagtatccccattgacttgttaacgaaggttacataagatggtatttgtagttcggcacagcaatagtagggaccatgcacccagtgatgaattttgcctgttgggggtttcatttaaatgataagaaataaacaaaaaatgaaaaagtcacagagaaaaagagaaaatctagagtggggtaaaaaaaaaatacagaaattttggtcccaaatgtcatgatttcaattttattacaacatgccagtcttataatggtatataaaagccagcatttcaacaacaaatttttgacccaccatgaaaactagagttttacttctcttttaaacatgttttaacaagaatcaaagctattcaggaagaatggaaagttgtgctattatttcaagtgatagagaaaaaacattatttgagtctgaagaatcattcatttttaatataatgaaaatttgaatctgatataactaattgcttaaacctctcttgcatgtactacagcaagatcataaaagatatcaaagcataaagagcagaataagaattctttatctgcaacaggattccctatggtattcttccgtaatgtataggtctgtaacagatattcaacaagagaatttaagacaagatatcatttaacatacgaattcaatgttaccttcaggatctcatcatacatacttggaggattacttagtctgacagatagttgtcttgtactcttttaagataccatagcaagcatttggcataattaggtgtgttgctgccttatcacctgctcaaggataaccagagagcaacccaagaattgtggtgttttcagaaattcagatttaaggcaaactttgaactttactatttataaatcatatattcagctaccaaagccaccacaagctacagacatgctttgttacaaggtacatgcttaatctaagaaaagtagataccttggtttttttgttactgtttttaaaagtttctatcatatttctgaagactatgctatatggctttaaaacaagaattaaggttaaaaacaaaacagcagggttaaggtcagataaaactattttaaccatccttccttcacataaagaagtctcctgtattattaggattcctaaataatctatacttttcaatccattctcaaatagccaaatatttattttatttatttattttttgagacagagtcttgctctgtcacctaggctggagtacagtggcgcgaatcttggctcactgcaggctccgcctcccaggttcaagcgattctcctgcctcagcctctcgagtactggattacaggcacccaccagcacgcccggctaattttttgtatttttagtagagatggggtttcaccatgttggccaggctggtctcaaactcctgacctcaagcgatctgcccacctcggcctcccaaagtgctgggattataggcgtgagccatcatgcccagcctaaccaaatatttaaataagtatgtgctgaccctagaaacattaagagtctgacaaaatgccttagcagttttcagtgtcagttgtttttcttctttttaagttttattgtttttaattgagacatcataattgtacctgtttatgggctacaatatgatgcttcaacacatacatacattgtttaatgaccaaatcagggtaattaccatacacctgtcatttcttggtggtgagaacactgaaatcctctcttctagcttttttgaaatatacattatcattaactatattcaccctactgtgcaatacaacactggaatttattcttactaactgcagctttatacccattgacctacctttctacagccctctccgctccccagcctctggtaaccactattctaactttctacttctaagtgccaggttttattatgccatatataaaaataataatgatagtacaagttttaaagtttttttaaaagagcgtcaggacagttatgctggaaactctccctgggacattaaaaggtgaaatatttgtttcagccaaatggtttctgcctcaccaactactgtgcaaaattcccagccctgaaaatgactgatccgcaggggaccccagctgagttacctgacctacctgttgagcagatgcccccagagagcttcaactttgagacttcattaagctgtgttcagcacaattcaaaaaagttattgatacaaagaggagttattcctggaggatcactcctaaaacgccaacaactagttagtgagaatacctgaataacaataatgataacctttcaaagaagcagcaactattattttacagaaatagaactaagtggcacctgagttataaagacagtttggaggaattctgctgcatacgatctttaaacaactaaggtccccgttctcaatctgcagctctgaaccaaagaacattaagggcatcacctactctgagatgacggtggcctcttttaacccctgtttatagaatagctggctgcaggtgaaaggactgagatgatgctgtccttgtcccccagaaagaagcaaaatcatcttttttacagggcaggtacttccaatctaactagggaaacatgcggcagttcgccaagcagtaaaatctcaatacgcatttatttaacaaacgcccgttatgtcttaggcgcggttcttcgcgctttataaaagttaactcatttgattctaaataataaccttttaggtacggaaaacggagaaaaaatccatgaagatggggactttctacccaccccagccgctttacaaagaaataaccaaacttctagtccccaggtcaaaaataaggagattaaaacccagacaggggaggttaaggacaaaaaccgcagccgcgctgagtcgttaccgtccacaggacactggcggtccgagtcgctgctcatctccgctcccccactccaggctgccccgggcgcggctcccgcagtct
